United States Patent 9,205,144 (IDENTIFICATION OF CONSERVED PEPTIDE BLOCKS IN HOMOLOGOUS POLYPEPTIDES) - sequence listing, part 8

SEQ ID NO: 265849 - protein, 3436 aa, Japanese encephalitis virus
  MOD_RES (21)..(22): Any amino acid
  MOD_RES (111)..(124): Any amino acid
  MOD_RES (150)..(161): Any amino acid
  MOD_RES (180)..(184): Any amino acid
  MOD_RES (267)..(267): Any amino acid
  MOD_RES (291)..(297): Any amino acid
  MOD_RES (318)..(322): Any amino acid
  MOD_RES (364)..(367): Any amino acid
  MOD_RES (423)..(423): Any amino acid
  MOD_RES (442)..(445): Any amino acid
  MOD_RES (683)..(687): Any amino acid
  MOD_RES (703)..(717): Any amino acid
  MOD_RES (743)..(757): Any amino acid
  MOD_RES (781)..(792): Any amino acid
  MOD_RES (815)..(825): Any amino acid
  MOD_RES (858)..(862): Any amino acid
  MOD_RES (874)..(889): Any amino acid
  MOD_RES (951)..(959): Any amino acid
  MOD_RES (1133)..(1133): Any amino acid
  MOD_RES (1145)..(1148): Any amino acid
  MOD_RES (1220)..(1228): Any amino acid
  MOD_RES (1344)..(1356): Any amino acid
  MOD_RES (1371)..(1374): Any amino acid
  MOD_RES (1390)..(1419): Any amino acid
  MOD_RES (1448)..(1450): Any amino acid
  MOD_RES (1489)..(1508): Any amino acid
  MOD_RES (1587)..(1596): Any amino acid
  MOD_RES (1611)..(1611): Any amino acid
  MOD_RES (1668)..(1669): Any amino acid
  MOD_RES (1730)..(1731): Any amino acid
  MOD_RES (1749)..(1750): Any amino acid
  MOD_RES (1765)..(1833): Any amino acid
  MOD_RES (1853)..(1858): Any amino acid
  MOD_RES (1872)..(1872): Any amino acid
  MOD_RES (1900)..(1931): Any amino acid
  MOD_RES (1961)..(1965): Any amino acid
  MOD_RES (2000)..(2016): Any amino acid
  MOD_RES (2036)..(2051): Any amino acid
  MOD_RES (2071)..(2076): Any amino acid
  MOD_RES (2096)..(2096): Any amino acid
  MOD_RES (2109)..(2120): Any amino acid
  MOD_RES (2146)..(2153): Any amino acid
  MOD_RES (2173)..(2174): Any amino acid
  MOD_RES (2216)..(2243): Any amino acid
  MOD_RES (2264)..(2264): Any amino acid
  MOD_RES (2318)..(2333): Any amino acid
  MOD_RES (2353)..(2372): Any amino acid
  MOD_RES (2405)..(2452): Any amino acid
  MOD_RES (2494)..(2516): Any amino acid
  MOD_RES (2590)..(2599): Any amino acid
  MOD_RES (2641)..(2642): Any amino acid
  MOD_RES (2672)..(2716): Any amino acid
  MOD_RES (2736)..(2768): Any amino acid
  MOD_RES (2794)..(2796): Any amino acid
  MOD_RES (2855)..(2857): Any amino acid
  MOD_RES (2877)..(2885): Any amino acid
  MOD_RES (2901)..(2901): Any amino acid
  MOD_RES (2963)..(2963): Any amino acid
  MOD_RES (2994)..(3017): Any amino acid
  MOD_RES (3087)..(3099): Any amino acid
  MOD_RES (3137)..(3147): Any amino acid
  MOD_RES (3198)..(3205): Any amino acid
  MOD_RES (3247)..(3252): Any amino acid
  MOD_RES (3271)..(3275): Any amino acid
  MOD_RES (3351)..(3351): Any amino acid
  MOD_RES (3376)..(3381): Any amino acid
MTKKPRGPGISRAINMLKRGXXRVFPLVRVKKVVISLLDGRGPARFVLALVSFFKFTALSPTKALSGRWKAVERSVAMKHLTSFKRELGTLIDTVNKRGRKQNKRGGNGGXXXXXXXXXXXXXXAGALKLSNFQGKLLMAVNNTDIADVXXXXXXXXXXXXWVRAIDVGHMCEDTITYEXXXXXAGNDPEDVDCWCDHQEVYVQYGRCTRTSHSKRSRRSVSVQPHGESSLVNKKEAWLDSTRATRYLMKTENWIVRNPGYAFLAVXLGWMLGSTTGPRLGFTILLLLVAXXXXXXXLGMGNRDFIEGVSGATWVDLXXXXXSCLTIMANDKPTLDVRMTNIEASQLAEVRSYCYRASVTDISXXXXCPTTGEAHNKKGADSSYVCKQGFTDRGWRNGCGLSGKGSIDTCAKFSCTSKATGKXIQPENSKYEVGIFVHGATXXXXHGNYSAQVGTSQAARFTITPNAPSVTLKLGDFGEVTLDCEARSGLNTEAFYVMTVGSKSLLVHREWFHDLALPWSSSSNTAWRNRELLMEFEQAHATKQSVVALGSQERSLHQALAGAIVVEYPSSVKLTSGHVKRRLKMDKLALKGTTYGMCTENSSFRKNPADTGHGTVVIELLYSGSDGPCKIPIVSVVSLNDMTPAGRLVTVNPFVAASSANSKALVEMEPPFGDSYIVVGMGXXXXXHHWYKPGSTLGKAFSXXXXXXXXXXXXXXXAWDFGSIGGIFNSIGRAVHQVFGDAXXXXXXXXXXXXXXXMGVLLLWMGVNARNRSIALAFLAXXXXXXXXXXXXHADTGCAIDTARNQMRCGSGIFXXXXXXXXXXXYKYLPETPKALAKIVHKAHMEGICGVRSVTRLXXXXXEAVRDELNVPLXXXXXXXXXXXXXXXXRYRSTPKRLSMTREKFEMGWKAWGKSLLFAPEMANSTFVVDGPETKECPDVRRAWNSTQIEXXXXXXXXXRVWLKIREESTDECDGAIIGTAVKGHVTLHSDVSYWIESRFNDTWKLERLVFEEVKSCTWPETHSLWGDDVEESDLIIPHTLAGPKSKHNRREGYMTQNQGPWDENGLVPDLDYCPGTTVTITEDCSKRAPSLRTTTDSGKLITDWCCRNCSLPPLRFRTGSGCWYGMEIRPAXHDETTLVRSRVXXXXGEMVDPFQMGLLVMFLATQEVFGKRWTARLTVPAVLGALLVLMFGGITYTDLARYVVLVAAVFAEANSGGDXXXXXXXXXFKIQPAFLAMNMLSTRWTNQENVVLVLGAALFQLASADLQIGVHGILNAAAIAWMIIRAITFPTASSVTMPVLALLTPGMRALCLDTYRIILLVIGVCSLLQERKRTMAKKKGAVXXXXXXXXXXXXXPTTIAAGLMACNPNXXXXWPATEVLSAVGLMFAXXXXXXXXXXXXXXXXXXXXXXXXXXXXXXGKATDMWLEQAADISWDMGAAITGSSRRXXXKLDDDGDFHFIDVPGVPWKIWVLRMSCIGLVALTPWAIXXXXXXXXXXXXXXXXXXXXWDTPSPKPCAKGDTTTGVYRIMACGILGTYQAGVGVMYENVLHTLWHTTRGAAVMSGGGKLTPYWGSVREDRIAYGGPXXXXXXXXXXNDVQVIVVEPGKGAXSIQTKPGVFCTPFGKVGTVSLDYPRGTSGSPILDFNGDVVGLYGNGVELGDRSYVSXXVQGERQEEPVPEAYTPSMLRKKQMTVLDLPPGLGKTRKILPQTIKDAIQQHLRTAVLAPTXXVAAEMAEVLRGLPVRYQXXAVQRSHQGNEIVDVXXXXXXXXXXXXXXXXXXXXXXXXXXXXXXXXXXXXXXXXXXXXXXXXXXXXXXXXXXXXXXXXXXXXXDAPIHDLQDETPDRAWSSGXXXXXXWSTEYSGKTVWFVXSVKMGNEIAMCLQRAGKRVIQLNRKSYXXXXXXXXXXXXXXXXXXXXXXXXXXXXXXXXIDCRKSVKPTILEEEEGRVILGNPSPITNXXXXXRRGRVSRNPSQVGDEYEYGGATSEDDGNLAHWTEXXXXXXXXXXXXXXXXXLYGPEREKAFTMDVEYRLRXXXXXXXXXXXXXXXXPVWLAYKVAPNGIQYTDRKXXXXXXRTNAILEDNTEVEIVTRTGXRKVLKPRWLDARXXXXXXXXXXXXDFASGKRSATSFIEVPGRMPEHFMGXXXXXXXXMYLVATAEKGGKTHRMALEXXPDALETVTLIVAIAAMTRGFFLLMMQRKGIEKMGLGALVLVXXXXXXXXXXXXXXXXXXXXXXXXXXXXVLIPEPEKQKLQTDNQLAVFXICVLTVVGVAAANEYGMLERTKADLKSMFAGKTQVSGLTGLPSVALDLRPATAXXXXXXXXXXXXXXXXHLITSEYVTPSLASISSQAXXXXXXXXXXXXXXXXXXXXLVLLGCWGQVTLTTSLTAVVLAILHYGYMLPGXXXXXXXXXXXXXXXXXXXXXXXXXXXXXXXXXXXXXXXXXXXXXXXXLLIGGSVAAFLVNPNVTTVRKPGVLVTAATLSLWDNGASAVXXXXXXXXXXXXXXXXXXXXXXXAWTLIKNADNPSLKRGGPGGRTLGDQWKRKLNAMGREEFFKYRREGIIEVDRTEACRARSENNKVGGHPVSRGXXXXXXXXXXGFVSPIGKVVDLGCGRGGWSYCAATLKKVQEFRGYTKGGAGXXEPMPMQSYGWNLVSMKSGVHVFYKPSEPSXXXXXXXXXXXXXXXXXXXXXXXXXXXXXXXXXXXXXXXXXXXXXPYMPKVIEKNEVLQRRFGGXXXXXXXXXXXXXXXXXXXXXXXXXXXXXXXXXQVLLGRMDRAVWRGPRYEEDVNLGSXXXAVGKGEVHSDQDKIRRRIQKLREEFGTTWHKDPEHPYRNWTYHGSYEVRATGSASSLVXXXVKLMSKPWDTIANVTTMAMXXXXXXXXXRVFKEKVGTKAPEPPXGVREVLNETTNWLWAHLSRKKRPRLCTKEEFIKKVNSNASLGAVFAEQNQWSTAREAVSDPXLWEIVDVERENHLRGECHTCVYHMMGKREKXXXXXXXXXXXXXXXXXXXXXXXXEFEALGFLNEDHWLSRENSGGGEEGLGVQKLGYIIRDIAVKQGGKMYADDPAGWDTRITKTDLENEAKVXXXXXXXXXXXXXAIIELTYRHQVFKVMRPASKGKTVMAVYSREDQRGSGXXXXXXXXXXXNIAVQLVRLVEVEGVIGPQHLEHLPRENKIAVRTWLFENGGERVTRMAISXXXXXXXXLDDRFATSLHFLNAMSKVRRDILQWKPSHGWLDWQQVPFCSXXXXXXVMKDGRSLVDPCRGQDELXXXXXISPGAGWNVKDTACLPKAYAQMWLLLYFHRRDQRLMANAICSAVPVNWVPTGRTSWSIHSKGEWIPTEDMLQVWNXVWIEENEWMTDMTPIASWTDVPYVXXXXXXWCGSLIGTRSRATWAENVYAAINQVRAIIGKEDYVDYMLFPRRYEDVLTQEDRVI

SEQ ID NO: 265850 - protein, 3436 aa, Japanese encephalitis virus
  MOD_RES (1)..(1): Any amino acid
  MOD_RES (20)..(25): Any amino acid
  MOD_RES (39)..(40): Any amino acid
  MOD_RES (60)..(62): Any amino acid
  MOD_RES (80)..(84): Any amino acid
  MOD_RES (111)..(124): Any amino acid
  MOD_RES (138)..(184): Any amino acid
  MOD_RES (259)..(267): Any amino acid
  MOD_RES (288)..(298): Any amino acid
  MOD_RES (317)..(327): Any amino acid
  MOD_RES (347)..(369): Any amino acid
  MOD_RES (387)..(391): Any amino acid
  MOD_RES (407)..(410): Any amino acid
  MOD_RES (423)..(423): Any amino acid
  MOD_RES (442)..(445): Any amino acid
  MOD_RES (481)..(495): Any amino acid
  MOD_RES (530)..(545): Any amino acid
  MOD_RES (580)..(590): Any amino acid
  MOD_RES (610)..(615): Any amino acid
  MOD_RES (631)..(632): Any amino acid
  MOD_RES (648)..(653): Any amino acid
  MOD_RES (683)..(687): Any amino acid
  MOD_RES (701)..(717): Any amino acid
  MOD_RES (737)..(766): Any amino acid
  MOD_RES (777)..(792): Any amino acid
  MOD_RES (813)..(835): Any amino acid
  MOD_RES (855)..(892): Any amino acid
  MOD_RES (904)..(912): Any amino acid
  MOD_RES (926)..(931): Any amino acid
  MOD_RES (951)..(966): Any amino acid
  MOD_RES (1019)..(1020): Any amino acid
  MOD_RES (1075)..(1082): Any amino acid
  MOD_RES (1102)..(1106): Any amino acid
  MOD_RES (1133)..(1133): Any amino acid
  MOD_RES (1145)..(1148): Any amino acid
  MOD_RES (1160)..(1161): Any amino acid
  MOD_RES (1172)..(1206): Any amino acid
  MOD_RES (1220)..(1229): Any amino acid
  MOD_RES (1275)..(1285): Any amino acid
  MOD_RES (1319)..(1319): Any amino acid
  MOD_RES (1343)..(1423): Any amino acid
  MOD_RES (1446)..(1453): Any amino acid
  MOD_RES (1488)..(1537): Any amino acid
  MOD_RES (1573)..(1599): Any amino acid
  MOD_RES (1611)..(1611): Any amino acid
  MOD_RES (1636)..(1653): Any amino acid
  MOD_RES (1664)..(1671): Any amino acid
  MOD_RES (1724)..(1837): Any amino acid
  MOD_RES (1853)..(1858): Any amino acid
  MOD_RES (1870)..(1935): Any amino acid
  MOD_RES (1949)..(1980): Any amino acid
  MOD_RES (1996)..(2020): Any amino acid
  MOD_RES (2036)..(2084): Any amino acid
  MOD_RES (2095)..(2120): Any amino acid
  MOD_RES (2146)..(2156): Any amino acid
  MOD_RES (2172)..(2175): Any amino acid
  MOD_RES (2209)..(2244): Any amino acid
  MOD_RES (2263)..(2284): Any amino acid
  MOD_RES (2317)..(2377): Any amino acid
  MOD_RES (2404)..(2459): Any amino acid
  MOD_RES (2483)..(2519): Any amino acid
  MOD_RES (2563)..(2570): Any amino acid
  MOD_RES (2586)..(2607): Any amino acid
  MOD_RES (2637)..(2656): Any amino acid
  MOD_RES (2667)..(2774): Any amino acid
  MOD_RES (2788)..(2796): Any amino acid
  MOD_RES (2837)..(2929): Any amino acid
  MOD_RES (2949)..(2950): Any amino acid
  MOD_RES (2963)..(2963): Any amino acid
  MOD_RES (2993)..(3018): Any amino acid
  MOD_RES (3069)..(3108): Any amino acid
  MOD_RES (3129)..(3163): Any amino acid
  MOD_RES (3183)..(3218): Any amino acid
  MOD_RES (3238)..(3275): Any amino acid
  MOD_RES (3295)..(3297): Any amino acid
  MOD_RES (3328)..(3351): Any amino acid
  MOD_RES (3373)..(3381): Any amino acid
  MOD_RES (3401)..(3404): Any amino acid
XTKKPGGPGKSRAINMLKRXXXXXXPLVGVKRVVISLLXXIGPVRFVLAFITFFKFTALXXXKALSGRWRALEKSVAMKXXXXXKRELGILIDGVNKRGRKRNKRGGNEGXXXXXXXXXXXXXXAGAIKLSNFQGKLXXXXXXXXXXXXXXXXXXXXXXXXXXXXXXXXXXXXXXXXXXXXXXXPGNDPQDVDCWCDNQEVYIQYGRCTRTRHSQTSKRSVSVQPNGERSLVNKKEAWLNSTKATRYLVKTENWIVRNXXXXXXXXXLGWMLGSTNGQRVVFTILPLXXXXXXXXXXXGMGNRDFVQGASGATWVDXXXXXXXXXXXMANDKPTLDRRMINIEASQXXXXXXXXXXXXXXXXXXXXXXXTTGEAHNEKQADSSYVCXXXXXDRGWGKGCGLFGKGSXXXXAKFSCTNKAIGRXIQSENIKYKVGIFVHGATXXXXHGNYTAQIGASQAARFTVTPNAPSVTLELGDYGEVXXXXXXXXXXXXXXXYVMTVGPKSFLVHREWFHDLALPWTSSSNTAWRNXXXXXXXXXXXXXXXXVVALGSREGALHQALAGAIVVEYSNSVKLTSGHLXXXXXXXXXXXKGTTYGVCTKKFSFAKNPAXXXXXXVVIELSYSGRDGPCKXXIVSVANLNDMTPVGRXXXXXXFVATSSSNSKALVEMEPPFGDSYIVVGRKXXXXXHHRHKPGSTLGKAXXXXXXXXXXXXXXXXXAWDFGSIGRAFNSIGKAVHXXXXXXXXXXXXXXXXXXXXXXXXXXXXXXINARDRSIAMXXXXXXXXXXXXXXXXHADTGSAIDITRNQMRCGSGXXXXXXXXXXXXXXXXXXXXXXXLAKIVHKAHMEGVCGVRSVXXXXXXXXXXXXXXXXXXXXXXXXXXXXXXXXXXXXXXSAPKRLFMTQEXXXXXXXXXGKSILFAPEMANSXXXXXXPETKECPVEQRAWNSMQIEXXXXXXXXXXXXXXXXEENTDECDGTIIGTAIKGHVTVHSDLSYWIESHLNDTRKRERAVFEEVKSCTXXETHTLWGDGVEESELIIPDTIAGPKSKHNQREGYKTQNQGPWDEDGIVLDFDYCXXXXXXXXEDCGKRGPWVRTTTDIGKLXXXXXCRSCTLPPLRFRTDNGCWYGMEVRPVXHDEATLVRSQAXXXXGGMVDPFQLGLXXMFLATQEVLGXXXXXXXXXXXXXXXXXXXXXXXXXXXXXXXXXXXVAASFAEANSGGDXXXXXXXXXXKIQPAFLAMKTLSTKWTNQENMILVLGAAFFQLASMDLQIGVHGIXXXXXXXXXXXKAITFPTTSTVTMPLLTLLAPGMRALCLDTYRIXLLIIGICSLQQEREKTMAKKKGAXXXXXXXXXXXXXXXXXXXXXXXXXXXXXXXXXXXXXXXXXXXXXXXXXXXXXXXXXXXXXXXXXXXXXXXXXXXXXXXXXDMWLERAADVSWGMDAAITGSSXXXXXXXXEDGDFHLIDDPGVPWKVWVLRMSCICLAALTPWAXXXXXXXXXXXXXXXXXXXXXXXXXXXXXXXXXXXXXXXXXXXXXXXXXXYQAGVGVIYESVFHTLWHPTRGAAIMSGKGKLTPYXXXXXXXXXXXXXXXXXXXXXXXXXXXQVIVVEQGKPAXNIQTKPGIFPPPFGKVGAVSLDYPXXXXXXXXXXXXXXXXXXYGNGGELGDGXXXXXXXXGDRQEEPVPEAYTPTMLKKKQLTVLDLHPGLGKTRKILPQIIRDAIQQRLRTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHDLQDEIPDWAWSSGXXXXXXWITEYSGKTVWXXXXXXXXXXXXXXXXXXXXXXXXXXXXXXXXXXXXXXXXXXXXXXXXXXXXXXXXXXXXXXXXXXKSVKPIILEEGEGXXXXXXXXXXXXXXXXXXXXXXXXXXXXXXXXYHYGGATSEGDSNLAXXXXXXXXXXXXXXXXXXXXXXXXXEREKALTMDGEYRLRXXXXXXXXXXXXXXXXXXXXXXXXXXXXXXXXXXXXXXXXXXXXXXXXXSTEVEIVTRMXXXXXXXXXXXXXXXXXXXXXXXXXXDFAAGKRSAVSFIEELGRMPEHFAGXXXXXXXXXXXVATAEKGGKTHRMALXXXXDALETITLIIAITAMTGGFFLLMKQRKGIGKMGXXXXXXXXXXXXXXXXXXXXXXXXXXXXXXXXXXXXLIPEPEKQRLQTDNQLAVXXXXXXXXXXXXXXXXXXXXXXTKADLKSMFVGKAPALGLTGLPSMTLDLRPATXXXXXXXXXXXXXXXXXXXXXXXXXXXXXXXXXXXXXXXXXXXXXXXXXXXXXXXXXXXXXCWGQITLTTVLTAMVLTTLHYGYMLPXXXXXXXXXXXXXXXXXXXXXXXXXXXXXXXXXXXXXXXXXXXXXXXXXXXXXXXXAAFLVNPNITTVKKPGVLVTAATXXXXXXXXXXXXXXXXXXXXXXXXXXXXXXXXXXXXXLIKNANKPSFKRGRPGGRTLGEQWKEKLNAMSREEFFKYRREGXXXXXXXXARRARRENNKVGGHPXXXXXXXXXXXXXXXXXXXXXXVIDLGCGCGGWSYYAATLKRVQEVRGYTKXXXXXXXXXXXXXXXXXXXXLKSGVDVFYRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMNRTVWRGPRYEEXXXXXXXXXAVGKGEVHSTQGKIKKRIQKQREEFATTWHKDHEHPYRTWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEEFINKVNSNASLGAVFAEXXQWSTAREAVNDPXFWEMVDVERENHLRGECHTRIYNMMGKREXXXXXXXXXXXXXXXXXXXXXXXXXXFEALGSLNLDHWLSRENSGGGVEGLGVQKLGYISGDITSRAIGKMYADDTXXXXXXXXXXXXXXXXXXXXXXXXXXXXXXXXXXXXXXXXKVVKVMRPAAEGKTVMVVYSXXXXXXXXXXXXXXXXXXXXXXXXXXXXXXXXXXXGPQHLEQLPKKNKIAVRTWXXXXXXXXXXXXXXXXXXXXXXXXXXXXXXXXXXXXAMSKVRKDIQQWKPSHGWHXXXXXXXXXXXXXXXXXXXXXXXXXXXXXXXXXXXXXXISPGAGWNVMDTACLAKAYXXXWVLLYFHRRDQRLMANAICSAVPVNWVPTGXXXXXXXXXXXXXXXXXXXXXXXXVWIEENEWMMDKTPIASWTDVXXXXXXXXXWCGNLIGTRARATWAENIYXXXXQVRAILGKETYVDYMDSLRRYEDVSIQEDRVI

SEQ ID NO: 265851 - protein, 3436 aa, Japanese encephalitis virus
  MOD_RES (1)..(41): Any amino acid
  MOD_RES (54)..(64): Any amino acid
  MOD_RES (76)..(84): Any amino acid
  MOD_RES (111)..(124): Any amino acid
  MOD_RES (135)..(184): Any amino acid
  MOD_RES (195)..(215): Any amino acid
  MOD_RES (227)..(276): Any amino acid
  MOD_RES (288)..(299): Any amino acid
  MOD_RES (316)..(369): Any amino acid
  MOD_RES (380)..(392): Any amino acid
  MOD_RES (406)..(411): Any amino acid
  MOD_RES (423)..(450): Any amino acid
  MOD_RES (477)..(512): Any amino acid
  MOD_RES (526)..(548): Any amino acid
  MOD_RES (562)..(591): Any amino acid
  MOD_RES (610)..(618): Any amino acid
  MOD_RES (631)..(635): Any amino acid
  MOD_RES (647)..(654): Any amino acid
  MOD_RES (670)..(672): Any amino acid
  MOD_RES (683)..(687): Any amino acid
  MOD_RES (700)..(723): Any amino acid
  MOD_RES (736)..(793): Any amino acid
  MOD_RES (805)..(838): Any amino acid
  MOD_RES (855)..(937): Any amino acid
  MOD_RES (950)..(966): Any amino acid
  MOD_RES (992)..(992): Any amino acid
  MOD_RES (1013)..(1035): Any amino acid
  MOD_RES (1046)..(1057): Any amino acid
  MOD_RES (1075)..(1082): Any amino acid
  MOD_RES (1096)..(1134): Any amino acid
  MOD_RES (1145)..(1233): Any amino acid
  MOD_RES (1261)..(1287): Any amino acid
  MOD_RES (1315)..(1320): Any amino acid
  MOD_RES (1343)..(1433): Any amino acid
  MOD_RES (1446)..(1468): Any amino acid
  MOD_RES (1485)..(1540): Any amino acid
  MOD_RES (1572)..(1599): Any amino acid
  MOD_RES (1611)..(1611): Any amino acid
  MOD_RES (1634)..(1676): Any amino acid
  MOD_RES (1689)..(2126): Any amino acid
  MOD_RES (2140)..(2175): Any amino acid
  MOD_RES (2188)..(2247): Any amino acid
  MOD_RES (2260)..(2286): Any amino acid
  MOD_RES (2309)..(2381): Any amino acid
  MOD_RES (2404)..(2521): Any amino acid
  MOD_RES (2560)..(2570): Any amino acid
  MOD_RES (2582)..(2806): Any amino acid
  MOD_RES (2830)..(2929): Any amino acid
  MOD_RES (2949)..(2952): Any amino acid
  MOD_RES (2963)..(2963): Any amino acid
  MOD_RES (2974)..(3033): Any amino acid
  MOD_RES (3054)..(3111): Any amino acid
  MOD_RES (3129)..(3164): Any amino acid
  MOD_RES (3180)..(3281): Any amino acid
  MOD_RES (3292)..(3353): Any amino acid
  MOD_RES (3366)..(3382): Any amino acid
  MOD_RES (3401)..(3404): Any amino acid
  MOD_RES (3435)..(3436): Any amino acid
XXXXXXXXXXXXXXXXXXXXXXXXXXXXXXXXXXXXXXXXXGPLRFVLALVSFXXXXXXXXXXXLLGRWRALEKSXXXXXXXXXKGELGTLIDVVNKRGKKQNKRGGNERXXXXXXXXXXXXXXVGALKLSNFQXXXXXXXXXXXXXXXXXXXXXXXXXXXXXXXXXXXXXXXXXXXXXXXXXXTGNDPEDVDCXXXXXXXXXXXXXXXXXXXXXRSRRSVSVHTHXXXXXXXXXXXXXXXXXXXXXXXXXXXXXXXXXXXXXXXXXXXXXXXXXXGHRVVFTILLLXXXXXXXXXXXXMGNRDFIQGASGATWVXXXXXXXXXXXXXXXXXXXXXXXXXXXXXXXXXXXXXXXXXXXXXXXXXXXXXXTTGEAHNEKQXXXXXXXXXXXXXRGWGNGCGLSGKGXXXXXXKFSCTSKAIERXXXXXXXXXXXXXXXXXXXXXXXXXXXXAQVGVSQAAKFTVTPNAPSVTLELGDXXXXXXXXXXXXXXXXXXXXXXXXXXXXXXXXXXXXHDLALPWTSSSNTXXXXXXXXXXXXXXXXXXXXXXXLGSQERALHQALAXXXXXXXXXXXXXXXXXXXXXXXXXXXXXXGTTYGMCTENSSFRKNPAXXXXXXXXXELSYSGSDGSCKXXXXXVASLNDMTPAGXXXXXXXXVATSSSNSKVLLEIEXXXGDSYIVVGREXXXXXHHWHKPGSTLGKXXXXXXXXXXXXXXXXXXXXXXXXIGGAFNSIGKAVXXXXXXXXXXXXXXXXXXXXXXXXXXXXXXXXXXXXXXXXXXXXXXXXXXXXXXXXXXADTGCAIDVTRXXXXXXXXXXXXXXXXXXXXXXXXXXXXXXXXXXIVHKAYKEGVCGIRSVXXXXXXXXXXXXXXXXXXXXXXXXXXXXXXXXXXXXXXXXXXXXXXXXXXXXXXXXXXXXXXXXXXXXXXXXXXXXXXXXXXXPDERRAWNSTQIXXXXXXXXXXXXXXXXXEETTDECDGAIIGTAVKGHVTVHSDXSYWIGSRYNDTRKLERAVFGXXXXXXXXXXXXXXXXXXXXXXXVIPHTIAGPRXXXXXXXXXXXXNQGPWDESGIVLDFDYCXXXXXXXXEDCGKRAPWVRTTXXXXXXXXXXXXXXXXXXXXXXXXXXXXXXXXXXXXXXXDETTLVRWQVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAFLVANTLSAKWTNQENVILVLGAAFFXXXXXXXXXXXXXXXXXXXXXXXXXXXITFPTTSTITMPVLALLTPGMRAFDLDXXXXXXLVIGICSLQQERRRTMAKKKGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWEMGAAITGSSXXXXXXXXXXXXXXXXXXXXXXXKVWVLRTSCIGLAALTXXXXXXXXXXXXXXXXXXXXXXXXXXXXXXXXXXXXXXXXXXXXXXXXXXXXXXXXGVGVMYESVFHTLWHTTRGAAIMSGGGKLTPXXXXXXXXXXXXXXXXXXXXXXXXXXXXQVIVVEPGKVAXNIQTKPGIFPTPLGEVGAVSLDXXXXXXXXXXXXXXXXXXXXXXXXXXXXXXXXXXXXXXXXXXXEPIPEAYNPSMLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRSAISFIEVRGRMXXXXXXXXXXXXXXXXXXXXXXXXXXXXXXXXXXXXDALETITLTVAIXXXXXXXXXXXXXXXXXXXXXXXXXXXXXXXXXXXXXXXXXXXXXXXXXXXXXXXXXXXXEPEKQRSQTGNQXXXXXXXXXXXXXXXXXXXXXXXXXXXADIKSMFGGKAPASGLTGLPSVXXXXXXXXXXXXXXXXXXXXXXXXXXXXXXXXXXXXXXXXXXXXXXXXXXXXXXXXXXXXXXXXXXXXXXXXXITLTTVLTAVVLATLHYGFMLPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKNADKPSLKKGRPGGRTLWEQWKERLNALSREEFFKYRXXXXXXXXXXXARRARRENNKVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQKKIRKRIQKLKEEFGTTWHKDPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEEFIKKVNSSAALGAVFAEXXXXSTAREAVGDSXFWEMVDVEREXXXXXXXXXXXXXXXXXXXXXXXXXXXXXXXXXXXXXXXXXXXXXXXXXXXXXXXXXXXXENSRGGVEGSGVQKLGYIIRXXXXXXXXXXXXXXXXXXXXXXXXXXXXXXXXXXXXXXXXXXXXXXXXXXXXXXXXXXKVMRPSTDGKTVMDVISXXXXXXXXXXXXXXXXXXXXXXXXXXXXXXXXXXXXPQHVEQLPKKNKIAVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWNVKDTACLPXXXXXXXXXXXXXXXXXXXXXXXXXXXXXXXXXXXXXXXXXXXXXXXXXXXXXXXXXXXXXXIEENEWMEDKTPXXXXXXXXXXXXXXXXXCGSLIGTRSRATWAENVYXXXXQVRAIIGKENYVDYMDSLQRIEDVLIQEDRXX

SEQ ID NO: 265852 - protein, 3436 aa, Japanese encephalitis virus
  MOD_RES (110)..(124): Any amino acid
  MOD_RES (267)..(276): Any amino acid
  MOD_RES (423)..(423): Any amino acid
  MOD_RES (683)..(687): Any amino acid
  MOD_RES (1000)..(1000): Any amino acid
  MOD_RES (1133)..(1133): Any amino acid
  MOD_RES (1145)..(1148): Any amino acid
  MOD_RES (1611)..(1612): Any amino acid
  MOD_RES (1853)..(1858): Any amino acid
  MOD_RES (2808)..(2808): Any amino acid
  MOD_RES (2901)..(2901): Any amino acid
  MOD_RES (2963)..(2963): Any amino acid
MTKKPGGPGKNRAINMLKRGLPRVFPLVGVKRVVMSLLDGRGPVRFVLALITFFKFTALAPTKALLGRWKAVEKSVAMKHLTSFKRELGTLIDAVNKRGRKQNKRGGNEXXXXXXXXXXXXXXXAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAXXXXXXXXXXGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGLFGKGSIDTCAKFSCTSKAIGRXIQPENIKYEVGIFVHGTTTSENHGNYSAQVGASQAAKFTVTPNAPSITLKLGDYGEVTLDCEPRSGLNTEAFYVMTVGSKSFLVHREWFHDLALPWTSPSSTAWRNRELLMEFEEAHATKQSVVALGSQEGGLHQALAGAIVVEYSSSVKLTSGHLKCRLKMDKLALKGTTYGMCTEKFSFAKNPADTGHGTVVIELSYSGSDGPCKIPIVSVASLNDMTPVGRLVTVNPFVATSSANSKVLVEMEPPFGDSYIVVGRGXXXXXHHWHKAGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRXNDTWKLERAVFGEVKSCTWPETHTLWGDGVEESELIIPHTIAGPKSKHNRREGYKTQNQGPWDENGIVLDFDYCPGTKVTITEDCGKRGPSVRTTTDSGKLITDWCCRSCSLPPLRFRTENGCWYGMEIRPVXHDETTLVRSQVXXXXGEMVDPFQLGLLVMFLATQEVLRKRWTARLTIPAVLGALLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLQERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWEMDAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIMSGEGKLTPYWGSVKEDRIAYGGPWRFDRKWNGTDDVQVIVVEPGKAAXXIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGXXXXXXWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQITLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQXKIKKRIQKLKEEFATTWHKDPEHPYRTWTYHGSYEVKATGSASSLVNGVVKLMSKPWDAIANVTTMAMTDTTPFGQQRVFKEKVDTKAPEPPXGAKEVLNETTNWLWAHLSREKRPRLCTKEEFIKKVNSNAALGAVFAEQNQWSTAREAVDDPXFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEQLPRKNKIAVRTWLFENGEERVTRMAISGDDCVVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 265853 - protein, 3436 aa, Japanese encephalitis virus
  MOD_RES (110)..(124): Any amino acid
  MOD_RES (152)..(159): Any amino acid
  MOD_RES (267)..(276): Any amino acid
  MOD_RES (423)..(423): Any amino acid
  MOD_RES (683)..(687): Any amino acid
  MOD_RES (817)..(823): Any amino acid
  MOD_RES (883)..(883): Any amino acid
  MOD_RES (958)..(958): Any amino acid
  MOD_RES (1000)..(1000): Any amino acid
  MOD_RES (1133)..(1133): Any amino acid
  MOD_RES (1145)..(1148): Any amino acid
  MOD_RES (1492)..(1507): Any amino acid
  MOD_RES (1611)..(1612): Any amino acid
  MOD_RES (1786)..(1787): Any amino acid
  MOD_RES (1809)..(1812): Any amino acid
  MOD_RES (1853)..(1858): Any amino acid
  MOD_RES (1906)..(1911): Any amino acid
  MOD_RES (2041)..(2047): Any amino acid
  MOD_RES (2419)..(2429): Any amino acid
  MOD_RES (2591)..(2592): Any amino acid
  MOD_RES (2697)..(2697): Any amino acid
  MOD_RES (2808)..(2808): Any amino acid
  MOD_RES (2901)..(2901): Any amino acid
  MOD_RES (2963)..(2963): Any amino acid
  MOD_RES (2997)..(3013): Any amino acid
  MOD_RES (3142)..(3142): Any amino acid
MTKKPGGPGRNRAIYMLKRGLPRVFPLVGVKKVVMSLLDGRGPVRFVLALTSFFKFTALAPTKALLGRWRALERSVAMKHLTSFKRELGTLIDAVNKRGKKQNKRGGNEXXXXXXXXXXXXXXXVGAMRLSNFQGKLLMTVNNTDIADVIVXXXXXXXXRCWVRAIDVGHLCEDTITYECPKLAVGNDPEDVDCWCDNQQVYVQYGRCTRTRHSKRTRRSVSVQPNGESSLVNKKEAWLDSTKATRYLTKTENWIVRNPGYAFLAAXXXXXXXXXXGQRLGFTILLLLVAPAYSFTCLGMGNRDFIQGVSGATWVDLVLEGDSCLTIMASDKPTLDVRMINIEAVQLAEVRSYYYRASVTDISTVARCPMTGEAHNKKGADSSYVCKQGFTDRGWGNGCGFSGKGSIDTCAKFSCTRKAIGRXIQPENIKYKVGIFVHGATTSENHGNYSAQVGASQAAKFTITPNAPSTALKLGDFGEVTLDCEPKSGLNTEAFYVMTVGSRSLLVHREWFHDLSLPWTPSSNTAWRNRELLMEFEGAHATKQSVVALGSQEGGLHHALAGAIVVEYSSSVMLTSGHVKCRLRMDKLALKGTTYGMCTGKFSFAKNPVDTGHGTVVIELTYSGSDGSCKIPIVSVASLNDLTPAGRLVTVNPFVATSSSNSKALLEIEPPFGDSYIVVGRKXXXXXHHWHKAGSTLGKAFLTTLKGAQRLVALGDTAWDFGSIGGVFNSIGRAVHQVFGDAFRTLFGGMSWITQGLMGALLLWMGINARDRSIAMAFLVTGGTLLFLATNVHADTGCAIDITRRQMRCGSGIFVHXXXXXXXDRYKYLPETPRSLAKIVHKAHQEGICGIRSVTRLEHQMWESVRDELNVPLKENAVDLSVXVNKPVGRYRSAPKRLSMTREKVEMGWKAWGKSILFAPEMANSSFVVDGPETKECPDERRAWNSTQIEDFGFGITXTRVWLKIREENTDECDGPIIGTAVKGNVAVHSDLSYWIESHXNDTWKLERAVFGEVKSCTWPETHTLWGDDAEESELIIPHTIAGPRSKHNRREGYRTQNQGPWDEDGLVPGFDYCPGTKVTITEDCGKRGPSIRTTTDIGKLITDWCCRSCSLPPLGFRTGSGCWYGMEIRPLXHDEATLVRSQVXXXXGEMIDPFQLGLLVVFLATQEVLRKRWTARLTIPAVLGVLLVLMLGGITYIDLARYVVLVAAAFAEANNGGDVLHLALIAVFKIQPAFLVMNMLSARWTNQENVALVLGAAFFQLASADLQIGVHGILNAAAMAWMIVRAITFPTTSTVAMPILALLAPGMRAFYLDTYRIILLVIGICSLLHERRKTMAKKKGAVLMGLALTSTGWFSPTTIAAGLMACNPNKKRGWPATEFLSAIGLMFAIVGGLAEMDIESMSIPFMLAVLMAVSYVVSGKATDMWLDRAADISWEMEAAITGSSRRLDVKLDEDGDFHFIDDPGVPWKVWLLRMSCSCLVALTPWAIVPAXXXXXXXXXXXXXXXXFWDTPSPKPCLKGDTTTGVYRIMARGILGTYQSGVGVMYESVLHTLWHTTRGAAIVSGGGKLTPYWGSVKEDRISYGGPWRFDRKWNGTDDVQVIVVEPGKPAXXIQTKPGIFPPPFGEIGTVSLDYPRGTSGSPILDSNGDVVGCLGNGGELGDGSYVSAIVQGDRQEEPVPDAYTPSMLKKRQLTVLDLHPGSGKTKKILPQIIKDAIQQRLKTAVLAPTRVVAAEMAEALKGLPVRYQTSAVQRSHQGNAIVDVMCHATLTHRLTSPNRVPNYNLXXMDEAHFTDPAGIAARGYIATKXXXXEAAAIFMTATSPGTTDPFPDSNAPIHDLQDETPDRAWSSGXXXXXXWITDYSGKTVWFVASVRMGNEIAVCLQRAGKRVIQLSRKSYDTEYPKXXXXXXDFVITTDISEVGANFGASRVIDCRKSVKPIILEKEEGRVILGNPSPITNASAAQRRGRVGRNPNQVGDEYHYGGPTSEGDGNLAHWTEAKILLDNIHMPNGLVVQLYGPEREKASTMDVEYRLRGEEKKXXXXXXXTADLPVWLAYRVASNGIQYTDRRWCFDGPRTNAILEDNIEVEIVTRTGERKILKPRWLYARVYADHQALKWFKDFAAGKRSAISFIEVPGRMPEHFAGKTREALDTMYLVATAERGGKTHRMALEELPDALETITLIAAITVMTGGFFLLMMQRKGIGRMGLGALVLVLATFFLWAAEVPGTKIAGTLLVALLLMVVLIPEPGKQKLQTGNQLAVFLICVLTVVGMAAANEYGMLEKTKADLKSMFGGRTQAPGLTGLPSVTLDLRPATAWAWYGGSTVVLTPLLKHIITSEYVTTSLASISSQAGSLFVLPRGVPSTDLDLTVGLVFLGCWGQITLTTFLTAMVLVTLHYGFMLPGWQAQALRAAQRRTAXXXXXXXXXXXMVATDVPELEKTTPLMQKKIGQVLLIGVSVAALLVNPNITTVREAGVLVTARTLTLWDNGASAAWNSTTATGLCHVMRGSYLRGGSIAWTLIKNADKPSLKKGRSGGRTLGEQWKEKLNAMSRDEFFKYRREAIIEVDRTEARRARRENNVVGGHPVSRGSXXLRWLVEKGFVPPIGKVIDLGCGRGSWNYYAATLKKVQEVKGYTKGGAGHEEPMLMQSYGRNLVSMKSGVHVFYRPSEPSDTLLCDIGESSPSPDVEEQRTLRVLXMTSDWLHRGPIEFCIKVLCPYMPKVIEKNEVLQRRFGGGVVRLPLSRNSNHEMYWVSGPAGNVVHAVNMTSQVLLGRMDRAVWRGPKYKEDVNLGSGTRAVGKGEIHSNQXKIRKRIQKLREEFGTTWHKDHEHPYRNWTYHGSYEVRANGSASSLVNGVVELMSKPWDTISYVTTMPMTDTTPFGQQRVFKEKVGTKAPEPPXGVREVLNETTNWLWAYLSRKKRPRLCTKEEFIRKVNSNASLGTVFAEQNQWSTAREAVGDPXFWEMVNVERENHLRGECHTCVYHMMGKREKKPGXXXXXXXXXXXXXXXXXARYLEFEALGFLNLDHWLSRRNSRGGVEGSSVQKLGYISRDIAVKQGGKMYADDTAGWDTRITRADLENEAKVLELLDGEHRKLARAIIELTYKHQVFKVMRPAAGGKTGMAVYSRENQRGSGQVVTYXLNTFTNIAVQLVRLMKVEGVIGPQHLEQLPRKTKIAVRTWLFENGEERVSRMAISGDDCAVKPLDDRFATSLHFLNAMSKVTRDIQEWKPSHGWHDWLHVPFCSNHFHEIVMKDGRSLVVPCRGQDELIGRARISPGAGCNVMDTACLAKAYAQMWLLLYFHRRYQCLMANAICSAVPVNWVPTGRTSWSKHSKGEWMTTENMLQVWNKVWIEENEWMVDKTPVASWTDVPYVGKREDIWCGSLIGTRTKATWAENIYAAINQVRAIIGKETYVDYMLSLRRYEDVLVQEDRVI

SEQ ID NO: 265854 - protein, 3436 aa, Japanese encephalitis virus
  MOD_RES (110)..(124): Any amino acid
  MOD_RES (151)..(160): Any amino acid
  MOD_RES (181)..(184): Any amino acid
  MOD_RES (267)..(276): Any amino acid
  MOD_RES (319)..(321): Any amino acid
  MOD_RES (365)..(366): Any amino acid
  MOD_RES (423)..(423): Any amino acid
  MOD_RES (683)..(687): Any amino acid
  MOD_RES (713)..(716): Any amino acid
  MOD_RES (744)..(756): Any amino acid
  MOD_RES (782)..(791): Any amino acid
  MOD_RES (816)..(824): Any amino acid
  MOD_RES (859)..(861): Any amino acid
  MOD_RES (875)..(888): Any amino acid
  MOD_RES (952)..(958): Any amino acid
  MOD_RES (1000)..(1000): Any amino acid
  MOD_RES (1133)..(1133): Any amino acid
  MOD_RES (1145)..(1148): Any amino acid
  MOD_RES (1221)..(1227): Any amino acid
  MOD_RES (1346)..(1355): Any amino acid
  MOD_RES (1372)..(1373): Any amino acid
  MOD_RES (1391)..(1418): Any amino acid
  MOD_RES (1449)..(1449): Any amino acid
  MOD_RES (1490)..(1507): Any amino acid
  MOD_RES (1588)..(1595): Any amino acid
  MOD_RES (1611)..(1612): Any amino acid
  MOD_RES (1766)..(1832): Any amino acid
  MOD_RES (1853)..(1858): Any amino acid
  MOD_RES (1901)..(1930): Any amino acid
  MOD_RES (1962)..(1964): Any amino acid
  MOD_RES (2001)..(2015): Any amino acid
  MOD_RES (2037)..(2050): Any amino acid
  MOD_RES (2072)..(2075): Any amino acid
  MOD_RES (2110)..(2119): Any amino acid
  MOD_RES (2147)..(2152): Any amino acid
  MOD_RES (2217)..(2226): Any amino acid
  MOD_RES (2238)..(2242): Any amino acid
  MOD_RES (2319)..(2332): Any amino acid
  MOD_RES (2354)..(2371): Any amino acid
  MOD_RES (2406)..(2451): Any amino acid
  MOD_RES (2495)..(2515): Any amino acid
  MOD_RES (2591)..(2598): Any amino acid
  MOD_RES (2673)..(2715): Any amino acid
  MOD_RES (2737)..(2767): Any amino acid
  MOD_RES (2795)..(2795): Any amino acid
  MOD_RES (2808)..(2808): Any amino acid
  MOD_RES (2856)..(2856): Any amino acid
  MOD_RES (2878)..(2884): Any amino acid
  MOD_RES (2901)..(2901): Any amino acid
  MOD_RES (2963)..(2963): Any amino acid
  MOD_RES (2995)..(3016): Any amino acid
  MOD_RES (3088)..(3098): Any amino acid
  MOD_RES (3138)..(3146): Any amino acid
  MOD_RES (3203)..(3204): Any amino acid
  MOD_RES (3248)..(3251): Any amino acid
  MOD_RES (3377)..(3380): Any amino acid
MTKKPRGPGKSRAINMLKRGLPRVFPLVRVKRVVISLLDGRGPARFVLALVSFFKFTALAPTKALSGRWKAVERSVAMKHLTSFKRELGTLIDTVNKRGRKRNKRGGNEXXXXXXXXXXXXXXXAGAIKLSNFQGKLLMAVNNTDIADVIXXXXXXXXXXCWVRAIDVGYLCEDTITYECXXXXAGNDPQDVDCWCDHQEVYVQYGPCTRTSHSKRSRRSVSVHTHGERSLVNKKKAWLDSTRATRYLMKTENWIIRNPGYAFLAVXXXXXXXXXXGPRVVFTILPLLVAPAYSFNCLGMGNRDFVERASGATWVDLVXXXDSCLTIMANDKPTLDVRMTNIEASQLAEVRSYCYRASVTDISTXXRCPTTGEAHNEKQADSSYVCKQGFTDRGWGKGCGLSGKGSIDTCAKFSCTNKAIGRXIQPENSKYKVGIFVHGTTTSENHGNYSAQVGTSQAAKFTVTPNAPSVTLELGDYGEVTLDCEARSGLNTEAFYVMTVGSKSLLVHREWFHDLALPWSSSSNTAWRNRELLMEFEQAHATKQSVVALGSQERALHQALAGAIVVEYSSSVKLTSGHLKRRLKMDKLALKGTTYGMCTENSSFRKNPADTGHGTVVIELSYSGRDGPCKIPIVSVVNLNDMTPAGRLVTVNPFVAASSSNSQVLLEIEPPFGDSYIVVGREXXXXXHHWYRPGSTLGKAFSTTLKGAQRLVXXXXTAWDFGSIGGIFNSIGRAVHQVFGDAFXXXXXXXXXXXXXLMGVLLLWMGINARNRSIALAFLATXXXXXXXXXXVHADTGCAIDTARNQMRCGSGIFVXXXXXXXXXRYKYLPETPKSLAKIVHKAYKEGVCGIRSVTRLEXXXWEAVRDELNVPLKXXXXXXXXXXXXXXGRYRSAPKRLFMTQEKVEMGWKAWGKSLLFAPELANSSFVVDGPETKECPDERRAWNSTQIEDXXXXXXXTRVWLKIREESTDECDGAIIGTAIKGHVTVHSDVSYWIESRXNDSWKRERLVFEEIKSCTWPETHSLWGDGVEESDLIIPHTLAGPKSKHNRREGYMTQNQGPWDEKGIVLDLDYCPGTTVTITEDCSKRGPSVRTTTDIGKLITDWCCRSCTLPPLRFRTDNGCWYGMEIRPAXHDEATLVRSQAXXXXGGMVDPFQMGLLVMFLATQEVLGKRWTARLTVPAVLGALLVLMFGGITYTDLARYVVLVAASFAEANSGGDVXXXXXXXVFKIQPAFLAMNTLSTKWTNQENVVLVLGAALFQLASADLQIGVHGMLNAAAIAWMIVRAITFPTASSVTMPVLALLTPGMKALCLDTYRIILLVIGVCSLLQERKRAMAKKKGAVLLXXXXXXXXXXSPTTITAGLMVCNPNKXXGWPATEVLSAVGLMFAIXXXXXXXXXXXXXXXXXXXXXXXXXXXXSGKATDMWLERAADVSWDMGAAITGSSRRLXVKLDDDGDFHLIDVPGVPWKVWVLRMSCIGLVALTPWAIVXXXXXXXXXXXXXXXXXXFWDTPSPKPCAKGDTTTGVYRIMACGIFGTYQAGVGVMYENVFHTLWHTTRGAAVMSGKGKLTPYWGSVREDRIAYGGPWXXXXXXXXTNDVQVIVVEPGKGAXXIQTKPGVFCTPFGKVGTVSLDYPRGTSGSPILNFNGDIIGLYGNGVELGDRSYVSAIVQGERQEEPVPEAYTPTMLRKKQLTVLDLHPGSGKTRKILPQIIKDAIQQHLRTAVLAPTRVVAAEMAEVLRGLPVRYQTSAVQREHQGNAIVDVMXXXXXXXXXXXXXXXXXXXXXXXXXXXXXXXXXXXXXXXXXXXXXXXXXXXXXXXXXXXXXXXXXXXSNAPIHDLQDEIPDWAWSSGXXXXXXWITEYSGKTVWFVASVKMGNEIAMCLQRAGKKVIQLSRKSYDXXXXXXXXXXXXXXXXXXXXXXXXXXXXXXVIDCRKSVKPTILEEGEGRVFLGNPSPITSAXXXQRRGRVSRNPSQVGDEYHYGGATSEDDGNLAHWTEAXXXXXXXXXXXXXXXQLYGPEREKALTMDGEYRLRGXXXXXXXXXXXXXXLPVWLAYKVAPNGIQYTDRKWXXXXPRTNAILEDNTEVEIVTRTGERKVLKPRWLDARVXXXXXXXXXXKDFAAGKRSAISFIEVLGRMPEHFAGKXXXXXXTMYLVATAEKSGKAHRMALEELPDALETITLTVAITVMTRGFFLLMMQRKGIGKMGLGALVLVLXXXXXXXXXXSGTKIAGTLLIXXXXXVVLIPEPEKQRSQTGNQLAVFLICVLTVVGVVAANEYGMLEKTKADLKSMFAGKAPVSGMTGLPSMTLDLRPATAWXXXXXXXXXXXXXXKHLITSEYVTPSLASISSQAGXXXXXXXXXXXXXXXXXXGLVLLGCWGQVTLTTSLTAVVLTILHYGYMLPGWXXXXXXXXXXXXXXXXXXXXXXXXXXXXXXXXXXXXXXXXXXXXXXVLLIGVSVAAFLVNPNVSTVKKPGVLVTAATLSLWDNGASAVWXXXXXXXXXXXXXXXXXXXXXIAWTLIKNANKPSLKRGRPGGRTLGEQWKEKLNAMGREEFFQYRREGIIEVDRTEACRARRENNKVGGHPVSRGSXXXXXXXXKGFVSPIGKVIDLGCGRGGWSYCAATLKRVQEFRGYTKGGAGHEEPMPMQSYGWNLVSLKSGVDVFYRPSEPSDXXXXXXXXXXXXXXXXXXXXXXXXXXXXXXXXXXXXXXXXXXXCPYMPKVIEKIEVLQRRFGGGXXXXXXXXXXXXXXXXXXXXXXXXXXXXXXXSQVLLGRMNRTVWRGPRYEEDVNLGSGXRAVGKGEVHSDQXKIRKRIQKQKEEFATTWHRDPEHPYRTWTYHGSYEVKANGSASSLVNXVVKLMSKPWDAISYVTTMPMTXXXXXXXQRVFKEKVGTMAPEPPXGVREVLNETTNWLWAHLSRKKRPRLCTKEEFIKKVNSSASLGAVFAEQNQWSTAREAVSDPXLWEIVDVERENHLRGECHTCVYHMMGKREKKXXXXXXXXXXXXXXXXXXXXXXLEFEALGFLNEDHWLSRENSGGGVEGLGVQKLGYIIGDITRKAIGKMYADDPAGWDTRITKTDLENEAKVLXXXXXXXXXXXRAIIELTYRHKVVKVMRPAAKGKTVMVVISRENQRGSGQXXXXXXXXXTNIAVQFVRLVEAEGVIGPQHLEHLPKENKIAVRTWLFENGGERVTRMAISGDDCAXXPLDDRFATALHFLNAMSKVRKDIQQWKPSHGWLDWQQVPFCSNXXXXIVMKDGRSILDPCRGQDELIDRARISPGAGWNVRDTACLPKAYAQMRLLLYFHRRDLRLMANAICSTVPLDWVPTGRTSWSIHSKGEWIPTEDMLQVWNRVWIEENEWMTDKTPIASWTDVPYVGXXXXIWCGSLIGTRSRATWAENVYAAINQVRAIIGKENYVDYMTSLRRIEDVSIQEDRVI

SEQ ID NO: 265855 - protein, 3436 aa, Japanese encephalitis virus
  MOD_RES (21)..(24): Any amino acid
  MOD_RES (81)..(83): Any amino acid
  MOD_RES (110)..(124): Any amino acid
  MOD_RES (139)..(184): Any amino acid
  MOD_RES (267)..(276): Any amino acid
  MOD_RES (289)..(297): Any amino acid
  MOD_RES (318)..(326): Any amino acid
  MOD_RES (348)..(368): Any amino acid
  MOD_RES (388)..(390): Any amino acid
  MOD_RES (408)..(409): Any amino acid
  MOD_RES (423)..(423): Any amino acid
  MOD_RES (443)..(444): Any amino acid
  MOD_RES (482)..(494): Any amino acid
  MOD_RES (531)..(544): Any amino acid
  MOD_RES (581)..(589): Any amino acid
  MOD_RES (611)..(614): Any amino acid
  MOD_RES (649)..(652): Any amino acid
  MOD_RES (683)..(687): Any amino acid
  MOD_RES (703)..(716): Any amino acid
  MOD_RES (738)..(765): Any amino acid
  MOD_RES (778)..(791): Any amino acid
  MOD_RES (814)..(834): Any amino acid
  MOD_RES (856)..(891): Any amino acid
  MOD_RES (905)..(911): Any amino acid
  MOD_RES (927)..(930): Any amino acid
  MOD_RES (952)..(965): Any amino acid
  MOD_RES (1000)..(1000): Any amino acid
  MOD_RES (1076)..(1081): Any amino acid
  MOD_RES (1103)..(1105): Any amino acid
  MOD_RES (1133)..(1133): Any amino acid
  MOD_RES (1145)..(1148): Any amino acid
  MOD_RES (1181)..(1205): Any amino acid
  MOD_RES (1221)..(1228): Any amino acid
  MOD_RES (1276)..(1284): Any amino acid
  MOD_RES (1344)..(1422): Any amino acid
  MOD_RES (1447)..(1452): Any amino acid
  MOD_RES (1489)..(1536): Any amino acid
  MOD_RES (1574)..(1598): Any amino acid
  MOD_RES (1611)..(1612): Any amino acid
  MOD_RES (1637)..(1652): Any amino acid
  MOD_RES (1665)..(1670): Any amino acid
  MOD_RES (1725)..(1833): Any amino acid
  MOD_RES (1853)..(1858): Any amino acid
  MOD_RES (1871)..(1934): Any amino acid
  MOD_RES (1952)..(1979): Any amino acid
  MOD_RES (1997)..(2019): Any amino acid
  MOD_RES (2037)..(2083): Any amino acid
  MOD_RES (2096)..(2119): Any amino acid
  MOD_RES (2147)..(2155): Any amino acid
  MOD_RES (2173)..(2174): Any amino acid
  MOD_RES (2216)..(2243): Any amino acid
  MOD_RES (2264)..(2283): Any amino acid
  MOD_RES (2318)..(2376): Any amino acid
  MOD_RES (2405)..(2456): Any amino acid
  MOD_RES (2485)..(2518): Any amino acid
  MOD_RES (2564)..(2569): Any amino acid
  MOD_RES (2587)..(2606): Any amino acid
  MOD_RES (2638)..(2651): Any amino acid
  MOD_RES (2668)..(2773): Any amino acid
  MOD_RES (2789)..(2795): Any amino acid
  MOD_RES (2808)..(2808): Any amino acid
  MOD_RES (2838)..(2858): Any amino acid
  MOD_RES (2870)..(2928): Any amino acid
  MOD_RES (2963)..(2963): Any amino acid
  MOD_RES (2994)..(3017): Any amino acid
  MOD_RES (3079)..(3107): Any amino acid
  MOD_RES (3130)..(3162): Any amino acid
  MOD_RES (3184)..(3214): Any amino acid
  MOD_RES (3239)..(3274): Any amino acid
  MOD_RES (3296)..(3296): Any amino acid
  MOD_RES (3329)..(3350): Any amino acid
  MOD_RES (3374)..(3380): Any amino acid
  MOD_RES (3402)..(3403): Any amino acid
MTKKPGGPGINRAIYMLKRGXXXXFPLVGVKRVVISLLDGIGPLRFVLAFITFFKFTALSPTKALSGRWRALEKSVAMKHXXXFKGELGTLIDVVNKRGRKQNKRGGNGXXXXXXXXXXXXXXXAGALKLSNFQGKLLXXXXXXXXXXXXXXXXXXXXXXXXXXXXXXXXXXXXXXXXXXXXXXTGNDPEDVDCWCDNQEVYIQYGRCTRTRHSKRSKRSVSVQTHGESSLENKKEAWLNSTKATRYLVKTENWIIRNPGYAFLAGXXXXXXXXXXGQRVVFTILPLLXXXXXXXXXLGMGNRDFIERASGATWVDLXXXXXXXXXIMANDRPTLDRRMINIEASQLXXXXXXXXXXXXXXXXXXXXXPTTGEAHNEKQADSSYVCKXXXTDRGWRNGCGLSGKGSIXXCAKFSCTSKATGKXIQSENIKYEVGIFVHGATTXXNHGNYTAQIGVSQAAKFTVTPNAPSVTLELGDYGEVTXXXXXXXXXXXXXFYVMTVGPKSFLVHREWFHDLALPWTSSSNTAWRNRXXXXXXXXXXXXXXSVVALGSREGSLHQALAGAIVVEYPNSVKLTSGHLKXXXXXXXXXLKGTTYGMCTKKFSFAKNPADXXXXTVVIELLYSGSDGPCKIPIVSVASLNDMTPAGRLXXXXPFVATSSANSKVLLEIEPPFGDSYIVVGMGXXXXXHHWHKPGSTLGKAFSXXXXXXXXXXXXXXTAWDFGSIGGAFNSIGKAVHQXXXXXXXXXXXXXXXXXXXXXXXXXXXXGVNARNRSIALAXXXXXXXXXXXXXXVHADTGSAIDITRNQMRCGSGIXXXXXXXXXXXXXXXXXXXXXALAKIVHKAHMEGVCGVRSVTXXXXXXXXXXXXXXXXXXXXXXXXXXXXXXXXXXXXRSTPKRLSMTQEKXXXXXXXWGKSMLFAPELANSTXXXXGPETKECPDVQRAWNSMQIEDXXXXXXXXXXXXXXREENTDECDGTIIGTAVKGHVALHSDLSYWIGSRXNDTWKLERAVFEEVKSCTWPETHTLWGDDVEESELIIPDTIAGPKSKHNQREGYKTQNQGPWDESGIVLDFDYCPXXXXXXTEDCGKRAPWLRTTTDSGKLIXXXCCRNCSLPPLRFRTGSGCWYGMEVRPVXHDETTLVRWQVXXXXGEMVDPFQMGLLVMFLATQEVFRKRWTARLTIXXXXXXXXXXXXXXXXXXXXXXXXXLVAAVFAEANSGGDVXXXXXXXXFKIQPAFLVAKMLSTRWTNQENVILVLGAAFFQLASMDLQIGVHGILXXXXXXXXXIKAITFPTTSTITMPLLALLTPGMRALDLDTYRIILLVIGICSLQQEREKTMAKKKGAVXXXXXXXXXXXXXXXXXXXXXXXXXXXXXXXXXXXXXXXXXXXXXXXXXXXXXXXXXXXXXXXXXXXXXXXXXXXXXXXTDMWLEQAADISWEMGAAITGSSRXXXXXXDEDGDFHLIDDPGVPWKVWVLRTSCICLAALTPWAIXXXXXXXXXXXXXXXXXXXXXXXXXXXXXXXXXXXXXXXXXXXXXXXXTHQAGVGVMYENVLHTLWHPTRGAAIMSGKGKLTPYWXXXXXXXXXXXXXXXXXXXXXXXXXVQVIVVEQGKPAXXFQTKPGVFRTPLGKVGAVSLDYPRXXXXXXXXXXXXXXXXLYGNGVELGDRSXXXXXXQGDRQEEPVPEAYTPSMLKKKQMTVLDLPPGLGKTRKILPQTIRDAIQQRLRTAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDAPIHDLQDEVPDRAWSSGXXXXXXWSTEYAGKTVWFXXXXXXXXXXXXXXXXXXXXXXXXXXXXXXXXXXXXXXXXXXXXXXXXXXXXXXXXXXXXXXXXRKSVEPTILEKEEGRVIXXXXXXXXXXXXXXXXXXXXXXXXXXXXEYHYGGATSEDDGNLAHXXXXXXXXXXXXXXXXXXXXXXXPEREKAFTMDVEYRLRGXXXXXXXXXXXXXXXXXXXXXXXXXXXXXXXXXXXXXXXXXXXXXXXDSTEVEIVTRMGXXXXXXXXXXXXXXXXXXXXXXXXKDFASGKRSATSFIEERGRMPEHFMGKXXXXXXXXXLVATAEKSGKAHRMALEXXPDALETVTLIVAIAAMTGGFFLLMKQRKGIEKMGLGALVLTXXXXXXXXXXXXXXXXXXXXXXXXXXXXVLIPEPEKQRSQTGNQLAVFXXXXXXXXXXXXXXXXXXXXKTKADLKSMFVGKTQALGLTGLPGMALDLRPATAXXXXXXXXXXXXXXXXXXXXXXXXXXXXXXXXXXXXXXXXXXXXXXXXXXXXXXXXXXXGCWGQITLTTVLTAMVLATLHYGFMLPGXXXXXXXXXXXXXXXXXXXXXXXXXXXXXXXXXXXXXXXXXXXXXXXXXXXXGSVAAFLVNPKVSTVRKAGVLVTAATLSXXXXXXXXXXXXXXXXXXXXXXXXXXXXXXXXXXTLIKNADNPSLKRGGPGGRTLWEQWKERLNALSREEFFQYRREAIXXXXXXEARRARSENNIVGGHPVXXXXXXXXXXXXXXXXXXXXKVVDLGCGCGGWSYYAATLKKVQEFRGYTKGXXXXXXXXXXXXXXWNLVSLKSGVHVFYKPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRMDRTVWRGPKYKEDXXXXXXXRAVGKGEVHSTQXKIKRRIQKLREEFATTWHKDHEHPYRTWTXXXXXXXXXXXXXXXXXXXXXKLMSKPWDAISXXXXXXXXXXXXXXXXXXXXXXXXXXXXXXXXXXXXXXXXXXXXXXXXXXXXXXXXXXXKEEFIKKVNSDAALGAVFAEQNQWSTAREAVNDPXFWEMVDVERENHLRGECHTRIYNMMGKREKXXXXXXXXXXXXXXXXXXXXXXXXEFEALGSLNENHWLSRENSGGGEEGSGVQKLGYIFRDIASREGGKMYADDTAGWDTRITKTXXXXXXXXXXXXXXXXXXXXXXXXXXXXXHKVVKVMRPASDGKTVMDVISRXXXXXXXXXXXXXXXXXXXXXXXXXXXXXXXXXIGPQHVEQLPRENKIAVRTWLXXXXXXXXXXXXXXXXXXXXXXXXXXXXXXXYFLNAMSKVRKDILEWKPSHGWHDXXXXXXXXXXXXXXXXXXXXXXXXXXXXXXXXXXXXRISPGAGWNVKDTACLPKAYAXMWVLLYFHRRDLRLMANAICSAVPVNWVPTGRXXXXXXXXXXXXXXXXXXXXXXRVWIEENEWMEDMTPITSWTDVPXXXXXXXIWCGNLIGTRARATWAENIYAXXNQVRAILGKEDYVDYMDFLQRYEDVLTQEDRVI

SEQ ID NO: 265856 - protein, 3437 aa, Japanese encephalitis virus
  MOD_RES (1)..(40): Any amino acid
  MOD_RES (55)..(63): Any amino acid
  MOD_RES (77)..(83): Any amino acid
  MOD_RES (102)..(124): Any amino acid
  MOD_RES (136)..(184): Any amino acid
  MOD_RES (196)..(214): Any amino acid
  MOD_RES (228)..(276): Any amino acid
  MOD_RES (289)..(298): Any amino acid
  MOD_RES (317)..(329): Any amino acid
  MOD_RES (341)..(368): Any amino acid
  MOD_RES (381)..(391): Any amino acid
  MOD_RES (407)..(410): Any amino acid
  MOD_RES (423)..(449): Any amino acid
  MOD_RES (477)..(511): Any amino acid
  MOD_RES (527)..(547): Any amino acid
  MOD_RES (563)..(568): Any amino acid
  MOD_RES (580)..(590): Any amino acid
  MOD_RES (611)..(617): Any amino acid
  MOD_RES (632)..(634): Any amino acid
  MOD_RES (648)..(653): Any amino acid
  MOD_RES (671)..(671): Any amino acid
  MOD_RES (683)..(687): Any amino acid
  MOD_RES (701)..(722): Any amino acid
  MOD_RES (737)..(792): Any amino acid
  MOD_RES (805)..(834): Any amino acid
  MOD_RES (856)..(936): Any amino acid
  MOD_RES (951)..(965): Any amino acid
  MOD_RES (993)..(1000): Any amino acid
  MOD_RES (1015)..(1023): Any amino acid
  MOD_RES (1056)..(1056): Any amino acid
  MOD_RES (1076)..(1081): Any amino acid
  MOD_RES (1097)..(1133): Any amino acid
  MOD_RES (1145)..(1232): Any amino acid
  MOD_RES (1262)..(1286): Any amino acid
  MOD_RES (1316)..(1319): Any amino acid
  MOD_RES (1344)..(1433): Any amino acid
  MOD_RES (1447)..(1467): Any amino acid
  MOD_RES (1486)..(1537): Any amino acid
  MOD_RES (1573)..(1598): Any amino acid
  MOD_RES (1611)..(1612): Any amino acid
  MOD_RES (1635)..(1675): Any amino acid
  MOD_RES (1689)..(1711): Any amino acid
  MOD_RES (1723)..(1981): Any amino acid
  MOD_RES (1993)..(2125): Any amino acid
  MOD_RES (2141)..(2174): Any amino acid
  MOD_RES (2188)..(2246): Any amino acid
  MOD_RES (2261)..(2283): Any amino acid
  MOD_RES (2297)..(2297): Any amino acid
  MOD_RES (2309)..(2380): Any amino acid
  MOD_RES (2405)..(2461): Any amino acid
  MOD_RES (2473)..(2520): Any amino acid
  MOD_RES (2561)..(2569): Any amino acid
  MOD_RES (2583)..(2775): Any amino acid
  MOD_RES (2787)..(2808): Any amino acid
  MOD_RES (2831)..(2928): Any amino acid
  MOD_RES (2950)..(2951): Any amino acid
  MOD_RES (2963)..(2963): Any amino acid
  MOD_RES (2975)..(3023): Any amino acid
  MOD_RES (3055)..(3111): Any amino acid
  MOD_RES (3130)..(3163): Any amino acid
  MOD_RES (3181)..(3280): Any amino acid
  MOD_RES (3293)..(3297): Any amino acid
  MOD_RES (3310)..(3350): Any amino acid
  MOD_RES (3366)..(3381): Any amino acid
  MOD_RES (3402)..(3403): Any amino acid
  MOD_RES (3436)..(3437): Any amino acid
XXXXXXXXXXXXXXXXXXXXXXXXXXXXXXXXXXXXXXXXRGPVRFVLAFITFFXXXXXXXXXALLGRWRALEKSVXXXXXXXFKRELGILIDGVNKRGRKXXXXXXXXXXXXXXXXXXXXXXXVGALKLSNFQGXXXXXXXXXXXXXXXXXXXXXXXXXXXXXXXXXXXXXXXXXXXXXXXXXPGNDPQDVDCWXXXXXXXXXXXXXXXXXXXQTSRRSVSVQPNGXXXXXXXXXXXXXXXXXXXXXXXXXXXXXXXXXXXXXXXXXXXXXXXXXGHRVVFTILLLLXXXXXXXXXXGMGNRDFIERASGATWVDXXXXXXXXXXXXXNDKPTLDVRMTXXXXXXXXXXXXXXXXXXXXXXXXXXXXPTTGEAHNEKQAXXXXXXXXXXXDRGWGNGCGLSGKGSXXXXAKFSCTSKAIERXXXXXXXXXXXXXXXXXXXXXXXXXXXSAQVGASQAARFTVTPNAPSVTLELGDXXXXXXXXXXXXXXXXXXXXXXXXXXXXXXXXXXXFHDLALPWSSPSSTAXXXXXXXXXXXXXXXXXXXXXALGSQERALHQALAGXXXXXXSNSVKLTSGHLXXXXXXXXXXXKGTTYGVCTENSSFRKNPADXXXXXXXIELSYSGSDGSCKIXXXSVANLNDMTPVGRXXXXXXFVATSSSNSQVLVEMEPXFGDSYIVIGRGXXXXXHHRHKAGSTLGKAXXXXXXXXXXXXXXXXXXXXXXSIGRVFNSIGKAVHXXXXXXXXXXXXXXXXXXXXXXXXXXXXXXXXXXXXXXXXXXXXXXXXXXXXXXXXHADTGCAIDVTRXXXXXXXXXXXXXXXXXXXXXXXXXXXXXXSLAKIVHKAHMEGICGVRSVTXXXXXXXXXXXXXXXXXXXXXXXXXXXXXXXXXXXXXXXXXXXXXXXXXXXXXXXXXXXXXXXXXXXXXXXXXXXXXXXXXCPVERRAWNSTQIEXXXXXXXXXXXXXXXREETTDECDGAIIGTAVKGHVALHSDLXXXXXXXXNDTRKLERAVFGEVXXXXXXXXXTLWGDGVEESDLVIPHTIAGPKSKHNRREGYMXQNQGPWDENGLVPGLDYCPXXXXXXTEDCGKRGPSLRTTTXXXXXXXXXXXXXXXXXXXXXXXXXXXXXXXXXXXXXHDETTLVRSRVXXXXXXXXXXXXXXXXXXXXXXXXXXXXXXXXXXXXXXXXXXXXXXXXXXXXXXXXXXXXXXXXXXXXXXXXXXXXXXXXXXXXXXXXPAFLAMNTLSAKWTNQENMVLVLGAAFFQXXXXXXXXXXXXXXXXXXXXXXXXXAITFPTTSTVTMPVLTLLTPGMRALCLDTXXXXLLIIGVCSLLQERRRTMAKKKGAVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWGMDAAITGSSRXXXXXXXXXXXXXXXXXXXXXWKIWLLRMSCIGLVALTPXXXXXXXXXXXXXXXXXXXXXXXXXXXXXXXXXXXXXXXXXXXXXXXXXXXXYQAGVGVIYQNVFHTLWHTTRGAAIMSGGGKLTPYXXXXXXXXXXXXXXXXXXXXXXXXXXVQVIVVEPGKVAXXIQTKPGIFPTPFGKVGTVSLDYXXXXXXXXXXXXXXXXXXXXXXXXXXXXXXXXXXXXXXXXXEEPIPEAYNPSMLXXXXXXXXXXXXXXXXXXXXXXXIIRDAIQQRLRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEYGGATSEDDSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRSAVSFIEEPGRMPXXXXXXXXXXXXXXXXXXXXXXXXXXXXXXXXXXPDALETITLIIAIXXXXXXXXXXXXXXXXXXXXXXXXXXXXXXXXXXXXXXXXXXXXXXXXXXXXXXXXXXXPEPEKQKSQTDNQLXXXXXXXXXXXXXXXXXXXXXXXRTKADIKSMFAGKXQASGLTGLPSVXXXXXXXXXXXXXXXXXXXXXXXXXXXXXXXXXXXXXXXXXXXXXXXXXXXXXXXXXXXXXXXXXXXXXXXXQITLTTVLTAVVLAILHYGYMLPGXXXXXXXXXXXXXXXXXXXXXXXXXXXXXXXXXXXXXXXXXXXXXXXXXXXXXXXXXFLVNPNVTTVKXXXXXXXXXXXXXXXXXXXXXXXXXXXXXXXXXXXXXXXXXXXXXXXXIKNADKPSFKRGGPGGRTLGDQWKRKLNAMSREEFFQYRRXXXXXXXXXEARRARRENNKVGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDRAVWRGPKYEXXXXXXXXXXXXXXXXXXXXXXKIRKRIQKLREGFATTWHKDPEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKEEFINKVNSNASLGTVFAEQXXWSTAREAVGDSXFWEMVDVERENXXXXXXXXXXXXXXXXXXXXXXXXXXXXXXXXXXXXXXXXXXXXXXXXXFLNLDHWLSRENSGGGVEGLGVQKLGYIFRDXXXXXXXXXXXXXXXXXXXXXXXXXXXXXXXXXXXXXXXXXXXXXXXXXXXXXXXXXKVMRPSTEGKTVMVVYSRXXXXXXXXXXXXXXXXXXXXXXXXXXXXXXXXXXGPQHLEQLPKKNKIAVRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWNVKDTACLPKXXXXXWLLLYFHRRDQRXXXXXXXXXXXXXXXXXXXXXXXXXXXXXXXXXXXXXXXXXRVWIEENEWMMDMTPXXXXXXXXXXXXXXXXWCGSLIGTRSRATWAENVYAXXNQVRAIIGKENYVDYMLSPRRYEDVSIQEDRVXX

SEQ ID NO: 265857 - protein, 3402 aa, Dengue virus
  MOD_RES (1)..(10): Any amino acid
  MOD_RES (75)..(82): Any amino acid
  MOD_RES (97)..(114): Any amino acid
  MOD_RES (129)..(130): Any amino acid
  MOD_RES (143)..(145): Any amino acid
  MOD_RES (169)..(173): Any amino acid
  MOD_RES (196)..(197): Any amino acid
  MOD_RES (236)..(236): Any amino acid
  MOD_RES (248)..(280): Any amino acid
  MOD_RES (329)..(335): Any amino acid
  MOD_RES (344)..(348): Any amino acid
  MOD_RES (361)..(375): Any amino acid
  MOD_RES (400)..(412): Any amino acid
  MOD_RES (421)..(421): Any amino acid
  MOD_RES (430)..(461): Any amino acid
  MOD_RES (480)..(483): Any amino acid
  MOD_RES (502)..(513): Any amino acid
  MOD_RES (554)..(557): Any amino acid
  MOD_RES (575)..(590): Any amino acid
  MOD_RES (602)..(644): Any amino acid
  MOD_RES (659)..(672): Any amino acid
  MOD_RES (709)..(719): Any amino acid
  MOD_RES (738)..(741): Any amino acid
  MOD_RES (753)..(784): Any amino acid
  MOD_RES (826)..(826): Any amino acid
  MOD_RES (847)..(886): Any amino acid
  MOD_RES (898)..(907): Any amino acid
  MOD_RES (916)..(927): Any amino acid
  MOD_RES (947)..(953): Any amino acid
  MOD_RES (999)..(999): Any amino acid
  MOD_RES (1021)..(1022): Any amino acid
  MOD_RES (1036)..(1036): Any amino acid
  MOD_RES (1053)..(1065): Any amino acid
  MOD_RES (1122)..(1200): Any amino acid
  MOD_RES (1209)..(1218): Any amino acid
  MOD_RES (1233)..(1346): Any amino acid
  MOD_RES (1403)..(1409): Any amino acid
  MOD_RES (1420)..(1423): Any amino acid
  MOD_RES (1439)..(1439): Any amino acid
  MOD_RES (1455)..(1476): Any amino acid
  MOD_RES (1489)..(1493): Any amino acid
  MOD_RES (1537)..(1537): Any amino acid
  MOD_RES (1562)..(1564): Any amino acid
  MOD_RES (1588)..(1595): Any amino acid
  MOD_RES (1618)..(1618): Any amino acid
  MOD_RES (1646)..(1658): Any amino acid
  MOD_RES (1799)..(1799): Any amino acid
  MOD_RES (1826)..(1830): Any amino acid
  MOD_RES (1875)..(1875): Any amino acid
  MOD_RES (1943)..(1943): Any amino acid
  MOD_RES (2035)..(2035): Any amino acid
  MOD_RES (2044)..(2044): Any amino acid
  MOD_RES (2096)..(2098): Any amino acid
  MOD_RES (2110)..(2116): Any amino acid
  MOD_RES (2131)..(2134): Any amino acid
  MOD_RES (2163)..(2173): Any amino acid
  MOD_RES (2182)..(2194): Any amino acid
  MOD_RES (2238)..(2245): Any amino acid
  MOD_RES (2260)..(2277): Any amino acid
  MOD_RES (2362)..(2365): Any amino acid
  MOD_RES (2493)..(2502): Any amino acid
  MOD_RES (2517)..(2525): Any amino acid
  MOD_RES (2548)..(2548): Any amino acid
  MOD_RES (2570)..(2570): Any amino acid
  MOD_RES (2633)..(2633): Any amino acid
  MOD_RES (2671)..(2674): Any amino acid
  MOD_RES (2691)..(2699): Any amino acid
  MOD_RES (2745)..(2747): Any amino acid
  MOD_RES (2767)..(2769): Any amino acid
  MOD_RES (2783)..(2788): Any amino acid
  MOD_RES (2864)..(2888): Any amino acid
  MOD_RES (2925)..(2935): Any amino acid
  MOD_RES (3021)..(3024): Any amino acid
  MOD_RES (3049)..(3064): Any amino acid
  MOD_RES (3084)..(3084): Any amino acid
  MOD_RES (3127)..(3154): Any amino acid
  MOD_RES (3177)..(3178): Any amino acid
  MOD_RES (3288)..(3288): Any amino acid
  MOD_RES (3331)..(3336): Any amino acid
  MOD_RES (3366)..(3367): Any amino acid
  MOD_RES (3376)..(3382): Any amino acid
  MOD_RES (3393)..(3402): Any amino acid
XXXXXXXXXXPPFNMLKRERNRVSTGSQLAKRFSKGLFSGQGPMKLVMAFIAFLRFLAIPPTAGILKRWGQLKKXXXXXXXXGFRKEIGRMLNILNXXXXXXXXXXXXXXXXXXFHLTTRNGEPHMIVXXQERGKSLLFKTAXXXNMCTLIAMDLGELCEDTVTYKCPXXXXXEPEDIDCWCNLTSTWVTYGTCSXXGEHRRDKRSVALAPHVGMGLETRTETWMSSEGAWKHAQXVETWALRHPGFXXXXXXXXXXXXXXXXXXXXXXXXXXXXXXXXXMRCVGVGNRDFVEGLSGATWVDVVLEHGSCVTTMAKNKPTLDFELIKTXXXXXXXLRKLCIEAXXXXXTTDSRCPTQGEAXXXXXXXXXXXXXXXFVDRGWGNGCGLFGKGSLVTCAKFXXXXXXXXXXXXXENLKYSVIXTVHTGDQHXXXXXXXXXXXXXXXXXXXXXXXXXXXXXXXXTLECSPRTGLDFNEMVLLXXXXKSWLVHKQWFLDLPLPWTXXXXXXXXXXXXKDLLVTFKTAHAKKQEVVVLGSQEGAMHTALTGATEIQTSXXXXIFAGHLKCRLKMDKLTLXXXXXXXXXXXXXXXXEVAETQHGTVLXXXXXXXXXXXXXXXXXXXXXXXXXXXXXXXXXXXXXXXXXXXVNIEAEPPFGDSYIXXXXXXXXXXXXXXKKGSSIGKMFEATARGARRMAILGDTAWDFGSVGGVXXXXXXXXXXXFGTAYGVLFSGVSWTMKIXXXXLLTWLGLNSRSXXXXXXXXXXXXXXXXXXXXXXXXXXXXXXXXGKELKCGSGIFVTDNVHTWTEQYKFQADSPKKLASAILNAHXEGVCGIRSVTRLENIMWKQIXXXXXXXXXXXXXXXXXXXXXXXXXXXXXXXXXXXXXXXXKYSWKTWGKAKXXXXXXXXXXFIIDGPNTXXXXXXXXXXXXWEVEDYGFGVFTTNIWLKLXXXXXXXCDHRLMSAAIKDSKAVHADMGYWIESSKNQTWQIEKASLIEVKTCXWPKSHTLWSNGVLESEMIIPKXXAGPVSQHNYRPGYXTQTAGPWHLGKLELDFXXXXXXXXXXXXXCGNRGPSLRTTTASGKLIHEWCCRSCTMPPLRFRGEDGCWYGMEIRPLKEKEENLVXXXXXXXXXXXXXXXXXXXXXXXXXXXXXXXXXXXXXXXXXXXXXXXXXXXXXXXXXXXXXXXXXXXXXXXXXXXXXXXYLALLAAFXXXXXXXXXXFLRKLTSRETALMVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEGIMAVGMVSILASALLKNDIPMTGPLVAGGLLTVCYVLSGSSADLSLEKAXXXXXXXQAEISGSSPIXXXXQQEDGSMSIKNEEEEXMLTILIRTGLLVISGXXXXXXXXXXXXXXXXXXXXXXAGVLWDVPSPPPXXXXXLEDGAYRIMQRGLFGYSQIGAGVYKEGVFHTMWHVTRGSVICHXGGRLEPSWASVKKDLISYGGGWRLXXXWKEGEEVQVIAVEPGKNPRAVQTXXXXXXXXTGTIGAIALDFKPGTSGSPIINXKGKVVGLYGNGVVTKSGTYVSAITQAEXXXXXXXXXXXXXIFRKRRLTIMDLHPGAGKTKRYLPAIVREALKRRLRTLILAPTRVVAAEMEEALRGLPIRYQTPAVKSEHTGREIVDLMCHATFTMRLLSPVRVPNYNLIIMDEAHFTDPASIAARGYISTRVGMGEAAAIFMTATPPGSXEPFPQSNSPIQDEEREIPERSWNTGFXXXXXFKGKTVWFVPSIKAGNDIANCLRKNGKKVIQLSRKTFDTEYQKTXLNDWDFVVTTDISEMGANFRADRVIDPRRCLKPVILTDGPERVILAGPMPVTVASAAQRRGRIGRNPXNENDQYIYMGQPLNNDEDHAHWTEAKMLLDNINTPEGIIPALFEPEREKSAAIDGEYRLRGEARKTFVELMRRGDLPVWLSYKVASAGISYXDRRWCFDGXRNNQILEENMDVEIWTKEGERKKLRPRWLDARTYSDPLALKEFKEFAAGRKXXXLNLITEMGRLPXXXXXXXKNALDNIVMLHTTEXXXXAYQHALSELPETLETLLLLALLGAMTAGXXXXXXXXXXXGKMTLGMCXXXXXXXXXXXXXIQPHWIAASIILEFFLMVLLIPEPEKQRTPQDNQLTYVVIAILXXXXXXXXNEMGFLETTKKDLGXXXXXXXXXXXXXXXXXXLDVDLRPASAWTLYAVATTVLTPMLRHSIENSSVNVSLTAIANQAAVLMGLDKGWPLSKMDLGVPLLALGCYSQVNPLTLTAAVXXXXAHYAIIGPGLQAKATREAQKRTAAGIMKNPTVDGITVIDLEPIPYDPKFEKQLGQVMLLVLCVTQVLLMRTTWALCEALTLATGPITTLWEGNPGRFWNTTIAVSMANIFRGSYLAGAGLAFSLIKNXXXXXXXXXXQGETLGEKWKRQLNXXXXXXXXXYKKSGIQEVDRTEAKEGLKRGEXDHHAVSRGSAKLRWFVERNMVXPKGKVVDLGCGRGGWSYYCAGLKKVTEVKGYTKGGPGHEEPIPMATYGWNLVKLHSGVDVFYXPPEKCDTLLCDIGESSSNPTIEEGRTLRVLKMVEPWLXXXXQFCIKVLNPYMPTVIEXXXXXXXXXGGMLVRNPLSRNSTHEMYWVSNASGNIVSSVNMISRMLLNRFTTRXXXATYEKDVDLGAGTRSVSTEXXXPDMDIIGRRLQRLXXXXXXSWHYDQENPYKTWAYHGSYETKQTGSASSMVNGVVKLLTKPWDVIPMVTQMAMTDTTPFGQQRVFKEKVDTRTPRXXXXXXXXXXXXXXXXXXXXXXXXXPRLCTREEFTRKVRSNAAIGAVFTDENKWKSAREAVXXXXXXXXXXXERALHQEGKCETCVYNMMGKREKKLGEFGKAKGSRAIWYMWLGARFLEFEALGFLNEDHWFSRENSLSGVEGEGLHKLGYILRDIXXXXGGAMYADDTAGWDTRITEDDLQNEXXXXXXXXXXXXXXXXAIFKLTYQNKVVRVQRPTPXGTVMDIISRKDQRGSGQVGTYGLNTFTNMEAQLIRQMEGEGVXXXXXXXXXXXXXXXXXXXXXXXXXXXXERLKRMAISGDDCVVKPIDDRFXXALTALNDMGKVRKDIPQWEPSKGWKDWQQVPFCSHHFHELIMKDGRSLVVPCRNQDELIGRARISQGAGWSLRETACLGKAYAQMWSLMYFHRRDLRLAANAICSAVPVXWVPTSRTTWSIHAHHQWMTTEDMLTVWNRVWIEENPWMEDKTXXXXXXDVPYLGKREDQWCGSLIGLTSRATWAKNIXXAITQVRNLXXXXXXXDYMPSMKRFRXXXXXXXXXX

SEQ ID NO: 265858 - protein, 3402 aa, Dengue virus
  MOD_RES (1)..(10): Any amino acid
  MOD_RES (75)..(82): Any amino acid
  MOD_RES (97)..(114): Any amino acid
  MOD_RES (129)..(130): Any amino acid
  MOD_RES (143)..(145): Any amino acid
  MOD_RES (169)..(173): Any amino acid
  MOD_RES (196)..(197): Any amino acid
  MOD_RES (236)..(236): Any amino acid
  MOD_RES (248)..(280): Any amino acid
  MOD_RES (329)..(335): Any amino acid
  MOD_RES (344)..(348): Any amino acid
  MOD_RES (361)..(375): Any amino acid
  MOD_RES (384)..(384): Any amino acid
  MOD_RES (400)..(412): Any amino acid
  MOD_RES (421)..(421): Any amino acid
  MOD_RES (430)..(461): Any amino acid
  MOD_RES (480)..(483): Any amino acid
  MOD_RES (502)..(513): Any amino acid
  MOD_RES (554)..(557): Any amino acid
  MOD_RES (575)..(590): Any amino acid
  MOD_RES (602)..(644): Any amino acid
  MOD_RES (659)..(672): Any amino acid
  MOD_RES (709)..(719): Any amino acid
  MOD_RES (738)..(741): Any amino acid
  MOD_RES (753)..(784): Any amino acid
  MOD_RES (826)..(826): Any amino acid
  MOD_RES (847)..(886): Any amino acid
  MOD_RES (898)..(907): Any amino acid
  MOD_RES (916)..(927): Any amino acid
  MOD_RES (947)..(953): Any amino acid
  MOD_RES (999)..(999): Any amino acid
  MOD_RES (1021)..(1022): Any amino acid
  MOD_RES (1036)..(1036): Any amino acid
  MOD_RES (1053)..(1065): Any amino acid
  MOD_RES (1122)..(1200): Any amino acid
  MOD_RES (1209)..(1218): Any amino acid
  MOD_RES (1233)..(1346): Any amino acid
  MOD_RES (1403)..(1409): Any amino acid
  MOD_RES (1420)..(1423): Any amino acid
  MOD_RES (1439)..(1439): Any amino acid
  MOD_RES (1455)..(1476): Any amino acid
  MOD_RES (1489)..(1493): Any amino acid
  MOD_RES (1537)..(1537): Any amino acid
  MOD_RES (1562)..(1564): Any amino acid
  MOD_RES (1588)..(1595): Any amino acid
  MOD_RES (1618)..(1618): Any amino acid
  MOD_RES (1646)..(1658): Any amino acid
  MOD_RES (1799)..(1799): Any amino acid
  MOD_RES (1826)..(1830): Any amino acid
  MOD_RES (1875)..(1875): Any amino acid
  MOD_RES (1943)..(1943): Any amino acid
  MOD_RES (2035)..(2035): Any amino acid
  MOD_RES (2044)..(2044): Any amino acid
  MOD_RES (2096)..(2098): Any amino acid
  MOD_RES (2110)..(2116): Any amino acid
  MOD_RES (2131)..(2134): Any amino acid
  MOD_RES (2163)..(2173): Any amino acid
  MOD_RES (2182)..(2194): Any amino acid
  MOD_RES (2238)..(2245): Any amino acid
  MOD_RES (2260)..(2277): Any amino acid
  MOD_RES (2362)..(2365): Any amino acid
  MOD_RES (2374)..(2379): Any amino acid
  MOD_RES (2493)..(2502): Any amino acid
  MOD_RES (2517)..(2525): Any amino acid
  MOD_RES (2548)..(2548): Any amino acid
  MOD_RES (2570)..(2570): Any amino acid
  MOD_RES (2633)..(2633): Any amino acid
  MOD_RES (2671)..(2674): Any amino acid
  MOD_RES (2691)..(2699): Any amino acid
  MOD_RES (2745)..(2747): Any amino acid
  MOD_RES (2767)..(2769): Any amino acid
  MOD_RES (2783)..(2788): Any amino acid
  MOD_RES (2847)..(2854): Any amino acid
  MOD_RES (2864)..(2888): Any amino acid
  MOD_RES (2925)..(2935): Any amino acid
  MOD_RES (2955)..(2957): Any amino acid
  MOD_RES (2973)..(2973): Any amino acid
  MOD_RES (3021)..(3024): Any amino acid
  MOD_RES (3049)..(3064): Any amino acid
  MOD_RES (3084)..(3084): Any amino acid
  MOD_RES (3127)..(3154): Any amino acid
  MOD_RES (3177)..(3178): Any amino acid
  MOD_RES (3288)..(3288): Any amino acid
  MOD_RES (3331)..(3336): Any amino acid
  MOD_RES (3366)..(3367): Any amino acid
  MOD_RES (3376)..(3382): Any amino acid
  MOD_RES (3393)..(3402): Any amino acid
XXXXXXXXXXPSFNMLKRARNRVSTPQGLVKRFSTGLLNGKGPLRMVLAFITFLRVLSIPPTAGVLARWGTFKKXXXXXXXXGFKKEISNMLSIINXXXXXXXXXXXXXXXXXXFHLTSRDGEPRMIVXXNEKGKSLLFKTSXXXNKCTLMAMDLGEMCDDTMTYKCPXXXXXEPDDIDCWCNSTDTWVTYGTCNXXGEHRREKRSVALVPHVGMGLETRAQTWMSAEGAWRQVEXVESWILRNPGFXXXXXXXXXXXXXXXXXXXXXXXXXXXXXXXXXMRCIGISNRDFVEGVSGGAWVDVVLEHGGCVTTMAQGKPTLDIELLKTXXXXXXXLRKLCIEGXXXXXTTATRCPTQGEPXXXXXXXXXXXXXXXYVDRGWGNXCGLFGKGGVVTCAKFXXXXXXXXXXXXXENLEYTVVXTVHNGDTHXXXXXXXXXXXXXXXXXXXXXXXXXXXXXXXXGLDCEPRSGLDFNEMILLXXXXKAWMVHRQWFFDLPLPWTXXXXXXXXXXXXKELLVTFKNPHAKRQDVTVLGSQEGAMHSALTGATEVDSGXXXXMFAGHLKCRLKMDKLELXXXXXXXXXXXXXXXXEVSETQHGTILXXXXXXXXXXXXXXXXXXXXXXXXXXXXXXXXXXXXXXXXXXXTNIELEPPFGESNIXXXXXXXXXXXXXXRKGSSIGQMFESTYRGAKRMAILGETAWDFGSIGGVXXXXXXXXXXXFGSAYTALFSGVSWMIRIXXXXLLTWIGLNSKNXXXXXXXXXXXXXXXXXXXXXXXXXXXXXXXXGRELKCGSGIFITNEVHTWTEQYKFQPESPSRLSAAIGKAWXDGICGIRSTTRLENLMWKQIXXXXXXXXXXXXXXXXXXXXXXXXXXXXXXXXXXXXXXXXKYSWKSWGKAKXXXXXXXXXXFLIDGPETXXXXXXXXXXXXLEVEDYGFGIFTTNIWMKFXXXXXXXCDSKLMSAAVKDQRAVHADMGYWIESEKNETWKLEKASFIEVKTCXWPKTHTLWSNGVLESDMIIPKXXAGPISQHNYRQGYXTQTVGPWHLGKLEIDFXXXXXXXXXXXXXCGHRGPSLRTTTASGKLVTQWCCRSCTLPPLRYLGEDGCWYGMEIRPVSEKEENMVXXXXXXXXXXXXXXXXXXXXXXXXXXXXXXXXXXXXXXXXXXXXXXXXXXXXXXXXXXXXXXXXXXXXXXXXXXXXXXXYLALMATFXXXXXXXXXXLLRRLTSREVLLLTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEGVMAVGLVSLLGSSLLKNDVPLAGPMVAGGLLLAAYVMTGRSADLELERAXXXXXXXMADITGSSPIXXXXVDDDGTMKIKDEERDXTITLLVKLALITVSGXXXXXXXXXXXXXXXXXXXXXXSGALWDVPSPAAXXXXXLDEGVYRIKQQGILGKTQVGVGVFQEGTFHTMWHVTRGAVLMHXGKRIEPSWADVRNDMISYGGGWKLXXXWDKGEEVQVLALEPGKNPKHVQTXXXXXXXXEGEIGAVSLDFSPGTSGSPIVNXKGKVIGLYGNGVVTTSGDYVSAIAQTEXXXXXXXXXXXXXMFKKKNLTIMDLHPGAGKTKRILPSIVREAIKRGLRTLILAPTRVVASEMAEALKGLPIRYQTTAVKSEHTGKEIVDLMCHATFTTRLLSSTRVPNYNLIVMDEAHFTDPSSVAARGYISTRVEMGEAAGIFMTATPPGTXDPFPQSNAVIEDEERDIPERSWNSGHXXXXXYQGKTVWFVPSIKAGNDIAACLRKNGKRVIQLSRKTFDTEYPKTXNTDWDYVVTTDISEMGANFRAERVIDPRRCMKPVILTDGEERVILAGPIPVTPSSAAQRRGRVGRNPXQEDDQYVFMGEPLENDEDCAHWKEAKMLLDNIYTPEGIIPTLFEPEREKVQAIDGEFRLRGEQRKTFVDLMKRGDLPVWLAHKVAAEGINYXDRKWCFDGXRNNQVLEENMEVEIWTREGEKKKLKPRWLDARVYADPMALKDFKEFASGRKXXXLDLILEIGKLPXXXXXXXQLALDNLAVLHTAEXXXXAYNHALNELPESLETLMLVALLATVTGGXXXXXXXXXXXGKLSMGLIXXXXXXXXXXXXXIQPQWIASAIILEFFLIVLLIPEPDRQRTPQDNQLAYVVIGLLXXXXXXXXNEMGLIEKTKTDFGXXXXXXXXXXXXXXXXXXLDVDLHPASAWTLYAVATTIITPMLRHTIENTSANLSLTAIANQAAILMGLGKGWPLHRMDIGVPLLAIGCYSQVNPITLTAALXXXXVHYAIIGPXXXXXXTREAQKRAAAGIMKNPTVDGIVAIDLDPISYDAKFEKQLGQIMLLILCTGQLLMMRTTWALCEVITLATGPLSTLWEGSPGKFWNTTIAVSTANIFRGSYLAGAGLLFSIMKNXXXXXXXXXXTGETLGEKWKSRLNXXXXXXXXXYKRSGILEVDRTLAKEGIKRGEXTKHAVSRGSSKIRWFVERNLVXPEGKVIDLGCGRGGWSYYMATLKNVREVKGLTKGGPGHEEPIPMSTYGWNLVRLQSGVDVFFXPTEQVDTLLCDIGESSPSPTVEAGRTLRVLNLVENWLXXXXEFCIKVLNPYMPSVIEXXXXXXXXXGGALVRCPLSRNSTHEMYWVSCGTGNIVSAVNMTSKMLLNRFTMAXXXPTYEPDVDLGSGTRNIGIEXXXPNLTIIGKRIEKIXXXXXXTWHYDQDNPYRTWAYHGSYEAPSSGSASSMVNGVVRLLTKPWDVVPMVTQLAMTDTTPXXXXXXXXEKVDTRTQEXXXXXXXXXXXXXXXXXXXXXXXXXPRICTREEFTSKVRSNAALGAIFQEEQGWTSASEAVXXXXXXXXXXXERNLHLEGKCESCVYNMMGXXXKKLGEFGRAKGSRAIXYMWLGARYLEFEALGFMNEDHWFGRENSWSGVEGEGLHRLGYILRDVXXXXGGNIYADDTAGWDTRITLEDLKNEXXXXXXXXXXXXXXXXSIFKLTYQNKVVKVLRPTPXGAVMDVISRRDQRGSGQVVTYGLNTFTNMEVQLIRQMEAEGVXXXXXXXXXXXXXXXXXXXXXXXXXXXXDRLSRMAISGDDCVVKPLDERFXXSLLFLNDMGKVRKDIPQWEPSKGWNDWTEVPFCSHHFHKIFMKDGREIVVPCRNQDELVGRARVSQGAGWSLKETACLGKSYAQMWQLMYFHRRDLRLASMAICSAVPTXWFPTSRTTWSIHAKHEWMTTEDMLKVWNRVWIQDNPNMIDKTXXXXXXDIPYLGKREDLWCGSLIGLSSRATWAQNIXXAINQVRSLXXXXXXXDYMTSMKRFKXXXXXXXXXX

SEQ ID NO: 265859 - protein, 3402 aa, Dengue virus
  MOD_RES (1)..(10): Any amino acid
  MOD_RES (75)..(82): Any amino acid
  MOD_RES (97)..(114): Any amino acid
  MOD_RES (129)..(130): Any amino acid
  MOD_RES (143)..(145): Any amino acid
  MOD_RES (169)..(176): Any amino acid
  MOD_RES (196)..(197): Any amino acid
  MOD_RES (236)..(236): Any amino acid
  MOD_RES (248)..(280): Any amino acid
  MOD_RES (329)..(335): Any amino acid
  MOD_RES (344)..(348): Any amino acid
  MOD_RES (359)..(375): Any amino acid
  MOD_RES (384)..(385): Any amino acid
  MOD_RES (400)..(412): Any amino acid
  MOD_RES (421)..(421): Any amino acid
  MOD_RES (430)..(461): Any amino acid
  MOD_RES (480)..(483): Any amino acid
  MOD_RES (502)..(513): Any amino acid
  MOD_RES (537)..(537): Any amino acid
  MOD_RES (554)..(557): Any amino acid
  MOD_RES (575)..(590): Any amino acid
  MOD_RES (602)..(644): Any amino acid
  MOD_RES (659)..(672): Any amino acid
  MOD_RES (709)..(719): Any amino acid
  MOD_RES (738)..(741): Any amino acid
  MOD_RES (753)..(784): Any amino acid
  MOD_RES (826)..(826): Any amino acid
  MOD_RES (847)..(886): Any amino acid
  MOD_RES (898)..(907): Any amino acid
  MOD_RES (916)..(927): Any amino acid
  MOD_RES (947)..(955): Any amino acid
  MOD_RES (999)..(1000): Any amino acid
  MOD_RES (1021)..(1022): Any amino acid
  MOD_RES (1036)..(1036): Any amino acid
  MOD_RES (1053)..(1065): Any amino acid
  MOD_RES (1122)..(1200): Any amino acid
  MOD_RES (1209)..(1218): Any amino acid
  MOD_RES (1233)..(1346): Any amino acid
  MOD_RES (1403)..(1409): Any amino acid
  MOD_RES (1420)..(1423): Any amino acid
  MOD_RES (1439)..(1439): Any amino acid
  MOD_RES (1455)..(1476): Any amino acid
  MOD_RES (1489)..(1493): Any amino acid
  MOD_RES (1537)..(1537): Any amino acid
  MOD_RES (1562)..(1564): Any amino acid
  MOD_RES (1588)..(1595): Any amino acid
  MOD_RES (1618)..(1618): Any amino acid
  MOD_RES (1646)..(1658): Any amino acid
  MOD_RES (1671)..(1671): Any amino acid
  MOD_RES (1700)..(1705): Any amino acid
  MOD_RES (1734)..(1742): Any amino acid
  MOD_RES (1777)..(1780): Any amino acid
  MOD_RES (1790)..(1790): Any amino acid
  MOD_RES (1799)..(1799): Any amino acid
  MOD_RES (1826)..(1830): Any amino acid
  MOD_RES (1863)..(1864): Any amino acid
  MOD_RES (1875)..(1875): Any amino acid
  MOD_RES (1885)..(1889): Any amino acid
  MOD_RES (1943)..(1943): Any amino acid
  MOD_RES (1965)..(1976): Any amino acid
  MOD_RES (2035)..(2035): Any amino acid
  MOD_RES (2044)..(2044): Any amino acid
  MOD_RES (2096)..(2098): Any amino acid
  MOD_RES (2110)..(2116): Any amino acid
  MOD_RES (2131)..(2134): Any amino acid
  MOD_RES (2163)..(2173): Any amino acid
  MOD_RES (2182)..(2194): Any amino acid
  MOD_RES (2218)..(2222): Any amino acid
  MOD_RES (2238)..(2245): Any amino acid
  MOD_RES (2260)..(2277): Any amino acid
  MOD_RES (2288)..(2289): Any amino acid
  MOD_RES (2362)..(2365): Any amino acid
  MOD_RES (2374)..(2393): Any amino acid
  MOD_RES (2466)..(2481): Any amino acid
  MOD_RES (2493)..(2502): Any amino acid
  MOD_RES (2517)..(2525): Any amino acid
  MOD_RES (2548)..(2548): Any amino acid
  MOD_RES (2570)..(2570): Any amino acid
  MOD_RES (2582)..(2582): Any amino acid
  MOD_RES (2633)..(2633): Any amino acid
  MOD_RES (2643)..(2643): Any amino acid
  MOD_RES (2671)..(2674): Any amino acid
  MOD_RES (2691)..(2699): Any amino acid
  MOD_RES (2710)..(2713): Any amino acid
  MOD_RES (2745)..(2747): Any amino acid
  MOD_RES (2767)..(2769): Any amino acid
  MOD_RES (2783)..(2788): Any amino acid
  MOD_RES (2847)..(2855): Any amino acid
  MOD_RES (2864)..(2888): Any amino acid
  MOD_RES (2925)..(2935): Any amino acid
  MOD_RES (2954)..(2989): Any amino acid
  MOD_RES (3010)..(3010): Any amino acid
  MOD_RES (3021)..(3024): Any amino acid
  MOD_RES (3049)..(3071): Any amino acid
  MOD_RES (3084)..(3084): Any amino acid
  MOD_RES (3098)..(3110): Any amino acid
  MOD_RES (3127)..(3154): Any amino acid
  MOD_RES (3177)..(3178): Any amino acid
  MOD_RES (3240)..(3257): Any amino acid
  MOD_RES (3288)..(3288): Any amino acid
  MOD_RES (3331)..(3336): Any amino acid
  MOD_RES (3345)..(3349): Any amino acid
  MOD_RES (3366)..(3367): Any amino acid
  MOD_RES (3376)..(3382): Any amino acid
  MOD_RES (3393)..(3402): Any amino acid
XXXXXXXXXXPSINMLKRVRNRVSTVQQLTKRFSLGLLSGRGPLKLFMALVAFLRFLAIPPTAGILKRWGTIKKXXXXXXXXGFKKEISNMLNIMNXXXXXXXXXXXXXXXXXXFHLTTRGGEPHMIVXXQERGKSLLFKTEXXXNMCTLMAIDLGEMCEDTITYKCPXXXXXXXXDVDCWCNATSAWVTYGTCTXXGERRREKRSVALAPHVGLGLDTRTQTWMSSEGAWKQIQXIETWILRHPGFXXXXXXXXXXXXXXXXXXXXXXXXXXXXXXXXXMRCVGIGSRDFVEGVSGGSWVDLVLEHGGCVTTMAKNKPTLDIELQKTXXXXXXXLRTYCIEAXXXXXTTESRCPTQGXXXXXXXXXXXXXXXXXMVDRGWGNXXGLFGKGGIVTCAMFXXXXXXXXXXXXXENLKYTVIXTPHSGEEHXXXXXXXXXXXXXXXXXXXXXXXXXXXXXXXXTLDCSPRTGIDFNEMILMXXXXKTWLVHRQWFLDLPLPWLXXXXXXXXXXXXQERMVTFKVPHAKKQDVVVLGSQXGAMHSALAGATEIQMSXXXXLFTGHLKCKVRMEKLRIXXXXXXXXXXXXXXXXEMAETQHGTTVXXXXXXXXXXXXXXXXXXXXXXXXXXXXXXXXXXXXXXXXXXXVNIEAEPPFGESYIXXXXXXXXXXXXXXKKGSTIGKMFETTMRGAKRMAILGDTAWDFGSVGGLXXXXXXXXXXXFGSVYTTMFGGVSWVMKIXXXXLVLWIGTNSRNXXXXXXXXXXXXXXXXXXXXXXXXXXXXXXXXNKELKCGSGIFVVDNVHTRTEQYKFQPESPARLATAIAGAWXEGVCGIRSTTRLENVMWKQIXXXXXXXXXXXXXXXXXXXXXXXXXXXXXXXXXXXXXXXXRYSWKAWGKAKXXXXXXXXXXFLIDGPDTXXXXXXXXXXXXFEVEDYGFGMFSTNIWLKLXXXXXXXXXHRLMSAAVKDERAVHADMGYWIESQKNGSWKLARASFIEVKSCXXPRSHTLWSNGVLESQMLIPKXXGGPISQHNHRPGYXTQIMGPWHLGKLEMDFXXXXXXXXXXXXXCDTRGPSLRTTTVTGKIITEWCCRSCTLPPLRYMGEDGCWYGMEIRPINEKEENMVXXXXXXXXXXXXXXXXXXXXXXXXXXXXXXXXXXXXXXXXXXXXXXXXXXXXXXXXXXXXXXXXXXXXXXXXXXXXXXXHLAIMAVFXXXXXXXXXXLFRKLTSRENLLLGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEAIMAVGLVSILLSSLLRNDVPLAGPLIAGGMLIACYVITGTSADLTVEKAXXXXXXXEAEQTGVSHNXXXXISEDGSFSIRDVEETXTLTILLKATLLAVSGXXXXXXXXXXXXXXXXXXXXXXSGVLWDTPSPPEXXXXXLSEGVYRIKQRGILGRSQVGVGIHMENVFHTMWHVTRGAVLMYXTKRLEPSWADVKKDLISYGGGWRFXXXWNTEEDVQVLAIEPGKNPKNVQTXXXXXXXXTGEVGAVTLDFKPGTSGSPIVDXEGKIVGLYGNGVVTRSGAYVSAIAQAKXXXXXXXXXXXXXVFRKRRLTIMDLXPGSGKTRKYLPAIIREAIKRKLRTLILAXXXXXXAEMEEALKGMPIRYQTPAIRAEHTGREIXXXXXXXXXTMRLLSPVRVPNYNMVIMDEAHFTDPSSIAARGYXXXXVEMGEAAAIXMTATPPGAXDAFPQSNAPIMDIEREIPERSWNSGYXXXXXFPGKTVWFVPSIKSGNDIANCLRKSGKKVIQLXXKTFDSEYVKTXLNDWDYVVTXXXXXMGANFKAGRVIDPRRCLKPVILKDGEERVVLAGPMPVTHSSAAQRRGRIGRNHXKENDQYIYSGDPLKNDEDHAHXXXXXXXXXXXXTPEGIIPSMFGPEREKTDAIDGEYRLKGEARKTFVELMKRGDLPVWLAYKVASEGFQYXDREWCFTGXKNNQILEENVEVEIWTKEGERKKLRPRWLDARIYSDPLALREFKEFAAGRRXXXGDLVTEIGRVPXXXXXXXRDALDNLVMLHNSEXXXXAYRHAMEELPDTIETLMLLTLIAVLTGGXXXXXXXXXXXGKTSIGLLXXXXXXXXXXXXXVELQWIASAIVLEFFMMVLLIPEXXXXXTPQDNQLIYVILTILXXXXXXXXNEMGLLEKTKKDLGXXXXXXXXXXXXXXXXXXLDIDLRPASAXXLYAVATTFITPMMRHTIENTTANISLAAIANQATVLMGLGKGWPISKVDIGVPLLAMGCYSQVNPTTLTASLXXXXTHYAIIGPXXXXXXXXXXXXXXXXXXXXNPTVDGIMTIDLDPVVYDSKFEKQLGQVMLLILCASQILLMRTSWAFCESLTLATGPVLTLWEGNPGKFWNTXXXXXXXXXXXXXXXXGAGLAFSLMKSXXXXXXXXXXIGETLGEKWKKKLNXXXXXXXXXYKRSGIMEVDRSEAKSALKDGSXIKHAVSRGTAKLRWIVERGMVXPEGRVIDLGCGXGGWSYYCGGLKNVTEVRGFTKGGPGHEEPVPMSTYGWNIVKLHSGKDVFFXPPERCDTLLXDIGESSPNPTIEESRTIRVLSLVENWLXXXXQFCVKILNPYMPSVVEXXXXXXXXXGGNLVRCPLSXXXXHEMYWVSGATGNIVSSVNMVSRMLLNRFTMTXXXPTYERDVDLGAGTRHVAVEXXXANLDIIGQRIENIXXXXXXTWHYDEDHPYKTWAYHGSYEVKPTGSASSMINGVVKLLTKPWDVLPMVTQIAMTDTTPXXXXXXXXXKVDTRTPQXXXXXXXXXXXXXXXXXXXXXXXXXPRMCTREEFIKKVRTNAAIGAVFVDENQWNSAKEAVXXXXXXXXXXXERELHKQGKCATCVYNMMXXXXXXXXXXXXXXXXXXXXXXXXXXXXXXXXXXXXLNEDHWFSRENSYSGVEGEGXHRLGYILEEIXXXXGDLMYADDTAGWDTRITEDDLHNEXXXXXXXXXXXXXXXXXXXXXXXQNKVVRVQRPAKXGTVMDIISRRDQRXXXXXXXXXXXXXTNMEAQLIRQMESEGIXXXXXXXXXXXXXXXXXXXXXXXXXXXXERLRRMAISGDDCVVKPLDDRFXXALLALNDMGKIRKDIQQWQPSKGWNNWQEVPFCSHHFHQLIMKDGRVLVVPCRPQDELIGRXXXXXXXXXXXXXXXXXXKSYAQMWTLMYFHRRDLRLASNAICSAVPSXWIPTSRTTWSIHATHEWMTTEDMLSVWNRVWIRDNPNMTDKTXXXXXXEVPYLGKRXXXXXGSLIGLTARATWATNIXXAINQVRRLXXXXXXXDYMPVMKRYSXXXXXXXXXX

SEQ ID NO: 265860 - protein, 3402 aa, Dengue virus
  MOD_RES (1)..(10): Any amino acid
  MOD_RES (19)..(19): Any amino acid
  MOD_RES (54)..(57): Any amino acid
  MOD_RES (75)..(82): Any amino acid
  MOD_RES (97)..(114): Any amino acid
  MOD_RES (129)..(130): Any amino acid
  MOD_RES (143)..(145): Any amino acid
  MOD_RES (169)..(176): Any amino acid
  MOD_RES (196)..(197): Any amino acid
  MOD_RES (236)..(236): Any amino acid
  MOD_RES (248)..(280): Any amino acid
  MOD_RES (294)..(301): Any amino acid
  MOD_RES (329)..(335): Any amino acid
  MOD_RES (344)..(348): Any amino acid
  MOD_RES (359)..(375): Any amino acid
  MOD_RES (384)..(386): Any amino acid
  MOD_RES (400)..(412): Any amino acid
  MOD_RES (421)..(421): Any amino acid
  MOD_RES (430)..(461): Any amino acid
  MOD_RES (478)..(483): Any amino acid
  MOD_RES (502)..(513): Any amino acid
  MOD_RES (535)..(544): Any amino acid
  MOD_RES (554)..(557): Any amino acid
  MOD_RES (575)..(590): Any amino acid
  MOD_RES (602)..(644): Any amino acid
  MOD_RES (659)..(672): Any amino acid
  MOD_RES (691)..(700): Any amino acid
  MOD_RES (709)..(719): Any amino acid
  MOD_RES (738)..(741): Any amino acid
  MOD_RES (753)..(784): Any amino acid
  MOD_RES (826)..(826): Any amino acid
  MOD_RES (847)..(886): Any amino acid
  MOD_RES (898)..(907): Any amino acid
  MOD_RES (916)..(931): Any amino acid
  MOD_RES (947)..(955): Any amino acid
  MOD_RES (999)..(1009): Any amino acid
  MOD_RES (1021)..(1022): Any amino acid
  MOD_RES (1036)..(1036): Any amino acid
  MOD_RES (1053)..(1065): Any amino acid
  MOD_RES (1090)..(1091): Any amino acid
  MOD_RES (1107)..(1113): Any amino acid
  MOD_RES (1122)..(1200): Any amino acid
  MOD_RES (1209)..(1218): Any amino acid
  MOD_RES (1233)..(1346): Any amino acid
  MOD_RES (1403)..(1409): Any amino acid
  MOD_RES (1420)..(1423): Any amino acid
  MOD_RES (1439)..(1439): Any amino acid
  MOD_RES (1455)..(1476): Any amino acid
  MOD_RES (1489)..(1493): Any amino acid
  MOD_RES (1527)..(1528): Any amino acid
  MOD_RES (1537)..(1537): Any amino acid
  MOD_RES (1555)..(1564): Any amino acid
  MOD_RES (1575)..(1577): Any amino acid
  MOD_RES (1588)..(1595): Any amino acid
  MOD_RES (1607)..(1609): Any amino acid
  MOD_RES (1618)..(1618): Any amino acid
  MOD_RES (1646)..(1658): Any amino acid
  MOD_RES (1669)..(1672): Any amino acid
  MOD_RES (1699)..(1716): Any amino acid
  MOD_RES (1734)..(1749): Any amino acid
  MOD_RES (1777)..(1799): Any amino acid
  MOD_RES (1826)..(1830): Any amino acid
  MOD_RES (1840)..(1842): Any amino acid
  MOD_RES (1863)..(1864): Any amino acid
  MOD_RES (1875)..(1875): Any amino acid
  MOD_RES (1884)..(1889): Any amino acid
  MOD_RES (1903)..(1904): Any amino acid
  MOD_RES (1920)..(1920): Any amino acid
  MOD_RES (1943)..(1943): Any amino acid
  MOD_RES (1965)..(1988): Any amino acid
  MOD_RES (2004)..(2004): Any amino acid
  MOD_RES (2014)..(2018): Any amino acid
  MOD_RES (2035)..(2047): Any amino acid
  MOD_RES (2062)..(2063): Any amino acid
  MOD_RES (2079)..(2081): Any amino acid
  MOD_RES (2096)..(2098): Any amino acid
  MOD_RES (2110)..(2116): Any amino acid
  MOD_RES (2131)..(2134): Any amino acid
  MOD_RES (2163)..(2173): Any amino acid
  MOD_RES (2182)..(2194): Any amino acid
  MOD_RES (2204)..(2227): Any amino acid
  MOD_RES (2238)..(2248): Any amino acid
  MOD_RES (2260)..(2290): Any amino acid
  MOD_RES (2347)..(2350): Any amino acid
  MOD_RES (2362)..(2393): Any amino acid
  MOD_RES (2417)..(2420): Any amino acid
  MOD_RES (2448)..(2451): Any amino acid
  MOD_RES (2460)..(2482): Any amino acid
  MOD_RES (2493)..(2502): Any amino acid
  MOD_RES (2517)..(2525): Any amino acid
  MOD_RES (2548)..(2548): Any amino acid
  MOD_RES (2570)..(2570): Any amino acid
  MOD_RES (2580)..(2586): Any amino acid
  MOD_RES (2607)..(2617): Any amino acid
  MOD_RES (2633)..(2646): Any amino acid
  MOD_RES (2668)..(2674): Any amino acid
  MOD_RES (2691)..(2699): Any amino acid
  MOD_RES (2710)..(2713): Any amino acid
  MOD_RES (2745)..(2747): Any amino acid
  MOD_RES (2767)..(2769): Any amino acid
  MOD_RES (2783)..(2788): Any amino acid
  MOD_RES (2803)..(2803): Any amino acid
  MOD_RES (2819)..(2827): Any amino acid
  MOD_RES (2843)..(2855): Any amino acid
  MOD_RES (2864)..(2888): Any amino acid
  MOD_RES (2925)..(2935): Any amino acid
  MOD_RES (2954)..(2997): Any amino acid
  MOD_RES (3007)..(3011): Any amino acid
  MOD_RES (3021)..(3024): Any amino acid
  MOD_RES (3035)..(3039): Any amino acid
  MOD_RES (3049)..(3074): Any amino acid
  MOD_RES (3084)..(3115): Any amino acid
  MOD_RES (3127)..(3154): Any amino acid
  MOD_RES (3163)..(3166): Any amino acid
  MOD_RES (3177)..(3178): Any amino acid
  MOD_RES (3189)..(3192): Any amino acid
  MOD_RES (3211)..(3211): Any amino acid
  MOD_RES (3228)..(3257): Any amino acid
  MOD_RES (3273)..(3279): Any amino acid
  MOD_RES (3288)..(3294): Any amino acid
  MOD_RES (3321)..(3321): Any amino acid
  MOD_RES (3330)..(3336): Any amino acid
  MOD_RES (3345)..(3355): Any amino acid
  MOD_RES (3366)..(3367): Any amino acid
  MOD_RES (3376)..(3382): Any amino acid
  MOD_RES (3393)..(3402): Any amino acid
XXXXXXXXXXTPFNMLKRXRNRVSTVSQLAKRFSRGMLQGQGPMKMVMAFIAFXXXXTIPPTAGILARWGSFKKXXXXXXXXGFKKEVSSMLNIMNXXXXXXXXXXXXXXXXXXFHLSTRDGEPLMIVXXHERGRPLLFKTTXXXNMCTLMAMDLGEFCEDTITYNCPXXXXXXXXDVDCWCNATSAWVMYGTCTXXGERRREKRSVALTPHSGMGLDTRAQTWMSSEGAWKHVQXVETWAFRHPGFXXXXXXXXXXXXXXXXXXXXXXXXXXXXXXXXXMRCVGIGNRDFVEXXXXXXXXDIVLEHGGCVTTMAKDKPTLDFELTKTXXXXXXXLRKYCIEAXXXXXTTASRCPTQGXXXXXXXXXXXXXXXXXVVDRGWGNXXXLFGKGSLITCAKFXXXXXXXXXXXXXENLEYTIVXTPHSGEENXXXXXXXXXXXXXXXXXXXXXXXXXXXXXXXXTMECSPRTSLDFNEMVXXXXXXKAWLVHKQWFFDLPLPWAXXXXXXXXXXXXKETLVTFKNPHAKRQDVVVLGXXXXXXXXXXTGATEIQNSXXXXLFMGHLKCRLRMDKLQLXXXXXXXXXXXXXXXXEIAETQHGTIVXXXXXXXXXXXXXXXXXXXXXXXXXXXXXXXXXXXXXXXXXXXINIETEPPSGESYIXXXXXXXXXXXXXXKRGSSIGKMLEATAKGARXXXXXXXXXXDFGSLGGVXXXXXXXXXXXFGAIYGAAFSGVSWIMKIXXXXIITWIGMNSRSXXXXXXXXXXXXXXXXXXXXXXXXXXXXXXXXGKELKCGSGIFVIDNVHTWTEQYQFQADSPKRLASAIQKAHXNGVCGIRSATRMENLLWKQIXXXXXXXXXXXXXXXXXXXXXXXXXXXXXXXXXXXXXXXXKYSWKTWGKARXXXXXXXXXXFIIDGPDTXXXXXXXXXXXXXXXXDYGFGVFTTNIWLRLXXXXXXXXXSKLMSAAVKDNRAVHADMGYWIESALNDTWKMERASFIEVKNCXXXXXXXXXXXGVLESQMLIPRXXAGPFSQHNNRPGYXTQTAGPWHLGRLEMDFXXXXXXXXXXXXXCGHRGSSLRTTTVSGKLIHEWCCRXXTLPPLRFKGEDGCWYXXXXXXXSEREENMVXXXXXXXXXXXXXXXXXXXXXXXXXXXXXXXXXXXXXXXXXXXXXXXXXXXXXXXXXXXXXXXXXXXXXXXXXXXXXXXYLALIATFXXXXXXXXXXFLRKLTSKELMMATXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEGIMAIGIVSILASSLLRNDVPMAGPLVAGGLLIACYVITGTSADLELEKAXXXXXXXEAEHSGASHNXXXXVDDDGTMRIKDDETEXILTVLLKTALLIVSGXXXXXXXXXXXXXXXXXXXXXXSGVLWDVPSPPEXXXXXLEDGIYRIKQKGIFGKTQVGVGVQKDGVFHTMWXXTRGAVLTYXGKRLEPNWANVKKDLISXXXXXXXXXXWQKGEEVQVIXXXPGKNPKNFQTXXXXXXXXTGEIGAIALDFXXXTSGSPIIDXEGKVVGLYGNGVVTKNGGYVSGIAQTNXXXXXXXXXXXXXIFRKRRLTIMXXXXGSGKTRKYLPAIVREAIKRKLRTLVLXXXXXXXXXXXXXXXXXXIRYQTTATKTEHTGREIXXXXXXXXXXXXXXXXIRVPNYNLVIMDEAHFTDPCSVAARGYXXXXXXXXXXXXXXXXXXXXXXXDAFPQSNAPIIDEEREIPERSWNSGNXXXXXFAGKTVWFVXXXKTGNDIAACLRKSGKRVIQLXXKTFDSEYIKTXTNDWDFVVXXXXXXMGANFKAERVIDPXXCLKPVILPDGPERVIXAGPMPVTAASAAQRRGRIGRNQXKEGDQYIFTGDPLRNDEDHAHXXXXXXXXXXXXXXXXXXXXXXXXEREKSAAVDGEYRLRXESRKTFVELXXXXXLPVWLAYKVASEGIKYXXXXXXXXXXXXXQILEENMEVEIWTKXXEKKKLRPKWLDARVYXXXLALKEFKDFAAGRKXXXLDILTEIASLPXXXXXXXRNALDNLVMLHTSEXXXXAYRHAVEELPETMETLLLLGLMILLTGGXXXXXXXXXXXGKTSIGLIXXXXXXXXXXXXXIPLQWIASAXXXXXXXXXXXXXXXXXXXXXXXXQLAYVVIGILXXXXXXXXXXXGLLETTKRDLGXXXXXXXXXXXXXXXXXXXXXXXXXXXXXXXYAVATTIVTPMLRHTIENSTANVSLAAIANQAVVLMGLGRGWPIHRVDLGVPLLALXXXXQVNPLTLIAAVXXXXXXXXXXXXXXXXXXXXXXXXXXXXXXXXNPTIDGITVIDLEPVIYDSKFEKXXXXVMLLVLCAVQLLLMRTSWALCEVLTLAXXXXMTLWEGNPXXXXXXXXXXXXXXXXXXXXXXXAGLAFSIMKSXXXXXXXXXXMGETLGEKWKNRLNXXXXXXXXXYKKSGITEVDRTEAKSALRDGSXTRHAVSRGSAKLQWIVERGMIXPEGRVIDLGXXXXXXXYYCGGLKNVKEVRGFTKGGPXXXXXXXXXXXGWNLVKLMSGKDVFYXXXXXXXXXXXXXXESSPNPTVEAGRTLRVLSLVEXXXXXXXQFCVKVLNPYMPAVIEXXXXXXXXXGGSLVRCPLSXXXXHEMYWISNGTGNIVASVNTTSRLLINRFTMKXXXPTIERDVDLGAGTRHVNAEXXXPNMDVIGERIKRIXXXXXXTWHYDDENPYKTWAXHGSYEVKATGSASSMXXXXXXXXXKPWDVVPTVTQMAMTXXXXXXXXXXXXXKVDTRTPKXXXXXXXXXXXXXXXXXXXXXXXXXPRLCTKAEFCKKVRSNAAMGAVFTEENQWDSAKAAVXXXXXXXXXXXERELHKLGKCGSCVYNMMXXXXXXXXXXXXXXXXXXXXXXXXXXXXXXXXXXXXXXXXXXXXRGNSLSGVEXXXXXRLGYILEDIXXXXGDLIYADDTAXXXXXITEDDLLNEXXXXXXXXXXXXXXXXXXXXXXXXXXVVKVQRPTPXXXXXXXXXXXXXXXXXXXXXXXXXXXXXXXXQLVRQMEGEGIXXXXXXXXXXXXXXXXXXXXXXXXXXXXERLRRMAIXXXXCVVKPTDDRFXXALIALNDMGKXXXXIQQWEPSRGWHDWQQVPFXSHHFHELVMKDGRKLVXXXXXXXXXXXXXXXXXXXXXXXXXXXXXXKSYAQMWALMYFHRRXXXXXXXAICSAVPPXXXXXXXTTWSIHASHEWMTTEDMLAVWNRVWIXDNPNMTDKXXXXXXXNVPYLGKRXXXXXXXXXXXTARATWASNIXXAIQQVRSLXXXXXXXDYMPAMKRYSXXXXXXXXXX

SEQ ID NO: 265861 - protein, 3402 aa, Dengue virus
  MOD_RES (1)..(19): Any amino acid
  MOD_RES (52)..(66): Any amino acid
  MOD_RES (75)..(82): Any amino acid
  MOD_RES (97)..(114): Any amino acid
  MOD_RES (124)..(134): Any amino acid
  MOD_RES (143)..(178): Any amino acid
  MOD_RES (194)..(207): Any amino acid
  MOD_RES (221)..(226): Any amino acid
  MOD_RES (236)..(236): Any amino acid
  MOD_RES (248)..(280): Any amino acid
  MOD_RES (292)..(308): Any amino acid
  MOD_RES (325)..(335): Any amino acid
  MOD_RES (344)..(375): Any amino acid
  MOD_RES (384)..(386): Any amino acid
  MOD_RES (400)..(412): Any amino acid
  MOD_RES (421)..(421): Any amino acid
  MOD_RES (430)..(461): Any amino acid
  MOD_RES (470)..(493): Any amino acid
  MOD_RES (502)..(513): Any amino acid
  MOD_RES (522)..(544): Any amino acid
  MOD_RES (554)..(565): Any amino acid
  MOD_RES (575)..(590): Any amino acid
  MOD_RES (600)..(647): Any amino acid
  MOD_RES (659)..(672): Any amino acid
  MOD_RES (681)..(719): Any amino acid
  MOD_RES (738)..(741): Any amino acid
  MOD_RES (753)..(784): Any amino acid
  MOD_RES (805)..(810): Any amino acid
  MOD_RES (826)..(826): Any amino acid
  MOD_RES (847)..(886): Any amino acid
  MOD_RES (898)..(907): Any amino acid
  MOD_RES (916)..(938): Any amino acid
  MOD_RES (947)..(963): Any amino acid
  MOD_RES (999)..(1012): Any amino acid
  MOD_RES (1021)..(1022): Any amino acid
  MOD_RES (1031)..(1036): Any amino acid
  MOD_RES (1047)..(1065): Any amino acid
  MOD_RES (1075)..(1091): Any amino acid
  MOD_RES (1106)..(1200): Any amino acid
  MOD_RES (1209)..(1218): Any amino acid
  MOD_RES (1233)..(1349): Any amino acid
  MOD_RES (1367)..(1393): Any amino acid
  MOD_RES (1403)..(1409): Any amino acid
  MOD_RES (1420)..(1423): Any amino acid
  MOD_RES (1439)..(1439): Any amino acid
  MOD_RES (1455)..(1480): Any amino acid
  MOD_RES (1489)..(1493): Any amino acid
  MOD_RES (1519)..(1528): Any amino acid
  MOD_RES (1537)..(1542): Any amino acid
  MOD_RES (1552)..(1564): Any amino acid
  MOD_RES (1575)..(1595): Any amino acid
  MOD_RES (1604)..(1628): Any amino acid
  MOD_RES (1646)..(1658): Any amino acid
  MOD_RES (1667)..(1676): Any amino acid
  MOD_RES (1698)..(1716): Any amino acid
  MOD_RES (1733)..(1802): Any amino acid
  MOD_RES (1818)..(1830): Any amino acid
  MOD_RES (1840)..(1864): Any amino acid
  MOD_RES (1875)..(1875): Any amino acid
  MOD_RES (1884)..(1889): Any amino acid
  MOD_RES (1903)..(1907): Any amino acid
  MOD_RES (1920)..(1934): Any amino acid
  MOD_RES (1943)..(1943): Any amino acid
  MOD_RES (1960)..(1988): Any amino acid
  MOD_RES (2001)..(2021): Any amino acid
  MOD_RES (2034)..(2098): Any amino acid
  MOD_RES (2110)..(2116): Any amino acid
  MOD_RES (2125)..(2134): Any amino acid
  MOD_RES (2144)..(2147): Any amino acid
  MOD_RES (2162)..(2173): Any amino acid
  MOD_RES (2182)..(2194): Any amino acid
  MOD_RES (2203)..(2228): Any amino acid
  MOD_RES (2238)..(2248): Any amino acid
  MOD_RES (2260)..(2290): Any amino acid
  MOD_RES (2306)..(2322): Any amino acid
  MOD_RES (2331)..(2333): Any amino acid
  MOD_RES (2342)..(2352): Any amino acid
  MOD_RES (2362)..(2394): Any amino acid
  MOD_RES (2414)..(2425): Any amino acid
  MOD_RES (2448)..(2525): Any amino acid
  MOD_RES (2537)..(2537): Any amino acid
  MOD_RES (2548)..(2548): Any amino acid
  MOD_RES (2565)..(2570): Any amino acid
  MOD_RES (2580)..(2588): Any amino acid
  MOD_RES (2599)..(2617): Any amino acid
  MOD_RES (2633)..(2648): Any amino acid
  MOD_RES (2658)..(2714): Any amino acid
  MOD_RES (2723)..(2728): Any amino acid
  MOD_RES (2745)..(2747): Any amino acid
  MOD_RES (2766)..(2769): Any amino acid
  MOD_RES (2783)..(2829): Any amino acid
  MOD_RES (2839)..(2894): Any amino acid
  MOD_RES (2925)..(2935): Any amino acid
  MOD_RES (2950)..(2997): Any amino acid
  MOD_RES (3007)..(3011): Any amino acid
  MOD_RES (3021)..(3039): Any amino acid
  MOD_RES (3049)..(3168): Any amino acid
  MOD_RES (3177)..(3178): Any amino acid
  MOD_RES (3189)..(3195): Any amino acid
  MOD_RES (3210)..(3219): Any amino acid
  MOD_RES (3228)..(3257): Any amino acid
  MOD_RES (3267)..(3279): Any amino acid
  MOD_RES (3288)..(3336): Any amino acid
  MOD_RES (3345)..(3355): Any amino acid
  MOD_RES (3364)..(3367): Any amino acid
  MOD_RES (3376)..(3383): Any amino acid
  MOD_RES (3392)..(3402): Any amino acid
XXXXXXXXXXXXXXXXXXXRNRVSTIQGLVKRFSSGLFSGQGPLKLFMAFVXXXXXXXXXXXXXXXARWSSFKKXXXXXXXXGFKREISNMLNTMNXXXXXXXXXXXXXXXXXXFSLSTRDGEXXXXXXXXXXXKSLLFKTKXXXXXXXXXXXXXXXXXXXXXXXXXXXXXXXXXXXXDCWCNTTETWVTYGTXXXXXXXXXXXXXXALTPHSGTGLETRXXXXXXSEGAWRQIQXIETWVLRHPGFXXXXXXXXXXXXXXXXXXXXXXXXXXXXXXXXXMRCIGVGNRDFXXXXXXXXXXXXXXXXXSCVTTIAKSKPTLDIEXXXXXXXXXXXLRKFCIEAXXXXXXXXXXXXXXXXXXXXXXXXXXXXXXXXLVDRGWGNXXXLFGKGSLLTCAKFXXXXXXXXXXXXXENLKYTVTXTVHNGDAHXXXXXXXXXXXXXXXXXXXXXXXXXXXXXXXXSLDCEPRSXXXXXXXXXXXXXXXXXXXXXXXXLDLPLPWAXXXXXXXXXXXXKDLLVTFKXXXXXXXXXXXXXXXXXXXXXXXTGATEIQISXXXXXXXXXXXXKVRMERLRIXXXXXXXXXXXXXXXXELAETQHGTXXXXXXXXXXXXXXXXXXXXXXXXXXXXXXXXXXXXXXXXXXXXXXXXEAEPPFGDSYVXXXXXXXXXXXXXXRRGSSIGKXXXXXXXXXXXXXXXXXXXXXXXXXXXXXXXXXXXXXXXFGAAYTALFGGVSWMVRIXXXXVITWLGLNSRNXXXXXXXXXXXXXXXXXXXXXXXXXXXXXXXXSKELKCGNGIFVADNVHTWTXXXXXXPESPARVASAIQKAQXDGVCGVRSTTRLENLLWKQVXXXXXXXXXXXXXXXXXXXXXXXXXXXXXXXXXXXXXXXXRYSWKIWGKAKXXXXXXXXXXFIIDGPSTXXXXXXXXXXXXXXXXXXXXXXXTTSIWMKFXXXXXXXXXXXXXXXXXKDDRAVHADMGYWIESRLNDTWKIEKASFIEIKSCXXXXXXXXXXXXXXESEMVIPKXXAGPFSHHNXXXXXXTQAAGPWHLGXXXXXXXXXXXXXXXXXXXCGHRGSSLRXXXXXXXXXXXXXXXXXTLPPLRFKGEDGCWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHLAIMIVFXXXXXXXXXXFLRRLTSKELMMTTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLNEAVMAVGVVSILLSSXXXXXXXXXXXXXXXXXXXXXXXXXXXSADLSLERAXXXXXXXEAEHSGTSHNXXXXIAEDGSFSIRDIEETXILTILLKATLLAISGXXXXXXXXXXXXXXXXXXXXXXXXXXWDVPSPATXXXXXLTDGIYRILQRGLLGKTQVGVGIHIXXXXXXXXXXTRGAVLTHXXXXXXPNWANVKKDXXXXXXXXXXXXXWDREEDVQVLXXXXXXXXXXXXXXXXXXXXXAGTIGAVSXXXXXXXXXXXXXXXXXXXXXXXXXGVVTRSGTYVSSIAQTEXXXXXXXXXXXXXVFKKRNLTXXXXXXXXXXTRRYLPAMVREAIRRGLRTLIXXXXXXXXXXXXXXXXXXXIRYQTTAIKAEHTGREXXXXXXXXXXXXXXXXXXXXXXXXXXXXXXXXXXXXXXXXXXXXXXXXXXXXXXXXXXXXXXXXXXXXXXPQSNAPIQDEEKDIPXXXXXXXXXXXXXFVGKTVWFVXXXXXXXXXXXXXXXXXXXXXXXXXKTFDTEYTKTXANDWDFVVXXXXXXMGANFRAERVIDPXXXXXPVISTDGEERVVXXXXXXXXXXXXXXXRGRIGRNLXKEGDQYVFSGDPLRNDXXXXXXXXXXXXXXXXXXXXXXXXXXXXXEREKNQAIDGEFXXXXXXXXXXXXXXXXXXXXXWLAYRVAAEGINXXXXXXXXXXXXXXXXXXXXXXXXXXXXXXXXXXXXXXXXXXXXXXXXXXXXXXXXXXXXXXXXXLDILTEIATLPXXXXXXXRNALDNLAXXXXXXXXXXAYTHALSELXXXXETLMLIGLLATVTGXXXXXXXXXXXXGKLSVGLIXXXXXXXXXXXXXVPLQWIASXXXXXXXXXXXXXXXXXXXXXXXXXXLIYVILAILXXXXXXXXXXXGLLEKTKKDFGXXXXXXXXXXXXXXXXXXXXXXXXXXXXXXXYAVATTFITPMLRHSXXXXXXXXXXXXXXXXXTVLMGLGRXXXLHRVDLGVXXXXXXXXXXXNPTTLIASLXXXXXXXXXXXXXXXXXXXXXXXXXXXXXXXXXPTVDGVTVIDLDPIPYDPKXXXXXXXXXXXXLCVGQLLLMRTSWAFCEALTLAXXXXXXXXXXXXXXXXXXXXXXXXXXXXXXXXXXXXXXXXXXXXXXXXXXXXXXXXXXXXXXXXXXXXXXXXXXXXXXYKRSGIIEVDRXEAKEGLRRGEXTKYAVSRGTSKIRWIVXXXXXXPEGKVMDLGXXXXXXXXXCGGLKDVREVXXXXXXXXXXXXXXXXXXXGWNLVKLYSGKDVFFXXXXXXXXXXXXXXXXSPNPTVEAGXXXXXXXXXXXXXXXXXXXXXXXXXXXXXXXXXXXXXXXXXXXXXXXXXXXXXXXXXEMYWVSGVXXXXXXSVNTISKMLINRFTMRXXXPTYEKDADLGTGTRHVAVXXXXPNMDVIGERIRRIXXXXXXXXXXXXXXXXXXXXXXXXXXXXXXXXXXXXXXXXXXXXXXXWDMIPMVTQXXXXXXXXXXXXXXXXXXXXXXXXXXXXXXXXXXXXXXXXXXXXXXXXXXXXXXXXEEFINKVRSNAALGAVFTDENQWDSARAAVXXXXXXXXXXXERNLHLDGKCETCVXXXXXXXXXXXXXXXXXXXXXXXXXXXXXXXXXXXXXXXXXXXXXXXXRENSFSGVEXXXXXRLGYILREVXXXXXXXXXXXXXXXXXXXITIEDLKNEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVKPVDDRFXXALFALNDMGKXXXXXXXWEPSKGWSDWTQVPXXXXXXXXXXMKDGRTLVXXXXXXXXXXXXXXXXXXXXXXXXXXXXXXKAYAQMWALXXXXXXXXXXXXXAICSAVPAXXXXXXXXXXXXXXXXXXXXXXXXXXXXXXXXXXXXXXXXXXXXXXXXXEIPYLGKRXXXXXXXXXXXTARATWASXXXXAIAQVRNLXXXXXXXXYMPVMRRYXXXXXXXXXXX

SEQ ID NO: 265862 - protein, 3402 aa, Dengue virus
  MOD_RES (1)..(10): Any amino acid
  MOD_RES (71)..(82): Any amino acid
  MOD_RES (93)..(114): Any amino acid
  MOD_RES (129)..(130): Any amino acid
  MOD_RES (143)..(145): Any amino acid
  MOD_RES (163)..(173): Any amino acid
  MOD_RES (195)..(197): Any amino acid
  MOD_RES (236)..(236): Any amino acid
  MOD_RES (248)..(280): Any amino acid
  MOD_RES (329)..(348): Any amino acid
  MOD_RES (361)..(375): Any amino acid
  MOD_RES (400)..(462): Any amino acid
  MOD_RES (480)..(483): Any amino acid
  MOD_RES (501)..(514): Any amino acid
  MOD_RES (553)..(557): Any amino acid
  MOD_RES (574)..(590): Any amino acid
  MOD_RES (602)..(644): Any amino acid
  MOD_RES (659)..(673): Any amino acid
  MOD_RES (709)..(719): Any amino acid
  MOD_RES (734)..(741): Any amino acid
  MOD_RES (753)..(784): Any amino acid
  MOD_RES (825)..(827): Any amino acid
  MOD_RES (847)..(887): Any amino acid
  MOD_RES (898)..(927): Any amino acid
  MOD_RES (947)..(953): Any amino acid
  MOD_RES (987)..(987): Any amino acid
  MOD_RES (999)..(999): Any amino acid
  MOD_RES (1021)..(1026): Any amino acid
  MOD_RES (1036)..(1036): Any amino acid
  MOD_RES (1053)..(1065): Any amino acid
  MOD_RES (1114)..(1218): Any amino acid
  MOD_RES (1233)..(1346): Any amino acid
  MOD_RES (1402)..(1409): Any amino acid
  MOD_RES (1420)..(1423): Any amino acid
  MOD_RES (1439)..(1439): Any amino acid
  MOD_RES (1455)..(1476): Any amino acid
  MOD_RES (1489)..(1506): Any amino acid
  MOD_RES (1518)..(1518): Any amino acid
  MOD_RES (1537)..(1537): Any amino acid
  MOD_RES (1562)..(1564): Any amino acid
  MOD_RES (1588)..(1595): Any amino acid
  MOD_RES (1618)..(1618): Any amino acid
  MOD_RES (1646)..(1659): Any amino acid
  MOD_RES (1799)..(1799): Any amino acid
  MOD_RES (1826)..(1830): Any amino acid
  MOD_RES (1875)..(1875): Any amino acid
  MOD_RES (1943)..(1943): Any amino acid
  MOD_RES (2035)..(2044): Any amino acid
  MOD_RES (2096)..(2099): Any amino acid
  MOD_RES (2110)..(2116): Any amino acid
  MOD_RES (2131)..(2134): Any amino acid
  MOD_RES (2163)..(2194): Any amino acid
  MOD_RES (2238)..(2245): Any amino acid
  MOD_RES (2260)..(2277): Any amino acid
  MOD_RES (2362)..(2365): Any amino acid
  MOD_RES (2493)..(2502): Any amino acid
  MOD_RES (2517)..(2525): Any amino acid
  MOD_RES (2548)..(2549): Any amino acid
  MOD_RES (2570)..(2570): Any amino acid
  MOD_RES (2633)..(2633): Any amino acid
  MOD_RES (2671)..(2674): Any amino acid
  MOD_RES (2691)..(2699): Any amino acid
  MOD_RES (2744)..(2747): Any amino acid
  MOD_RES (2767)..(2769): Any amino acid
  MOD_RES (2783)..(2788): Any amino acid
  MOD_RES (2864)..(2888): Any amino acid
  MOD_RES (2898)..(2899): Any amino acid
  MOD_RES (2925)..(2935): Any amino acid
  MOD_RES (3019)..(3024): Any amino acid
  MOD_RES (3049)..(3064): Any amino acid
  MOD_RES (3084)..(3084): Any amino acid
  MOD_RES (3127)..(3154): Any amino acid
  MOD_RES (3177)..(3178): Any amino acid
  MOD_RES (3225)..(3225): Any amino acid
  MOD_RES (3288)..(3288): Any amino acid
  MOD_RES (3321)..(3321): Any amino acid
  MOD_RES (3331)..(3336): Any amino acid
  MOD_RES (3366)..(3382): Any amino acid
  MOD_RES (3393)..(3402): Any amino acid
XXXXXXXXXXPPFNMLKRERNRVSTGSQLAKRFSKGLFSGQGPMKLVMAFIAFLRFLAIPPTAGILKRWGXXXXXXXXXXXXGFRKEIGRMLXXXXXXXXXXXXXXXXXXXXXXFHLTTRNGEPHMIVXXQERGKSLLFKTAXXXNMCTLIAMDLGELCEDTXXXXXXXXXXXEPEDIDCWCNLTSTWVTYGTCXXXGEHRRDKRSVALVPHVGMGLETRTETWMSSEGAWKHAQXVETWALRHPGFXXXXXXXXXXXXXXXXXXXXXXXXXXXXXXXXXMRCVGVGNRDFVEGLSGATWVDVVLEHGSCVTTMAKNKPTLDFELIKTXXXXXXXXXXXXXXXXXXXXTTDSRCPTQGEAXXXXXXXXXXXXXXXFVDRGWGNGCGLFGKGSLVTCAKFXXXXXXXXXXXXXXXXXXXXXXXXXXXXXXXXXXXXXXXXXXXXXXXXXXXXXXXXXXXXXXXLECSPRTGLDFNEMVLLXXXXKSWLVHKQWFLDLPLPWXXXXXXXXXXXXXXDLLVTFKTAHAKKQEVVVLGSQEGAMHTALTGATEIQTXXXXXIFAGHLKCRLKMDKLTXXXXXXXXXXXXXXXXXEVAETQHGTVLXXXXXXXXXXXXXXXXXXXXXXXXXXXXXXXXXXXXXXXXXXXVNIEAEPPFGDSYIXXXXXXXXXXXXXXXKGSSIGKMFEATARGARRMAILGDTAWDFGSVGGVXXXXXXXXXXXFGTAYGVLFSGVSWXXXXXXXXLLTWLGLNSRSXXXXXXXXXXXXXXXXXXXXXXXXXXXXXXXXGKELKCGSGIFVTDEVHTWTEQYKFQADSPSKLASAIQKAXXXGVCGIRSVTRLENIMWKQIXXXXXXXXXXXXXXXXXXXXXXXXXXXXXXXXXXXXXXXXXYSWKTWGKAKXXXXXXXXXXXXXXXXXXXXXXXXXXXXXXWEVEDYGFGVFTTNIWLKLXXXXXXXCDHRLMSAAIKDSKAVHADMGYWIESSKNQTWQXEKASLIEVKTCXWPKSHTLWSNGVLESEMIIPKXXXXXXSQHNYRPGYXTQTAGPWHLGKLELDFXXXXXXXXXXXXXCGNRGPSLRTTTASGKLIHEWCCRSCTMPPLRFRGEDGCWYGMEIRPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFLRKLTSRETALMVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEGIMAVGMVSILASALLKNDIPMTGPLVAGGLLTVCYVLSGSSADLSLEKXXXXXXXXQAEISGSSPIXXXXQQEDGSMSIKNEEEEXMLTILIRTGLLVISGXXXXXXXXXXXXXXXXXXXXXXAGVLWDVPSPPPXXXXXXXXXXXXXXXXXXFGYSQIGAGVYXEGVFHTMWHVTRGSVICHXGGRLEPSWASVKKDLISYGGGWRLXXXWKEGEEVQVIAVEPGKNPRAVQTXXXXXXXXTGTIGAIALDFKPGTSGSPIINXKGKVVGLYGNGVVTKSGDYVSAITQAEXXXXXXXXXXXXXXFRKRRLTIMDLHPGAGKTKRYLPAIVREALKRRLRTLILAPTRVVAAEMEEALRGLPIRYQTPAVKSEHTGREIVDLMCHATFTMRLLSPVRVPNYNLIIMDEAHFTDPASIAARGYISTRVGMGEAAAIFMTATPPGSXDPFPQSNSPIQDEERDIPERSWNTGFXXXXXFKGKTVWFVPSIKAGNDIANCLRKNGKKVIQLSRKTFDTEYQKTXLNDWDFVVTTDISEMGANFRADRVIDPRRCLKPVILTDGPERVILAGPMPVTVASAAQRRGRIGRNPXNENDQYIYMGQPLNNDEDHAHWTEAKMLLDNINTPEGIIPALFEPEREKSAAIDGEYRLRGEARKTFVELMRRGDLPVWLSYKVASAGISYXXXXXXXXXXRNNQILEENMDVEIWTKEGERKKLRPRWLDARVYSDPLALKEFKEFAAGRKXXXXNLITEMGRLPXXXXXXXKNALDNIVMLHTTEXXXXAYQHALSELPETLETLLLLALLGAMTAGXXXXXXXXXXXXXXXXXXXXXXXXXXXXXXXXIQPHWIAASIILEFFLMVLLIPEPEKQRTPQDNQLTYVVIAILXXXXXXXXNEMGFLETTKKDLGXXXXXXXXXXXXXXXXXXLDVDLRPASAWTLYAVATTVLTPMLRHSIENSSVNVSLTAIANQAAVLMGLDKGWPLSKMDLGVPLLALGCYSQVNPLTLTAAVXXXXAHYAIIGPGLQAKATREAQKRTAAGIMKNPTVDGITVIDLEPIPYDPKFEKQLGQVMLLVLCVTQVLLMRTTWALCEALTLATGPITTLWEGNPGRFWNTTIAVSMANIFRGSYLAGAGLAFSLIKNXXXXXXXXXXQGETLGEKWKRQLNXXXXXXXXXYKKSGIQEVDRTEAKEGLKRGEXXHHAVSRGSAKLRWFVERNLVXPKGKVVDLGCGRGGWSYYCAGLKKVTEVKGYTKGGPGHEEPIPMATYGWNLVKLHSGVDVFYXPPEKCDTLLCDIGESSSNPTIEEGRTLRVLKMVEPWLXXXXQFCIKVLNPYMPTVIEXXXXXXXXXGGMLVRNPLSRNSTHEMYWVSNASGNIVSSVNMISRMLINRFTMXXXXATYEKDVDLGAGTRSVSTEXXXPDMDIIGKRIEKIXXXXXXSWHYDQENPYKTWAYHGSYETKQTGSASSMVNGVVKLLTKPWDVIPMVTQMAMTDTTPFGQQRVFKEKVDTRTPRXXXXXXXXXXXXXXXXXXXXXXXXXPRLCTREEFXXKVRSNAAIGAVFTDENKWKSAREAVXXXXXXXXXXXERALHQEGKCETCVYNMMGKREKKLGEFGKAKGSRAIWYMWLGARFLEFEALGFLNEDHWFSRENSLSGVEGEGLHKLGYILRXXXXXXGGAMYADDTAGWDTRITEDDLQNEXXXXXXXXXXXXXXXXAIFKLTYQNKVVKVLRPTPXGTVMDIISRKDQRGSGQVGTYGLNTFTNMEAQLIRQMEGEGVXXXXXXXXXXXXXXXXXXXXXXXXXXXXERLKRMAISGDDCVVKPIDDRFXXALTALNDMGKVRKDIPQWEPSKGWKDWQQVPFCSHHFHELIMKDGRXLVVPCRNQDELIGRARISQGAGWSLRETACLGKAYAQMWSLMYFHRRDLRLAANAICSAVPVXWVPTSRTTWSIHAHHQWMTTEDMLTVWNRVWIXENPWMEDKTXXXXXXDVPYLGKREDQWCGSLIGLTSRATWAKNIXXXXXXXXXXXXXXXXXDYMPSMKRFRXXXXXXXXXX

SEQ ID NO: 265863 - protein, 3403 aa, Dengue virus
  MOD_RES (1)..(10): Any amino acid
  MOD_RES (71)..(82): Any amino acid
  MOD_RES (93)..(114): Any amino acid
  MOD_RES (129)..(130): Any amino acid
  MOD_RES (143)..(145): Any amino acid
  MOD_RES (163)..(173): Any amino acid
  MOD_RES (195)..(197): Any amino acid
  MOD_RES (236)..(236): Any amino acid
  MOD_RES (248)..(280): Any amino acid
  MOD_RES (329)..(348): Any amino acid
  MOD_RES (361)..(375): Any amino acid
  MOD_RES (400)..(462): Any amino acid
  MOD_RES (480)..(483): Any amino acid
  MOD_RES (501)..(514): Any amino acid
  MOD_RES (553)..(557): Any amino acid
  MOD_RES (574)..(590): Any amino acid
  MOD_RES (602)..(644): Any amino acid
  MOD_RES (659)..(673): Any amino acid
  MOD_RES (709)..(719): Any amino acid
  MOD_RES (734)..(741): Any amino acid
  MOD_RES (753)..(784): Any amino acid
  MOD_RES (825)..(827): Any amino acid
  MOD_RES (847)..(887): Any amino acid
  MOD_RES (898)..(927): Any amino acid
  MOD_RES (947)..(953): Any amino acid
  MOD_RES (987)..(987): Any amino acid
  MOD_RES (999)..(999): Any amino acid
  MOD_RES (1021)..(1026): Any amino acid
  MOD_RES (1036)..(1036): Any amino acid
  MOD_RES (1053)..(1065): Any amino acid
  MOD_RES (1114)..(1218): Any amino acid
  MOD_RES (1233)..(1346): Any amino acid
  MOD_RES (1402)..(1409): Any amino acid
  MOD_RES (1420)..(1423): Any amino acid
  MOD_RES (1439)..(1439): Any amino acid
  MOD_RES (1455)..(1476): Any amino acid
  MOD_RES (1489)..(1506): Any amino acid
  MOD_RES (1518)..(1518): Any amino acid
  MOD_RES (1537)..(1537): Any amino acid
  MOD_RES (1562)..(1564): Any amino acid
  MOD_RES (1588)..(1595): Any amino acid
  MOD_RES (1618)..(1618): Any amino acid
  MOD_RES (1646)..(1659): Any amino acid
  MOD_RES (1799)..(1799): Any amino acid
  MOD_RES (1826)..(1830): Any amino acid
  MOD_RES (1875)..(1875): Any amino acid
  MOD_RES (1943)..(1943): Any amino acid
  MOD_RES (2035)..(2044): Any amino acid
  MOD_RES (2096)..(2099): Any amino acid
  MOD_RES (2110)..(2116): Any amino acid
  MOD_RES (2131)..(2134): Any amino acid
  MOD_RES (2163)..(2194): Any amino acid
  MOD_RES (2238)..(2245): Any amino acid
  MOD_RES (2260)..(2277): Any amino acid
  MOD_RES (2362)..(2365): Any amino acid
  MOD_RES (2375)..(2378): Any amino acid
  MOD_RES (2493)..(2502): Any amino acid
  MOD_RES (2517)..(2525): Any amino acid
  MOD_RES (2548)..(2549): Any amino acid
  MOD_RES (2570)..(2570): Any amino acid
  MOD_RES (2633)..(2633): Any amino acid
  MOD_RES (2671)..(2674): Any amino acid
  MOD_RES (2691)..(2699): Any amino acid
  MOD_RES (2744)..(2747): Any amino acid
  MOD_RES (2767)..(2769): Any amino acid
  MOD_RES (2783)..(2788): Any amino acid
  MOD_RES (2848)..(2853): Any amino acid
  MOD_RES (2864)..(2888): Any amino acid
  MOD_RES (2898)..(2899): Any amino acid
  MOD_RES (2925)..(2935): Any amino acid
  MOD_RES (2956)..(2956): Any amino acid
  MOD_RES (3019)..(3024): Any amino acid
  MOD_RES (3049)..(3064): Any amino acid
  MOD_RES (3084)..(3084): Any amino acid
  MOD_RES (3127)..(3154): Any amino acid
  MOD_RES (3177)..(3178): Any amino acid
  MOD_RES (3225)..(3225): Any amino acid
  MOD_RES (3288)..(3288): Any amino acid
  MOD_RES (3321)..(3321): Any amino acid
  MOD_RES (3331)..(3336): Any amino acid
  MOD_RES (3366)..(3382): Any amino acid
  MOD_RES (3393)..(3402): Any amino acid
XXXXXXXXXXPSFNMLKRARNRVSTPQGLVKRFSTGLLNGKGPLRMVLAFITFLRVLSIPPTAGVLARWGXXXXXXXXXXXXGFKKEISNMLXXXXXXXXXXXXXXXXXXXXXXFHLTSRDGEPRMIVXXNEKGKSLLFKTSXXXNKCTLMAIDLGEMCDDTXXXXXXXXXXXEPEDIDCWCNSTDTWVTYGTCXXXGEHRREKRSVALAPHVGMGLETRAQTWMSAEGAWRQVEXVESWILRNPGFXXXXXXXXXXXXXXXXXXXXXXXXXXXXXXXXXMRCIGIGNRDFVEGVSGGAWVDVVLEHGGCVTTMAQGKPTLDIELLKTXXXXXXXXXXXXXXXXXXXXTTATRCPTQGEPXXXXXXXXXXXXXXXYVDRGWGNGCGLFGKGGVVTCAKFXXXXXXXXXXXXXXXXXXXXXXXXXXXXXXXXXXXXXXXXXXXXXXXXXXXXXXXXXXXXXXXLDCEPRTGLDFNEMILLXXXXKAWMVHRQWFFDLPLPWXXXXXXXXXXXXXXELLVTFKNPHAKRQDVTVLGSQEGAMHSALTGATEIQMXXXXXMFAGHLKCRLKMDKLEXXXXXXXXXXXXXXXXXEVSETQHGTILXXXXXXXXXXXXXXXXXXXXXXXXXXXXXXXXXXXXXXXXXXXTNIELEPPFGESNIXXXXXXXXXXXXXXXKGSSIGQMFESTYRGAKRMAILGDTAWDFGSIGGVXXXXXXXXXXXFGSAYTALFSGVSWXXXXXXXXLLTWIGLNSKNXXXXXXXXXXXXXXXXXXXXXXXXXXXXXXXXGRELKCGSGIFITNNVHTWTEQYKFQPESPKRLSAAIGKAXXXGICGIRSTTRLENLMWKQIXXXXXXXXXXXXXXXXXXXXXXXXXXXXXXXXXXXXXXXXXYSWKSWGKAKXXXXXXXXXXXXXXXXXXXXXXXXXXXXXXLEVEDYGFGIFTTNIWMKFXXXXXXXCDSKLMSAAIKDQRAVHADMGYWIESEKNETWKXEKASFIEVKTCXWPKTHTLWSNGVLESDMIIPKXXXXXXSQHNYRQGYXTQTVGPWHLGKLEIDFXXXXXXXXXXXXXCGHRGPSLRTTTASGKLVTQWCCRSCTLPPLRYLGEDGCWYGMEIRPVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLFRRLTSREVLLLTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEGVMAVGLVSLLGSSLLKNDVPLAGPMVAGGLLLAAYVMTGRSADLELERXXXXXXXXMADITGSSPIXXXXVDDDGTMKIKDEERDXTITLLVKLALITVSGXXXXXXXXXXXXXXXXXXXXXXSGALWDVPSPAAXXXXXXXXXXXXXXXXXXLGKTQVGVGIHXEGTFHTMWHVTRGAVLMHXGKRIEPSWADVRNDLISYGGGWKLXXXWDKGEEVQVLALEPGKNPKHVQTXXXXXXXXEGEIGAVSLDFSPGTSGSPIVNXKGKVIGLYGNGVVTTSGTYVSAIAQTEXXXXXXXXXXXXXXFKKKNLTIMDLHPGAGKTKRILPSIVREAIKRGLRTLILAPTRVVASEMAEALKGLPIRYQTTAVKSEHTGKEIVDLMCHATFTTRLLSSTRVPNYNLIVMDEAHFTDPSSVAARGYISTRVEMGEAAGIFMTATPPGTXDPFPQSNAVIEDEEREIPERSWNSGHXXXXXYQGKTVWFVPSIKAGNDIAACLRKNGKRVIQLSRKTFDTEYPKTXNTDWDYVVTTDISEMGANFRAERVIDPRRCMKPVILTDGEERVILAGPIPVTPSSAAQRRGRVGRNPXQEDDQYVFMGEPLENDEDCAHWKEAKMLLDNINTPEGIIPTMFEPEREKVQAIDGEFRLRGEQRKTFVDLMKRGDLPVWLAHKVASEGFQYXXXXXXXXXXRNNQVLEENMEVEIWTKEGEKKKLKPRWLDARIYADPMALKDFKEFASGRKXXXXDLILEIGKLPXXXXXXXQLALDNLAVLHTAEXXXXAYNHALNELPESLETLMLVALIAVLTGGXXXXXXXXXXXXXXXXXXXXXXXXXXXXXXXXIQPQWIASSIILEFFLIVLLIPEPDRQRTPQDNQLAYVVIGLLXXXXXXXXNEMGLIEKTKTDFGXXXXXXXXXXXXXXXXXXLDVDLHPASAWTLYAVATTIITPMLRHTIENTSANLSLAAIANQAAILMGLGKGWPLHRMDIGVPLLAIGCYSQVNPITLTAALXXXXVHYAIIGPGXXXXATREAQKRAAAGIMKNPTVDGIVAIDLDPISYDAKFEKQLGQIMLLILCTGQLLMMRTTWALCESITLATGPLSTLWEGSPGKFWNTTIAVSTANIFRGSYLAGAGLLFSIMKNXXXXXXXXXXTGETLGEKWKSRLNXXXXXXXXXYKRSGILEVDRTLAKEGIKRGEXXKHAVSRGSSKIRWFVERNMVXPEGKVIDLGCGRGGWSYYMATLKNVREVKGLTKGGPGHEEPIPMSTYGWNLVRLQSGVDVFFXPTEQVDTLLCDIGESSPSPTVEAGRTLRVLNLVENWLXXXXEFCIKVLNPYMPSVIEXXXXXXXXXGGALVRCPLSRNSTHEMYWVSCGTGNIVSAVNMTSKMLLNRFTTXXXXPTYEPDVDLGSGTRNIGIEXXXPNLTIIGRRLQRLXXXXXXTWHYDQDNPYRTWAYHGSYEAPSSGSASSMVNGVVRLLTKPWDVVPMVTQLAMTDTTPFXXXXXXKEKVDTRTPQXXXXXXXXXXXXXXXXXXXXXXXXXPRICTREEFXXKVRSNAALGAIFQEEQGWTSASEAVXXXXXXXXXXXERNLHLEGKCESCVYNMMGKXEKKLGEFGRAKGSRAIWYMWLGARYLEFEALGFMNEDHWFGRENSWSGVEGEGLHRLGYILEXXXXXXGGNIYADDTAGWDTRITLEDLKNEXXXXXXXXXXXXXXXXSIFKLTYQNKVVRVQRPTPXGAVMDVISRRDQRGSGQVVTYSLNTFTNMEVQLIRQMEAEGVXXXXXXXXXXXXXXXXXXXXXXXXXXXXDRLSRMAISGDDCVVKPLDERFXXSLLFLNDMGKVRKDIPQWEPSKGWNDWTEVPFCSHHFHKIFMKDGRXIVVPCRNQDELVGRARVSQGAGWSLRETACLGKSYAQMWQLMYFHRRDLRLASMAICSAVPTXWFPTSRTTWSIHAKHEWMTTEDMLKVWNRVWIXDNPWMEDKTXXXXXXDIPYLGKREDLWCGSLIGLSSRATWAQNIXXXXXXXXXXXXXXXXXDYMTSMKRFKXXXXXXXXXXC

SEQ ID NO: 265864 - protein, 3402 aa, Dengue virus
  MOD_RES (1)..(10): Any amino acid
  MOD_RES (71)..(82): Any amino acid
  MOD_RES (93)..(114): Any amino acid
  MOD_RES (129)..(130): Any amino acid
  MOD_RES (143)..(145): Any amino acid
  MOD_RES (163)..(175): Any amino acid
  MOD_RES (195)..(197): Any amino acid
  MOD_RES (236)..(236): Any amino acid
  MOD_RES (248)..(280): Any amino acid
  MOD_RES (329)..(348): Any amino acid
  MOD_RES (361)..(375): Any amino acid
  MOD_RES (400)..(462): Any amino acid
  MOD_RES (480)..(483): Any amino acid
  MOD_RES (501)..(514): Any amino acid
  MOD_RES (553)..(557): Any amino acid
  MOD_RES (574)..(590): Any amino acid
  MOD_RES (602)..(644): Any amino acid
  MOD_RES (659)..(673): Any amino acid
  MOD_RES (709)..(719): Any amino acid
  MOD_RES (734)..(741): Any amino acid
  MOD_RES (753)..(784): Any amino acid
  MOD_RES (825)..(827): Any amino acid
  MOD_RES (847)..(887): Any amino acid
  MOD_RES (898)..(927): Any amino acid
  MOD_RES (947)..(954): Any amino acid
  MOD_RES (987)..(987): Any amino acid
  MOD_RES (999)..(999): Any amino acid
  MOD_RES (1021)..(1026): Any amino acid
  MOD_RES (1036)..(1036): Any amino acid
  MOD_RES (1053)..(1065): Any amino acid
  MOD_RES (1114)..(1218): Any amino acid
  MOD_RES (1233)..(1346): Any amino acid
  MOD_RES (1402)..(1409): Any amino acid
  MOD_RES (1420)..(1423): Any amino acid
  MOD_RES (1439)..(1439): Any amino acid
  MOD_RES (1455)..(1476): Any amino acid
  MOD_RES (1489)..(1506): Any amino acid
  MOD_RES (1518)..(1518): Any amino acid
  MOD_RES (1537)..(1537): Any amino acid
  MOD_RES (1562)..(1564): Any amino acid
  MOD_RES (1588)..(1595): Any amino acid
  MOD_RES (1618)..(1618): Any amino acid
  MOD_RES (1646)..(1659): Any amino acid
  MOD_RES (1701)..(1704): Any amino acid
  MOD_RES (1735)..(1741): Any amino acid
  MOD_RES (1778)..(1779): Any amino acid
  MOD_RES (1799)..(1799): Any amino acid
  MOD_RES (1826)..(1830): Any amino acid
  MOD_RES (1875)..(1875): Any amino acid
  MOD_RES (1886)..(1888): Any amino acid
  MOD_RES (1943)..(1943): Any amino acid
  MOD_RES (1966)..(1975): Any amino acid
  MOD_RES (2035)..(2044): Any amino acid
  MOD_RES (2096)..(2099): Any amino acid
  MOD_RES (2110)..(2116): Any amino acid
  MOD_RES (2131)..(2134): Any amino acid
  MOD_RES (2163)..(2194): Any amino acid
  MOD_RES (2220)..(2222): Any amino acid
  MOD_RES (2238)..(2245): Any amino acid
  MOD_RES (2260)..(2277): Any amino acid
  MOD_RES (2362)..(2365): Any amino acid
  MOD_RES (2375)..(2392): Any amino acid
  MOD_RES (2467)..(2480): Any amino acid
  MOD_RES (2493)..(2502): Any amino acid
  MOD_RES (2517)..(2525): Any amino acid
  MOD_RES (2548)..(2549): Any amino acid
  MOD_RES (2570)..(2570): Any amino acid
  MOD_RES (2633)..(2633): Any amino acid
  MOD_RES (2671)..(2674): Any amino acid
  MOD_RES (2691)..(2699): Any amino acid
  MOD_RES (2711)..(2712): Any amino acid
  MOD_RES (2744)..(2747): Any amino acid
  MOD_RES (2767)..(2769): Any amino acid
  MOD_RES (2783)..(2788): Any amino acid
  MOD_RES (2848)..(2854): Any amino acid
  MOD_RES (2864)..(2888): Any amino acid
  MOD_RES (2898)..(2899): Any amino acid
  MOD_RES (2925)..(2935): Any amino acid
  MOD_RES (2955)..(2988): Any amino acid
  MOD_RES (3019)..(3024): Any amino acid
  MOD_RES (3049)..(3070): Any amino acid
  MOD_RES (3084)..(3084): Any amino acid
  MOD_RES (3099)..(3109): Any amino acid
  MOD_RES (3127)..(3154): Any amino acid
  MOD_RES (3177)..(3178): Any amino acid
  MOD_RES (3225)..(3225): Any amino acid
  MOD_RES (3241)..(3250): Any amino acid
  MOD_RES (3288)..(3288): Any amino acid
  MOD_RES (3321)..(3321): Any amino acid
  MOD_RES (3331)..(3336): Any amino acid
  MOD_RES (3346)..(3348): Any amino acid
  MOD_RES (3366)..(3382): Any amino acid
  MOD_RES (3393)..(3402): Any amino acid
XXXXXXXXXXPSINMLKRVRNRVSTVQQLTKRFSLGLLSGRGPLKLFMALVAFLRFLAIPPTAGILARWGXXXXXXXXXXXXGFKKEISSMLXXXXXXXXXXXXXXXXXXXXXXFHLTTRGGEPHMIVXXQERGKSLLFKTEXXXNMCTLMAMDLGEMCEDTXXXXXXXXXXXXXDDVDCWCNATSTWVMYGTCXXXGERRREKRSVALAPHVGLGLDTRTQTWMSSEGAWKQIQXIETWILRHPGFXXXXXXXXXXXXXXXXXXXXXXXXXXXXXXXXXMRCVGISSRDFVEGVSGGSWVDLVLEHGGCVTTMAKNKPTLDIELQKTXXXXXXXXXXXXXXXXXXXXTTESRCPTQGEPXXXXXXXXXXXXXXXMVDRGWGNGCGLFGKGGIVTCAMFXXXXXXXXXXXXXXXXXXXXXXXXXXXXXXXXXXXXXXXXXXXXXXXXXXXXXXXXXXXXXXXLDCSPRSGIDFNEMILMXXXXKTWLVHRQWFLNLPLPWXXXXXXXXXXXXXXERMVTFKVPHAKKQDVVVLGSQEGAMHSALAGATEVDSXXXXXLFTGHLKCKVRMEKLRXXXXXXXXXXXXXXXXXEMAETQHGTTVXXXXXXXXXXXXXXXXXXXXXXXXXXXXXXXXXXXXXXXXXXXVNIEAEPPFGESYIXXXXXXXXXXXXXXXKGSTIGKMFETTMRGAKRMAILGETAWDFGSVGGLXXXXXXXXXXXFGSVYTTMFGGVSWXXXXXXXXLVLWIGTNSRNXXXXXXXXXXXXXXXXXXXXXXXXXXXXXXXXNKELKCGSGIFVVDNVHTWTEQYKFQPESPARLASAILNAXXXGVCGIRSTTRLENVMWKQIXXXXXXXXXXXXXXXXXXXXXXXXXXXXXXXXXXXXXXXXXYSWKAWGKAKXXXXXXXXXXXXXXXXXXXXXXXXXXXXXXFEVEDYGFGMFSTNIWLKLXXXXXXXXDHRLMSAAVKDERAVHADMGYWIESQKNGSWKXARASFIEVKSCXWPRSHTLWSNGVLESQMLIPKXXXXXXSQHNHRPGYXTQIMGPWHLGKLEMDFXXXXXXXXXXXXXCDTRGPSLRTTTVTGKIITEWCCRSCTLPPLRYMGEDGCWYGMEIRPIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLRKLTSRENLLLGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEAIMAVGLVSILLSSLLRNDVPLAGPLIAGGMLIACYVITGTSADLTVEKXXXXXXXXEAEQTGVSHNXXXXISEDGSFSIRDVEETXTLTILLKATLLAVSGXXXXXXXXXXXXXXXXXXXXXXSGVLWDTPSPPEXXXXXXXXXXXXXXXXXXLGRSQVGVGVFXENVFHTMWHVTRGAVLMYXTKRLEPSWADVKKDMISYGGGWRFXXXWNTEEDVQVLAIEPGKNPKNVQTXXXXXXXXTGEVGAVTLDFKPGTSGSPIVDXEGKIVGLYGNGVVTRSGAYVSAIAQAKXXXXXXXXXXXXXXFRKRRLTIMDLHPGSGKTRKYLPAIIREAIKRKLRTLILAPXXXXAAEMEEALKGMPIRYQTPAIRAEHTGREIVXXXXXXXFTMRLLSPVRVPNYNMVIMDEAHFTDPSSIAARGYIXXRVEMGEAAAIFMTATPPGAXEAFPQSNAPIMDIEKEIPERSWNSGYXXXXXFPGKTVWFVPSIKSGNDIANCLRKSGKKVIQLSRKTFDSEYVKTXLNDWDYVVTTXXXEMGANFKAGRVIDPRRCLKPVILKDGEERVVLAGPMPVTHSSAAQRRGRIGRNHXKENDQYIYSGDPLKNDEDHAHWXXXXXXXXXXYTPEGIIPSLFGPEREKTDAIDGEYRLKGEARKTFVELMKRGDLPVWLAYKVASEGIKYXXXXXXXXXXKNNQILEENVEVEIWTREGERKKLRPRWLDARTYSDPLALREFKEFAAGRRXXXXDLVTEIGRVPXXXXXXXRDALDNLVMLHNSEXXXXAYRHAMEELPDTIETLMLLTLLATVTGGXXXXXXXXXXXXXXXXXXXXXXXXXXXXXXXXVELQWIASAIVLEFFMMVLLIPEPDXXXTPQDNQLIYVILTILXXXXXXXXNEMGLLEKTKKDLGXXXXXXXXXXXXXXXXXXLDIDLRPASAWTLYAVATTFITPMMRHTIENTTANISLTAIANQATVLMGLGKGWPISKVDIGVPLLAMGCYSQVNPTTLTASLXXXXTHYAIIGPGXXXXXXXXXXXXXXXXXXKNPTVDGIMTIDLDPVVYDSKFEKQLGQVMLLILCASQILLMRTSWAFCEVLTLATGPILTLWEGNPGKFWNTTXXXXXXXXXXXXXXAGAGLAFSLMKSXXXXXXXXXXIGETLGEKWKKKLNXXXXXXXXXYKRSGIMEVDRSEAKSALKDGSXXKHAVSRGTAKLQWFVERNMVXPEGRVIDLGCGRGGWSYYCGGLKNVTEVRGFTKGGPGHEEPVPMSTYGWNIVKLHSGKDVFFXPPERCDTLLCDIGESSPNPTIEESRTIRVLSLVENWLXXXXQFCVKILNPYMPSVVEXXXXXXXXXGGNLVRCPLSRXXTHEMYWVSGATGNIVSSVNMVSRMLLNRFTMXXXXPTYERDVDLGAGTRHVAVEXXXANLDIIGQRIENIXXXXXXTWHYDEDHPYKTWAYHGSYEVKPTGSASSMINGVVKLLTKPWDVLPMVTQIAMTDTTPFXXXXXXXEKVDTRTQEXXXXXXXXXXXXXXXXXXXXXXXXXPRMCTREEFXXKVRTNAAIGAVFVDENQWNSAKEAVXXXXXXXXXXXERELHKQGKCATCVYNMMGXXXXXXXXXXXXXXXXXXXXXXXXXXXXXXXXXXFLNEDHWFSRENSYSGVEGEGLHRLGYILRXXXXXXGDLMYADDTAGWDTRITEDDLHNEXXXXXXXXXXXXXXXXXXXXXXYQNKVVRVQRPAKXGTVMDIISRRDQRGXXXXXXXXXXXFTNMEAQLIRQMESEGIXXXXXXXXXXXXXXXXXXXXXXXXXXXXERLRRMAISGDDCVVKPLDDRFXXALLALNDMGKVRKDIQQWQPSKGWNNWQEVPFCSHHFHQLIMKDGRXLVVPCRPQDELIGRAXXXXXXXXXXKETACLGKSYAQMWTLMYFHRRDLRLASNAICSAVPSXWIPTSRTTWSIHATHEWMTTEDMLSVWNRVWIXDNPNMIDKTXXXXXXEVPYLGKREXXXCGSLIGLTARATWATNIXXXXXXXXXXXXXXXXXDYMPVMKRYSXXXXXXXXXX

SEQ ID NO: 265865 - protein, 3402 aa, Dengue virus
  MOD_RES (1)..(10): Any amino acid
  MOD_RES (55)..(56): Any amino acid
  MOD_RES (71)..(82): Any amino acid
  MOD_RES (93)..(114): Any amino acid
  MOD_RES (129)..(130): Any amino acid
  MOD_RES (143)..(145): Any amino acid
  MOD_RES (163)..(175): Any amino acid
  MOD_RES (195)..(197): Any amino acid
  MOD_RES (236)..(236): Any amino acid
  MOD_RES (248)..(280): Any amino acid
  MOD_RES (329)..(348): Any amino acid
  MOD_RES (360)..(375): Any amino acid
  MOD_RES (385)..(385): Any amino acid
  MOD_RES (400)..(462): Any amino acid
  MOD_RES (479)..(483): Any amino acid
  MOD_RES (499)..(514): Any amino acid
  MOD_RES (536)..(543): Any amino acid
  MOD_RES (553)..(557): Any amino acid
  MOD_RES (574)..(590): Any amino acid
  MOD_RES (602)..(644): Any amino acid
  MOD_RES (659)..(673): Any amino acid
  MOD_RES (692)..(696): Any amino acid
  MOD_RES (709)..(719): Any amino acid
  MOD_RES (734)..(741): Any amino acid
  MOD_RES (753)..(784): Any amino acid
  MOD_RES (825)..(827): Any amino acid
  MOD_RES (847)..(887): Any amino acid
  MOD_RES (898)..(930): Any amino acid
  MOD_RES (947)..(954): Any amino acid
  MOD_RES (987)..(987): Any amino acid
  MOD_RES (999)..(1008): Any amino acid
  MOD_RES (1021)..(1026): Any amino acid
  MOD_RES (1036)..(1036): Any amino acid
  MOD_RES (1053)..(1065): Any amino acid
  MOD_RES (1108)..(1218): Any amino acid
  MOD_RES (1233)..(1346): Any amino acid
  MOD_RES (1402)..(1409): Any amino acid
  MOD_RES (1420)..(1423): Any amino acid
  MOD_RES (1439)..(1439): Any amino acid
  MOD_RES (1455)..(1476): Any amino acid
  MOD_RES (1489)..(1506): Any amino acid
  MOD_RES (1518)..(1518): Any amino acid
  MOD_RES (1537)..(1537): Any amino acid
  MOD_RES (1556)..(1564): Any amino acid
  MOD_RES (1576)..(1576): Any amino acid
  MOD_RES (1588)..(1595): Any amino acid
  MOD_RES (1608)..(1608): Any amino acid
  MOD_RES (1618)..(1618): Any amino acid
  MOD_RES (1646)..(1659): Any amino acid
  MOD_RES (1670)..(1671): Any amino acid
  MOD_RES (1700)..(1715): Any amino acid
  MOD_RES (1735)..(1748): Any amino acid
  MOD_RES (1778)..(1799): Any amino acid
  MOD_RES (1826)..(1830): Any amino acid
  MOD_RES (1841)..(1841): Any amino acid
  MOD_RES (1875)..(1875): Any amino acid
  MOD_RES (1885)..(1888): Any amino acid
  MOD_RES (1943)..(1943): Any amino acid
  MOD_RES (1966)..(1984): Any amino acid
  MOD_RES (2015)..(2017): Any amino acid
  MOD_RES (2035)..(2046): Any amino acid
  MOD_RES (2096)..(2099): Any amino acid
  MOD_RES (2110)..(2116): Any amino acid
  MOD_RES (2131)..(2134): Any amino acid
  MOD_RES (2163)..(2194): Any amino acid
  MOD_RES (2205)..(2206): Any amino acid
  MOD_RES (2216)..(2226): Any amino acid
  MOD_RES (2238)..(2247): Any amino acid
  MOD_RES (2260)..(2289): Any amino acid
  MOD_RES (2348)..(2349): Any amino acid
  MOD_RES (2362)..(2392): Any amino acid
  MOD_RES (2418)..(2419): Any amino acid
  MOD_RES (2461)..(2481): Any amino acid
  MOD_RES (2493)..(2502): Any amino acid
  MOD_RES (2517)..(2525): Any amino acid
  MOD_RES (2548)..(2549): Any amino acid
  MOD_RES (2570)..(2570): Any amino acid
  MOD_RES (2581)..(2585): Any amino acid
  MOD_RES (2608)..(2614): Any amino acid
  MOD_RES (2633)..(2645): Any amino acid
  MOD_RES (2669)..(2674): Any amino acid
  MOD_RES (2691)..(2699): Any amino acid
  MOD_RES (2711)..(2712): Any amino acid
  MOD_RES (2744)..(2747): Any amino acid
  MOD_RES (2767)..(2769): Any amino acid
  MOD_RES (2783)..(2788): Any amino acid
  MOD_RES (2820)..(2826): Any amino acid
  MOD_RES (2844)..(2854): Any amino acid
  MOD_RES (2864)..(2888): Any amino acid
  MOD_RES (2898)..(2901): Any amino acid
  MOD_RES (2925)..(2935): Any amino acid
  MOD_RES (2955)..(2997): Any amino acid
  MOD_RES (3008)..(3024): Any amino acid
  MOD_RES (3036)..(3039): Any amino acid
  MOD_RES (3049)..(3073): Any amino acid
  MOD_RES (3084)..(3085): Any amino acid
  MOD_RES (3095)..(3114): Any amino acid
  MOD_RES (3127)..(3154): Any amino acid
  MOD_RES (3164)..(3165): Any amino acid
  MOD_RES (3177)..(3178): Any amino acid
  MOD_RES (3225)..(3250): Any amino acid
  MOD_RES (3274)..(3278): Any amino acid
  MOD_RES (3288)..(3293): Any amino acid
  MOD_RES (3321)..(3321): Any amino acid
  MOD_RES (3331)..(3336): Any amino acid
  MOD_RES (3346)..(3354): Any amino acid
  MOD_RES (3366)..(3382): Any amino acid
  MOD_RES (3393)..(3402): Any amino acid
XXXXXXXXXXTPFNMLKRERNRVSTVSQLAKRFSRGMLQGQGPMKMVMAFIAFLXXLTIPPTAGILARWSXXXXXXXXXXXXGFKKEVSNMLXXXXXXXXXXXXXXXXXXXXXXFHLSTRDGEPLMIVXXHERGRPLLFKTTXXXNMCTLMALDLGEFCEDTXXXXXXXXXXXXXDDVDCWCNATSAWVMYGTCXXXGERRREKRSVALTPHSGMGLDTRAQTWMSSEGAWKHVQXVETWAFRHPGFXXXXXXXXXXXXXXXXXXXXXXXXXXXXXXXXXMRCVGIGSRDFVEGVSGGTWVDIVLEHGGCVTTMAKDKPTLDFELTKTXXXXXXXXXXXXXXXXXXXXTTASRCPTQGEXXXXXXXXXXXXXXXXVVDRGWGNGXGLFGKGSLITCAKFXXXXXXXXXXXXXXXXXXXXXXXXXXXXXXXXXXXXXXXXXXXXXXXXXXXXXXXXXXXXXXXMECSPRTSLDFNEMVLXXXXXKAWLVHKQWFLNLPLXXXXXXXXXXXXXXXXETLVTFKNPHAKRQDVVVLGSXXXXXXXXLTGATEIQNXXXXXLFMGHLKCRLRMDKLQXXXXXXXXXXXXXXXXXEIAETQHGTIVXXXXXXXXXXXXXXXXXXXXXXXXXXXXXXXXXXXXXXXXXXXINIETEPPSGESYIXXXXXXXXXXXXXXXRGSSIGKMLEATAKGARRXXXXXDTAWDFGSLGGVXXXXXXXXXXXFGAIYGAAFSGVSWXXXXXXXXIITWIGMNSRSXXXXXXXXXXXXXXXXXXXXXXXXXXXXXXXXGKELKCGSGIFVIDNVHTRTEQYQFQADSPKRLATAIAGAXXXGVCGIRSATRMENLLWKQIXXXXXXXXXXXXXXXXXXXXXXXXXXXXXXXXXXXXXXXXXYSWKTWGKARXXXXXXXXXXXXXXXXXXXXXXXXXXXXXXXXXEDYGFGVFTTNIWLRLXXXXXXXXDSKLMSAAVKDNRAVHADMGYWIESALNDTWKXERASFIEVKNCXXXXXXXXXXNGVLESQMLIPRXXXXXXSQHNNRPGYXTQTAGPWHLGRLEMDFXXXXXXXXXXXXXCGHRGSSLRTTTVSGKLIHEWCCRSCTLPPLRFKGEDGCWYGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFLRKLTSKELMMATXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEGIMAIGIVSILASSLLRNDVPMAGPLVAGGLLIACYVITGRSADLELEKXXXXXXXXEAEHSGASHNXXXXVDDDGTMRIKDDETEXILTVLLKTALLIVSGXXXXXXXXXXXXXXXXXXXXXXSGVLWDVPSPPEXXXXXXXXXXXXXXXXXXFGKTQVGVGVQXDGVFHTMWHVTRGAVLTYXGKRLEPNWANVKKDLISYXXXXXXXXXWQKGEEVQVIAXEPGKNPKNFQTXXXXXXXXTGEIGAIALDFKXGTSGSPIIDXEGKVVGLYGNGVVTKNGGYVSGIAQTNXXXXXXXXXXXXXXFRKRRLTIMDXXPGSGKTRKYLPAIVREAIKRKLRTLVLAXXXXXXXXXXXXXXXXPIRYQTTATKTEHTGREIVXXXXXXXXXXXXXXPIRVPNYNLVIMDEAHFTDPCSVAARGYIXXXXXXXXXXXXXXXXXXXXXXDAFPQSNAPIIDEEREIPERSWNSGNXXXXXFAGKTVWFVPXIKTGNDIAACLRKSGKRVIQLSRKTFDSEYIKTXTNDWDFVVTXXXXEMGANFKAERVIDPRRCLKPVILPDGPERVILAGPMPVTAASAAQRRGRIGRNQXKEGDQYIFTGDPLRNDEDHAHWXXXXXXXXXXXXXXXXXXXLFGPEREKSAAVDGEYRLRGESRKTFVELMXXXDLPVWLAYKVAAEGINYXXXXXXXXXXXXNQILEENMEVEIWTKEGEKKKLRPKWLDARTYSDPLALKEFKDFAAGRKXXXXDILTEIASLPXXXXXXXRNALDNLVMLHTSEXXXXAYRHAVEELPETMETLLLLGLMILLTGGXXXXXXXXXXXXXXXXXXXXXXXXXXXXXXXXIPLQWIASAIXXEFFLMVLLVXXXXXXXXXXXNQLAYVVIGILXXXXXXXXXXMGLLETTKRDLGXXXXXXXXXXXXXXXXXXXXXXXXXXXXXXLYAVATTIVTPMLRHTIENSTANVSLAAIANQAVVLMGLGRGWPIHRVDLGVPLLALGXXSQVNPLTLIAAVXXXXXXXXXXXXXXXXXXXXXXXXXXXXXXXKNPTIDGITVIDLEPVIYDSKFEKQXXQVMLLVLCAVQLLLMRTSWALCEVLTLATGPVMTLWEGNPGXXXXXXXXXXXXXXXXXXXXXGAGLAFSIMKSXXXXXXXXXXMGETLGEKWKNRLNXXXXXXXXXYKKSGITEVDRTEAKSALRDGSXXRHAVSRGSAKLRWIVERGMVXPEGRVIDLGCXXXXXSYYCGGLKNVKEVRGFTKGGPGXXXXXXXSTYGWNLVKLMSGKDVFYXXXXXXXXXXXXXGESSPNPTVEAGRTLRVLSLVENXXXXXXQFCVKVLNPYMPAVIEXXXXXXXXXGGSLVRCPLSRXXTHEMYWISNGTGNIVASVNTTSRLLLNRFTMXXXXPTIERDVDLGAGTRHVNAEXXXPNMDVIGERIKRIXXXXXXTWHYDDENPYKTWAYHGSYEVKATGSASSMIXXXXXXXTKPWDVVPTVTQMAMTDXXXXXXXXXXXEKVDTRTPKXXXXXXXXXXXXXXXXXXXXXXXXXPRLCTKEEFXXXXRSNAAMGAVFTEENQWDSAKAAVXXXXXXXXXXXERELHKLGKCGSCVYNMMGXXXXXXXXXXXXXXXXXXXXXXXXXXXXXXXXXXXXXXXXXXXRGNSLSGVEGXXXXXXXXXXXXXXXXXGDLIYADDTAGXXXXITEDDLLNEXXXXXXXXXXXXXXXXXXXXXXXXXKVVKVQRPTPXXTVMDIISRRXXXXXXXXXXXXXXXXXXXXAQLIRQMEGEGIXXXXXXXXXXXXXXXXXXXXXXXXXXXXERLRRMAISXXDCVVKPTDDRFXXALIALNDMGKIRKDIQQWEPSRGWHDWQQVPFCSHHFHELVMKDGRXXXXXXXXXXXXXXXXXXXXXXXXXXKETACLGKSYAQMWALMYFHRRDXXXXXNAICSAVPPXXXXXXRTTWSIHASHEWMTTEDMLAVWNRVWIXDNPNMTDKTXXXXXXNVPYLGKREXXXXXXXXXLTARATWASNIXXXXXXXXXXXXXXXXXDYMPAMKRYSXXXXXXXXXX

SEQ ID NO: 265866 - protein, 3402 aa, Dengue virus
  MOD_RES (1)..(19): Any amino acid
  MOD_RES (54)..(82): Any amino acid
  MOD_RES (93)..(114): Any amino acid
  MOD_RES (125)..(133): Any amino acid
  MOD_RES (143)..(146): Any amino acid
  MOD_RES (156)..(177): Any amino acid
  MOD_RES (195)..(206): Any amino acid
  MOD_RES (221)..(225): Any amino acid
  MOD_RES (236)..(236): Any amino acid
  MOD_RES (248)..(280): Any amino acid
  MOD_RES (293)..(307): Any amino acid
  MOD_RES (326)..(375): Any amino acid
  MOD_RES (385)..(385): Any amino acid
  MOD_RES (400)..(462): Any amino acid
  MOD_RES (472)..(486): Any amino acid
  MOD_RES (496)..(519): Any amino acid
  MOD_RES (534)..(543): Any amino acid
  MOD_RES (553)..(557): Any amino acid
  MOD_RES (574)..(590): Any amino acid
  MOD_RES (602)..(644): Any amino acid
  MOD_RES (659)..(673): Any amino acid
  MOD_RES (684)..(719): Any amino acid
  MOD_RES (734)..(741): Any amino acid
  MOD_RES (753)..(784): Any amino acid
  MOD_RES (806)..(806): Any amino acid
  MOD_RES (825)..(832): Any amino acid
  MOD_RES (847)..(888): Any amino acid
  MOD_RES (898)..(936): Any amino acid
  MOD_RES (947)..(963): Any amino acid
  MOD_RES (987)..(987): Any amino acid
  MOD_RES (999)..(1011): Any amino acid
  MOD_RES (1021)..(1036): Any amino acid
  MOD_RES (1047)..(1065): Any amino acid
  MOD_RES (1076)..(1090): Any amino acid
  MOD_RES (1107)..(1218): Any amino acid
  MOD_RES (1233)..(1348): Any amino acid
  MOD_RES (1373)..(1392): Any amino acid
  MOD_RES (1402)..(1409): Any amino acid
  MOD_RES (1420)..(1423): Any amino acid
  MOD_RES (1439)..(1439): Any amino acid
  MOD_RES (1455)..(1479): Any amino acid
  MOD_RES (1489)..(1506): Any amino acid
  MOD_RES (1518)..(1527): Any amino acid
  MOD_RES (1537)..(1540): Any amino acid
  MOD_RES (1553)..(1564): Any amino acid
  MOD_RES (1576)..(1595): Any amino acid
  MOD_RES (1605)..(1627): Any amino acid
  MOD_RES (1646)..(1675): Any amino acid
  MOD_RES (1699)..(1715): Any amino acid
  MOD_RES (1734)..(1749): Any amino acid
  MOD_RES (1759)..(1799): Any amino acid
  MOD_RES (1819)..(1830): Any amino acid
  MOD_RES (1841)..(1863): Any amino acid
  MOD_RES (1875)..(1875): Any amino acid
  MOD_RES (1885)..(1888): Any amino acid
  MOD_RES (1904)..(1906): Any amino acid
  MOD_RES (1921)..(1933): Any amino acid
  MOD_RES (1943)..(1943): Any amino acid
  MOD_RES (1961)..(1987): Any amino acid
  MOD_RES (2002)..(2020): Any amino acid
  MOD_RES (2035)..(2099): Any amino acid
  MOD_RES (2110)..(2116): Any amino acid
  MOD_RES (2126)..(2134): Any amino acid
  MOD_RES (2145)..(2153): Any amino acid
  MOD_RES (2163)..(2194): Any amino acid
  MOD_RES (2204)..(2227): Any amino acid
  MOD_RES (2238)..(2247): Any amino acid
  MOD_RES (2260)..(2289): Any amino acid
  MOD_RES (2307)..(2321): Any amino acid
  MOD_RES (2332)..(2332): Any amino acid
  MOD_RES (2343)..(2351): Any amino acid
  MOD_RES (2362)..(2393): Any amino acid
  MOD_RES (2415)..(2425): Any amino acid
  MOD_RES (2452)..(2525): Any amino acid
  MOD_RES (2537)..(2537): Any amino acid
  MOD_RES (2548)..(2549): Any amino acid
  MOD_RES (2570)..(2570): Any amino acid
  MOD_RES (2581)..(2587): Any amino acid
  MOD_RES (2599)..(2616): Any amino acid
  MOD_RES (2633)..(2647): Any amino acid
  MOD_RES (2659)..(2713): Any amino acid
  MOD_RES (2723)..(2728): Any amino acid
  MOD_RES (2742)..(2747): Any amino acid
  MOD_RES (2767)..(2769): Any amino acid
  MOD_RES (2783)..(2790): Any amino acid
  MOD_RES (2800)..(2828): Any amino acid
  MOD_RES (2839)..(2903): Any amino acid
  MOD_RES (2925)..(2935): Any amino acid
  MOD_RES (2951)..(2997): Any amino acid
  MOD_RES (3008)..(3039): Any amino acid
  MOD_RES (3049)..(3114): Any amino acid
  MOD_RES (3127)..(3167): Any amino acid
  MOD_RES (3177)..(3178): Any amino acid
  MOD_RES (3189)..(3194): Any amino acid
  MOD_RES (3212)..(3256): Any amino acid
  MOD_RES (3268)..(3278): Any amino acid
  MOD_RES (3288)..(3336): Any amino acid
  MOD_RES (3346)..(3354): Any amino acid
  MOD_RES (3365)..(3382): Any amino acid
  MOD_RES (3393)..(3402): Any amino acid
XXXXXXXXXXXXXXXXXXXRNRVSTIQGLVKRFSSGLLSGQGPLKLFMAFVAFXXXXXXXXXXXXXXXXXXXXXXXXXXXXXGFKREISNMLXXXXXXXXXXXXXXXXXXXXXXFSLSTRDGEPXXXXXXXXXGKSLLFKTKXXXXMCTLMALDLXXXXXXXXXXXXXXXXXXXXXXVDCWCNTTETWVTYGTCXXXXXXXXXXXXVALTPHSGTGLETRXXXXXSSEGAWRQIQXIETWVLRHPGFXXXXXXXXXXXXXXXXXXXXXXXXXXXXXXXXXMRCIGVGNRDFVXXXXXXXXXXXXXXXGSCVTTIAKSKPTLDIELXXXXXXXXXXXXXXXXXXXXXXXXXXXXXXXXXXXXXXXXXXXXXXXXXXLVDRGWGNGXGLFGKGSLLTCAKFXXXXXXXXXXXXXXXXXXXXXXXXXXXXXXXXXXXXXXXXXXXXXXXXXXXXXXXXXXXXXXXMECSPRTSLXXXXXXXXXXXXXXXMVHRQWFLDXXXXXXXXXXXXXXXXXXXXXXXXFKNPHAKKQEVAVLXXXXXXXXXXLTGATEVDSXXXXXMYAGHLKCKVRMERLRXXXXXXXXXXXXXXXXXELAETQHGTILXXXXXXXXXXXXXXXXXXXXXXXXXXXXXXXXXXXXXXXXXXXVNIEAEPPFGDSYVXXXXXXXXXXXXXXXKGSSIGQMIEXXXXXXXXXXXXXXXXXXXXXXXXXXXXXXXXXXXXFGAAYTALFGGVSWXXXXXXXXVITWLGLNSRNXXXXXXXXXXXXXXXXXXXXXXXXXXXXXXXXSKELKCGNGIFVADNVHTWTEXYKFQPESPARVASAILNAXXXXXXXXRSTTRMENLLWKQVXXXXXXXXXXXXXXXXXXXXXXXXXXXXXXXXXXXXXXXXXXSWKIWGKAKXXXXXXXXXXXXXXXXXXXXXXXXXXXXXXXXXXXXXXXVFTTSIWMKFXXXXXXXXXXXXXXXXXKDDRAVHADMGYWIESRLNDTWKXEKASFIEIKSCXXXXXXXXXXXXXLESEMVIPKXXXXXXXXXXXXXXXXTQAAGPWHLGXXXXXXXXXXXXXXXXXXXCGHRGSSLRTXXXXXXXXXXXXXXXCTLPPLRFKGEDGCWYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFLRRLTSKELMMTTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPLNEAVMAVGVVSILASSFLRNDVXXXXXXXXXXXXXXXXXXXXSSADLSLERXXXXXXXXEAEHSGTSHNXXXXIAEDGSFSIRDIEETXILTILLKATLLAISGXXXXXXXXXXXXXXXXXXXXXXXXXLWDVPSPATXXXXXXXXXXXXXXXXXXLGKTQVGVGVHXXXXXXXXXXVTRGAVLTHXXXXLEPNWANVKKDLXXXXXXXXXXXXWDREEDVQVLAXXXXXXXXXXXXXXXXXXXXAGTIGAVSLXXXXXXXXXXXXXXXXXXXXXXXNGVVTRSGTYVSSIAQTEXXXXXXXXXXXXXXXXXXXXXXXXXXXXXXKTRRYLPAMVREAIRRGLRTLILXXXXXXXXXXXXXXXXXPIRYQTTAIKAEHTGREIXXXXXXXXXXXXXXXXVRVPNYNLVXXXXXXXXXXXXXXXXXXXXXXXXXXXXXXXXXXXXXXXXXEAFPQSNAPIQDEEKDIPEXXXXXXXXXXXXFVGKTVWFVPXXXXXXXXXXXXXXXXXXXXXXXRKTFDSEYAKTXANDWDFVVTXXXXEMGANFRAERVIDPRXXXKPVISTDGEERVVLXXXXXXXXXXXXXRRGRIGRNLXKEGDQYVFSGDPLRNDEXXXXXXXXXXXXXXXXXXXXXXXXXXXPEREKNQAIDGEFRXXXXXXXXXXXXXXXXXXXVWLAYRVAAEGINYXXXXXXXXXXXXXXXXXXXXXXXXXXXXXXXXXXXXXXXXXXXXXXXXXXXXXXXXXXXXXXXXXDILTEIATLPXXXXXXXRNALDNLAVXXXXXXXXXAYTHALSELPXXXXXXXXXGLLATVTGGXXXXXXXXXXXXXXXXXXXXXXXXXXXXXXXXVPLQWIASAXXXXXXXXXXXXXXXXXXXXXXXXQLIYVILAILXXXXXXXXXXMGLLEKTKKDFGXXXXXXXXXXXXXXXXXXXXXXXXXXXXXXLYAVATTFITPMLRHSIXXXXXXXXXXXXXXXATVLMGLGRGXPLHRVDLGVPXXXXXXXXXVNPTTLIASLXXXXXXXXXXXXXXXXXXXXXXXXXXXXXXXXNPTVDGVTVIDLDPIPYDPKFXXXXXXXXXXXLCVGQLLLMRTSWAFCEALTLATGPVXXXXXXXXXXXXXXXXXXXXXXXXXXXXXXXXXXXXXXXXXXXXXXXXXXXXXXXXXXXXXXXXXXXXXXXXXXYKRSGIIEVDRXEAKEGLRRGEXXKYAVSRGTSKIRWIVERGMIXPEGKVMDLGCXXXXXXXYCGGLKDVREVXXXXXXXXXXXXXXXXXXYGWNLVKLYSGKDVFFXXXXXXXXXXXXXXXSSPNPTVEAGRXXXXXXXXXXXXXXXXXXXXXXXXXXXXXXXXXXXXXXXXXXXXXXXXXXXXXXXHEMYWVSGVXXXXXXSVNTISKMLLNRFXXXXXXPTYEKDADLGTGTRHVAVEXXXPNMDVIGERIRRIXXXXXXXXHYDHENPYRXXXXXXXXXXXXXXXXXXXXXXXXXXXXXPWDMIPMVTQXXXXXXXXXXXXXXXXXXXXXXXXXXXXXXXXXXXXXXXXXXXXXXXXXXXXXXXXXXXXXXXXXNAALGAVFTEENQWDSARAAVXXXXXXXXXXXERNLHLDGKCETCVYXXXXXXXXXXXXXXXXXXXXXXXXXXXXXXXXXXXXXXXXXXXXXXXRENSFSGVEGXXXXXXXXXXXXXXXXXXXXXXXXXXXXXXXXITIEDLKNEXXXXXXXXXXXXXXXXXXXXXXXXXXXXXXXXXXXXXXXXXXXXXXXXXXXXXXXXXXXXXXXXXXVQLVRQMEGEGVXXXXXXXXXXXXXXXXXXXXXXXXXXXXXXXXXXXXXXXXXVVKPVDDRFXXALFALNDMGKXXXXXXQWEPSKGWSDWTQVPFCXXXXXXXXXXXXXXXXXXXXXXXXXXXXXXXXXXXXXXXXXXXXXGKAYAQMWALMXXXXXXXXXXXNAICSAVPAXXXXXXXXXXXXXXXXXXXXXXXXXXXXXXXXXXXXXXXXXXXXXXXXXEIPYLGKREXXXXXXXXXLTARATWASNXXXXXXXXXXXXXXXXXXDYMPVMRRYSXXXXXXXXXX

SEQ ID NO: 265867 - protein, 3402 aa, Dengue virus
  MOD_RES (1)..(10): Any amino acid
  MOD_RES (26)..(27): Any amino acid
  MOD_RES (71)..(82): Any amino acid
  MOD_RES (93)..(114): Any amino acid
  MOD_RES (129)..(130): Any amino acid
  MOD_RES (143)..(145): Any amino acid
  MOD_RES (158)..(173): Any amino acid
  MOD_RES (195)..(197): Any amino acid
  MOD_RES (236)..(236): Any amino acid
  MOD_RES (248)..(280): Any amino acid
  MOD_RES (329)..(348): Any amino acid
  MOD_RES (361)..(375): Any amino acid
  MOD_RES (400)..(462): Any amino acid
  MOD_RES (480)..(483): Any amino acid
  MOD_RES (501)..(514): Any amino acid
  MOD_RES (552)..(558): Any amino acid
  MOD_RES (573)..(644): Any amino acid
  MOD_RES (657)..(682): Any amino acid
  MOD_RES (709)..(722): Any amino acid
  MOD_RES (734)..(741): Any amino acid
  MOD_RES (753)..(784): Any amino acid
  MOD_RES (824)..(827): Any amino acid
  MOD_RES (847)..(887): Any amino acid
  MOD_RES (898)..(927): Any amino acid
  MOD_RES (946)..(953): Any amino acid
  MOD_RES (983)..(999): Any amino acid
  MOD_RES (1021)..(1036): Any amino acid
  MOD_RES (1053)..(1066): Any amino acid
  MOD_RES (1114)..(1222): Any amino acid
  MOD_RES (1233)..(1346): Any amino acid
  MOD_RES (1402)..(1409): Any amino acid
  MOD_RES (1420)..(1424): Any amino acid
  MOD_RES (1439)..(1439): Any amino acid
  MOD_RES (1455)..(1476): Any amino acid
  MOD_RES (1489)..(1507): Any amino acid
  MOD_RES (1518)..(1518): Any amino acid
  MOD_RES (1537)..(1537): Any amino acid
  MOD_RES (1562)..(1564): Any amino acid
  MOD_RES (1588)..(1595): Any amino acid
  MOD_RES (1618)..(1618): Any amino acid
  MOD_RES (1645)..(1659): Any amino acid
  MOD_RES (1799)..(1799): Any amino acid
  MOD_RES (1826)..(1830): Any amino acid
  MOD_RES (1875)..(1875): Any amino acid
  MOD_RES (1943)..(1943): Any amino acid
  MOD_RES (2030)..(2044): Any amino acid
  MOD_RES (2096)..(2099): Any amino acid
  MOD_RES (2110)..(2116): Any amino acid
  MOD_RES (2131)..(2134): Any amino acid
  MOD_RES (2154)..(2194): Any amino acid
  MOD_RES (2238)..(2245): Any amino acid
  MOD_RES (2258)..(2277): Any amino acid
  MOD_RES (2362)..(2365): Any amino acid
  MOD_RES (2493)..(2502): Any amino acid
  MOD_RES (2517)..(2525): Any amino acid
  MOD_RES (2548)..(2549): Any amino acid
  MOD_RES (2570)..(2570): Any amino acid
  MOD_RES (2633)..(2633): Any amino acid
  MOD_RES (2671)..(2674): Any amino acid
  MOD_RES (2691)..(2699): Any amino acid
  MOD_RES (2744)..(2747): Any amino acid
  MOD_RES (2767)..(2769): Any amino acid
  MOD_RES (2783)..(2788): Any amino acid
  MOD_RES (2864)..(2899): Any amino acid
  MOD_RES (2925)..(2935): Any amino acid
  MOD_RES (3019)..(3024): Any amino acid
  MOD_RES (3046)..(3064): Any amino acid
  MOD_RES (3084)..(3084): Any amino acid
  MOD_RES (3127)..(3154): Any amino acid
  MOD_RES (3177)..(3178): Any amino acid
  MOD_RES (3225)..(3225): Any amino acid
  MOD_RES (3287)..(3288): Any amino acid
  MOD_RES (3321)..(3336): Any amino acid
  MOD_RES (3366)..(3382): Any amino acid
  MOD_RES (3393)..(3402): Any amino acid
XXXXXXXXXXPPFNMLKRERNRVSTXXQLAKRFSKGLFSGQGPMKLVMAFIAFLRFLAIPPTAGILKRWGXXXXXXXXXXXXGFRKEIGRMLXXXXXXXXXXXXXXXXXXXXXXFHLTTRNGEPHMIVXXQERGKSLLFKTAXXXNMCTLIAMDLGEXXXXXXXXXXXXXXXXEPEDIDCWCNLTSTWVTYGTCXXXGEHRRDKRSVALVPHVGMGLETRTETWMSSEGAWKHAQXVETWALRHPGFXXXXXXXXXXXXXXXXXXXXXXXXXXXXXXXXXMRCVGVGNRDFVEGLSGATWVDVVLEHGSCVTTMAKNKPTLDFELIKTXXXXXXXXXXXXXXXXXXXXTTDSRCPTQGEAXXXXXXXXXXXXXXXFVDRGWGNGCGLFGKGSLVTCAKFXXXXXXXXXXXXXXXXXXXXXXXXXXXXXXXXXXXXXXXXXXXXXXXXXXXXXXXXXXXXXXXLECSPRTGLDFNEMVLLXXXXKSWLVHKQWFLDLPLPWXXXXXXXXXXXXXXDLLVTFKTAHAKKQEVVVLGSQEGAMHTALTGATEIQXXXXXXXFAGHLKCRLKMDKLXXXXXXXXXXXXXXXXXXXXXXXXXXXXXXXXXXXXXXXXXXXXXXXXXXXXXXXXXXXXXXXXXXXXXXXXVNIEAEPPFGESXXXXXXXXXXXXXXXXXXXXXXXXXXEATARGARRMAILGDTAWDFGSVGGVXXXXXXXXXXXXXXAYGVLFSGVSWXXXXXXXXLLTWLGLNSRSXXXXXXXXXXXXXXXXXXXXXXXXXXXXXXXXGKELKCGSGIFVTNEVHTWTEQYKFQADSPSKLASAIQKXXXXGVCGIRSVTRLENIMWKQIXXXXXXXXXXXXXXXXXXXXXXXXXXXXXXXXXXXXXXXXXYSWKTWGKAKXXXXXXXXXXXXXXXXXXXXXXXXXXXXXXWEVEDYGFGVFTTNIWLKXXXXXXXXCDHRLMSAAIKDSKAVHADMGYWIESSKNXXXXXXXXXXXXXXXXXWPKSHTLWSNGVLESEMIIPKXXXXXXXXXXXXXXXXTQTAGPWHLGKLELDFXXXXXXXXXXXXXXGNRGPSLRTTTASGKLIHEWCCRSCTMPPLRFRGEDGCWYGMEIRPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTSRETALMVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEGIMAVGMVSILASALLKNDIPMTGPLVAGGLLTVCYVLSGSSADLSLEKXXXXXXXXQAEISGSSPIXXXXXQEDGSMSIKNEEEEXMLTILIRTGLLVISGXXXXXXXXXXXXXXXXXXXXXXAGVLWDVPSPPPXXXXXXXXXXXXXXXXXXXGYSQIGAGVYXEGVFHTMWHVTRGSVICHXGGRLEPSWASVKKDLISYGGGWRLXXXWKEGEEVQVIALEPGKNPRAVQTXXXXXXXXTGTIGAIALDFKPGTSGSPIINXKGKVVGLYGNGVVTKSGDYVSAITQAXXXXXXXXXXXXXXXFRKRRLTIMDLHPGAGKTKRYLPAIVREALKRRLRTLILAPTRVVAAEMEEALRGLPIRYQTPAVKSEHTGREIVDLMCHATFTMRLLSPVRVPNYNLIIMDEAHFTDPASIAARGYISTRVGMGEAAAIFMTATPPGSXDPFPQSNSPIQDEERDIPERSWNTGFXXXXXFKGKTVWFVPSIKAGNDIANCLRKNGKKVIQLSRKTFDTEYQKTXLNDWDFVVTTDISEMGANFRADRVIDPRRCLKPVILTDGPERVILAGPMPVTVASAAQRRGRIGRNPXNENDQYIYMGQPLNNDEDHAHWTEAKMLLDNINTPEGIIPALFEPEREKSQAIDGEYRLRGEARKTFVELMRRGDLPVWLSYKVASXXXXXXXXXXXXXXXRNNQILEENMDVEIWTKEGERKKLRPRWLDARVYSDPLALKEFKEFAAGRKXXXXNLITEMGRLPXXXXXXXKNALDNIVMLHTTEXXXXAYQHALSELPETLETLLLLXXXXXXXXXXXXXXXXXXXXXXXXXXXXXXXXXXXXXXXXXIQPHWIAASIILEFFLMVLLIPEPEKQRTPQDNQLTYVVIAILXXXXXXXXNEMGFLEKTKKDXXXXXXXXXXXXXXXXXXXXLDVDLRPASAWTLYAVATTVLTPMLRHSIENSSVNVSLTAIANQAAVLMGLDKGWPLSKMDLGVPLLALGCYSQVNPLTLTAAVXXXXAHYAIIGPGLQAKATREAQKRTAAGIMKNPTVDGITVIDLEPIPYDPKFEKQLGQVMLLVLCVTQVLLMRTTWALCEALTLATGPITTLWEGNPGRFWNTTIAVSMANIFRGSYLAGAGLAFSLIKNXXXXXXXXXXQGETLGEKWKRQLNXXXXXXXXXYKKSGIQEVDRTEAKEGLKRGEXXHHAVSRGSAKLRWFVERNLVXPKGKVVDLGCGRGGWSYYCAGLKKVTEVKGYTKGGPGHEEPIPMATYGWNLVKLHSGVDVFYXPPEKCDTLLCDIGESSSNPTIEEGRTLRVLKMVEPWLXXXXQFCIKVLNPYMPTVIEXXXXXXXXXGGMLVRNPLSRNSTHEMYWVSNASGNIVSSVNMISRMLINRFTMXXXXATYEKDVDLGAGTRSVSTEXXXPDMDIIGKRIEKIXXXXXXSWHYDQENPYKTWAYHGSYETKQTGSASSMVNGVVKLLTKPWDVIPMVTQMAMTDTTPFGQQRVFKEKVDTRTPRXXXXXXXXXXXXXXXXXXXXXXXXXXXXXXXXXXXXKVRSNAAIGAVFTDENKWKSAREAVXXXXXXXXXXXERALHQEGKCETCVYNMMGKREKKLGEFGKAKGSRAIWYMWLGARFLEFEALGFLNEDHWFSRENSLSGVEGEGLHKLGYILRXXXXXXGGAMYADDTAGWDTRITEDDLXXXXXXXXXXXXXXXXXXXAIFKLTYQNKVVKVLRPTPXGTVMDIISRKDQRGSGQVGTYGLNTFTNMEAQLIRQMEGEGVXXXXXXXXXXXXXXXXXXXXXXXXXXXXERLKRMAISGDDCVVKPIDDRFXXALTALNDMGKVRKDIPQWEPSKGWKDWQQVPFCSHHFHELIMKDGRXLVVPCRNQDELIGRARISQGAGWSLRETACLGKAYAQMWSLMYFHRRDLRLAANAICSAVPXXWVPTSRTTWSIHAHHQWMTTEDMLTVWNRVWIXXXXXXXXXXXXXXXXDVPYLGKREDQWCGSLIGLTSRATWAKNIXXXXXXXXXXXXXXXXXDYMPSMKRFRXXXXXXXXXX

SEQ ID NO: 265868 - protein, 3402 aa, Dengue virus
  MOD_RES (1)..(10): Any amino acid
  MOD_RES (26)..(27): Any amino acid
  MOD_RES (71)..(82): Any amino acid
  MOD_RES (93)..(114): Any amino acid
  MOD_RES (129)..(130): Any amino acid
  MOD_RES (143)..(145): Any amino acid
  MOD_RES (158)..(173): Any amino acid
  MOD_RES (195)..(197): Any amino acid
  MOD_RES (236)..(236): Any amino acid
  MOD_RES (248)..(280): Any amino acid
  MOD_RES (329)..(348): Any amino acid
  MOD_RES (361)..(375): Any amino acid
  MOD_RES (400)..(462): Any amino acid
  MOD_RES (480)..(483): Any amino acid
  MOD_RES (501)..(514): Any amino acid
  MOD_RES (552)..(558): Any amino acid
  MOD_RES (573)..(644): Any amino acid
  MOD_RES (657)..(682): Any amino acid
  MOD_RES (709)..(722): Any amino acid
  MOD_RES (734)..(741): Any amino acid
  MOD_RES (753)..(784): Any amino acid
  MOD_RES (824)..(827): Any amino acid
  MOD_RES (847)..(887): Any amino acid
  MOD_RES (898)..(927): Any amino acid
  MOD_RES (946)..(953): Any amino acid
  MOD_RES (983)..(999): Any amino acid
  MOD_RES (1021)..(1036): Any amino acid
  MOD_RES (1053)..(1066): Any amino acid
  MOD_RES (1114)..(1222): Any amino acid
  MOD_RES (1233)..(1346): Any amino acid
  MOD_RES (1402)..(1409): Any amino acid
  MOD_RES (1420)..(1424): Any amino acid
  MOD_RES (1439)..(1439): Any amino acid
  MOD_RES (1455)..(1476): Any amino acid
  MOD_RES (1489)..(1507): Any amino acid
  MOD_RES (1518)..(1518): Any amino acid
  MOD_RES (1537)..(1537): Any amino acid
  MOD_RES (1562)..(1564): Any amino acid
  MOD_RES (1588)..(1595): Any amino acid
  MOD_RES (1618)..(1618): Any amino acid
  MOD_RES (1645)..(1659): Any amino acid
  MOD_RES (1799)..(1799): Any amino acid
  MOD_RES (1826)..(1830): Any amino acid
  MOD_RES (1875)..(1875): Any amino acid
  MOD_RES (1943)..(1943): Any amino acid
  MOD_RES (2030)..(2044): Any amino acid
  MOD_RES (2096)..(2099): Any amino acid
  MOD_RES (2110)..(2116): Any amino acid
  MOD_RES (2131)..(2134): Any amino acid
  MOD_RES (2154)..(2194): Any amino acid
  MOD_RES (2238)..(2245): Any amino acid
  MOD_RES (2258)..(2277): Any amino acid
  MOD_RES (2362)..(2365): Any amino acid
  MOD_RES (2376)..(2377): Any amino acid
  MOD_RES (2493)..(2502): Any amino acid
  MOD_RES (2517)..(2525): Any amino acid
  MOD_RES (2548)..(2549): Any amino acid
  MOD_RES (2570)..(2570): Any amino acid
  MOD_RES (2633)..(2633): Any amino acid
  MOD_RES (2671)..(2674): Any amino acid
  MOD_RES (2691)..(2699): Any amino acid
  MOD_RES (2744)..(2747): Any amino acid
  MOD_RES (2767)..(2769): Any amino acid
  MOD_RES (2783)..(2788): Any amino acid
  MOD_RES (2849)..(2852): Any amino acid
  MOD_RES (2864)..(2899): Any amino acid
  MOD_RES (2925)..(2935): Any amino acid
  MOD_RES (3019)..(3024): Any amino acid
  MOD_RES (3046)..(3064): Any amino acid
  MOD_RES (3084)..(3084): Any amino acid
  MOD_RES (3127)..(3154): Any amino acid
  MOD_RES (3177)..(3178): Any amino acid
  MOD_RES (3225)..(3225): Any amino acid
  MOD_RES (3287)..(3288): Any amino acid
  MOD_RES (3321)..(3336): Any amino acid
  MOD_RES (3366)..(3382): Any amino acid
  MOD_RES (3393)..(3402): Any amino acid
XXXXXXXXXXPSFNMLKRARNRVSTXXGLVKRFSTGLLNGKGPLRMVLAFITFLRVLSIPPTAGVLARWGXXXXXXXXXXXXGFKKEISNMLXXXXXXXXXXXXXXXXXXXXXXFHLTSRDGEPRMIVXXQERGKSLLFKTSXXXNKCTLMAIDLGEXXXXXXXXXXXXXXXXEPEDIDCWCNSTDTWVTYGTCXXXGEHRREKRSVALAPHVGMGLETRAQTWMSAEGAWRQVEXVESWILRNPGFXXXXXXXXXXXXXXXXXXXXXXXXXXXXXXXXXMRCIGVGNRDFVEGVSGGAWVDVVLEHGGCVTTMAQGKPTLDIELLKTXXXXXXXXXXXXXXXXXXXXTTATRCPTQGEPXXXXXXXXXXXXXXXYVDRGWGNGCGLFGKGGVVTCAKFXXXXXXXXXXXXXXXXXXXXXXXXXXXXXXXXXXXXXXXXXXXXXXXXXXXXXXXXXXXXXXXLDCEPRTGLDFNEMILLXXXXKAWMVHRQWFFDLPLPWXXXXXXXXXXXXXXELLVTFKNPHAKRQDVTVLGSQEGAMHSALAGATEVDXXXXXXXFAGHLKCKVRMEKLXXXXXXXXXXXXXXXXXXXXXXXXXXXXXXXXXXXXXXXXXXXXXXXXXXXXXXXXXXXXXXXXXXXXXXXXTNIELEPPFGDSXXXXXXXXXXXXXXXXXXXXXXXXXXESTYRGAKRMAILGDTAWDFGSIGGVXXXXXXXXXXXXXXAYTALFSGVSWXXXXXXXXLLTWIGLNSKNXXXXXXXXXXXXXXXXXXXXXXXXXXXXXXXXGRELKCGSGIFITDNVHTWTEQYKFQPESPKRLSAAIGKXXXXGICGIRSTTRLENLMWKQIXXXXXXXXXXXXXXXXXXXXXXXXXXXXXXXXXXXXXXXXXYSWKSWGKAKXXXXXXXXXXXXXXXXXXXXXXXXXXXXXXWEVEDYGFGIFTTNIWLKXXXXXXXXCDSKLMSAAIKDQRAVHADMGYWIESEKNXXXXXXXXXXXXXXXXXWPKTHTLWSNGVLESDMIIPKXXXXXXXXXXXXXXXXTQTVGPWHLGKLEIDFXXXXXXXXXXXXXXGHRGPSLRTTTASGKLVTQWCCRSCTLPPLRYLGEDGCWYGMEIRPVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTSREVLLLTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEGVMAVGLVSLLGSSLLKNDVPLAGPMVAGGLLLAAYVMTGRSADLELERXXXXXXXXMADITGSSPIXXXXXDDDGTMKIKDEERDXTITLLVKLALITVSGXXXXXXXXXXXXXXXXXXXXXXSGALWDVPSPAAXXXXXXXXXXXXXXXXXXXGKTQVGVGIHXEGTFHTMWHVTRGAVLMHXGKRIEPSWADVRNDLISYGGGWKLXXXWDKGEEVQVLAIEPGKNPKHVQTXXXXXXXXEGEIGAVSLDFKPGTSGSPIVNXKGKVIGLYGNGVVTTSGTYVSAIAQAXXXXXXXXXXXXXXXFKKKNLTIMDLHPGAGKTKRILPSIVREAIKRGLRTLILAPTRVVASEMAEALKGMPIRYQTTAVKSEHTGKEIVDLMCHATFTTRLLSSTRVPNYNLIVMDEAHFTDPSSVAARGYISTRVEMGEAAGIFMTATPPGTXDPFPQSNAVIEDEEREIPERSWNSGHXXXXXYQGKTVWFVPSIKAGNDIAACLRKNGKRVIQLSRKTFDTEYPKTXNTDWDYVVTTDISEMGANFRAERVIDPRRCMKPVILTDGPERVILAGPIPVTPSSAAQRRGRVGRNPXQEDDQYVFMGEPLENDEDCAHWKEAKMLLDNINTPEGIIPSMFEPEREKVDAIDGEFRLRGEQRKTFVDLMRRGDLPVWLAHKVASXXXXXXXXXXXXXXXRNNQVLEENMEVEIWTKEGEKKKLKPRWLDARIYADPMALKDFKEFASGRKXXXXDLILEIGKLPXXXXXXXQLALDNLAVLHTAEXXXXAYNHALNELPESLETLMLVXXXXXXXXXXXXXXXXXXXXXXXXXXXXXXXXXXXXXXXXXIQPQWIAASIILEFFLIVLLIPEPDRQRTPQDNQLAYVVIGLLXXXXXXXXNEMGLLETTKKDXXXXXXXXXXXXXXXXXXXXLDVDLHPASAWTLYAVATTIITPMLRHTIENTSANLSLAAIANQAAILMGLGKGWPLHRMDIGVPLLAIGCYSQVNPITLTAALXXXXVHYAIIGPGLXXKATREAQKRAAAGIMKNPTVDGIVAIDLDPISYDAKFEKQLGQIMLLILCTGQLLMMRTTWALCESITLATGPLSTLWEGSPGKFWNTTIAVSTANIFRGSYLAGAGLLFSIMKNXXXXXXXXXXTGETLGEKWKSRLNXXXXXXXXXYKRSGILEVDRTLAKEGIKRGEXXKHAVSRGSSKLRWFVERNMVXPEGKVIDLGCGRGGWSYYMATLKNVREVKGLTKGGPGHEEPIPMSTYGWNLVRLQSGVDVFFXPTEQVDTLLCDIGESSPSPTVEAGRTLRVLNLVENWLXXXXEFCIKVLNPYMPSVIEXXXXXXXXXGGALVRCPLSRNSTHEMYWVSCGTGNIVSAVNMTSKMLLNRFTTXXXXPTYEPDVDLGSGTRNIGIEXXXPNLTIIGRRLQRLXXXXXXTWHYDQDNPYRTWAYHGSYEAPSSGSASSMVNGVVKLLTKPWDVVPMVTQLAMTDTTPFGXXXXFKEKVDTRTPQXXXXXXXXXXXXXXXXXXXXXXXXXXXXXXXXXXXXKVRSNAALGAIFQEEQGWTSASEAVXXXXXXXXXXXERNLHLEGKCESCVYNMMGKREKKLGEFGRAKGSRAIWYMWLGARFLEFEALGFMNEDHWFGRENSWSGVEGEGLHRLGYILEXXXXXXGGNIYADDTAGWDTRITLEDLXXXXXXXXXXXXXXXXXXXSIFKLTYQNKVVRVQRPTPXGAVMDVISRRDQRGSGQVVTYGLNTFTNMEVQLIRQMEAEGVXXXXXXXXXXXXXXXXXXXXXXXXXXXXDRLSRMAISGDDCVVKPLDERFXXSLLFLNDMGKVRKDIPQWEPSKGWNDWTEVPFCSHHFHKIFMKDGRXIVVPCRNQDELVGRARVSQGAGWSLRETACLGKSYAQMWQLMYFHRRDLRLASMAICSAVPXXWFPTSRTTWSIHAKHQWMTTEDMLKVWNRVWIXXXXXXXXXXXXXXXXDIPYLGKREDLWCGSLIGLSSRATWAKNIXXXXXXXXXXXXXXXXXDYMTSMKRFKXXXXXXXXXX

SEQ ID NO: 265869 - protein, 3402 aa, Dengue virus
  MOD_RES (1)..(10): Any amino acid
  MOD_RES (26)..(27): Any amino acid
  MOD_RES (71)..(82): Any amino acid
  MOD_RES (93)..(114): Any amino acid
  MOD_RES (129)..(130): Any amino acid
  MOD_RES (143)..(145): Any amino acid
  MOD_RES (158)..(174): Any amino acid
  MOD_RES (195)..(197): Any amino acid
  MOD_RES (236)..(236): Any amino acid
  MOD_RES (248)..(280): Any amino acid
  MOD_RES (329)..(348): Any amino acid
  MOD_RES (361)..(375): Any amino acid
  MOD_RES (400)..(462): Any amino acid
  MOD_RES (480)..(483): Any amino acid
  MOD_RES (501)..(514): Any amino acid
  MOD_RES (552)..(558): Any amino acid
  MOD_RES (573)..(644): Any amino acid
  MOD_RES (657)..(682): Any amino acid
  MOD_RES (709)..(722): Any amino acid
  MOD_RES (734)..(741): Any amino acid
  MOD_RES (753)..(784): Any amino acid
  MOD_RES (824)..(827): Any amino acid
  MOD_RES (847)..(887): Any amino acid
  MOD_RES (898)..(927): Any amino acid
  MOD_RES (946)..(953): Any amino acid
  MOD_RES (983)..(999): Any amino acid
  MOD_RES (1021)..(1036): Any amino acid
  MOD_RES (1053)..(1066): Any amino acid
  MOD_RES (1114)..(1222): Any amino acid
  MOD_RES (1233)..(1346): Any amino acid
  MOD_RES (1402)..(1409): Any amino acid
  MOD_RES (1420)..(1424): Any amino acid
  MOD_RES (1439)..(1439): Any amino acid
  MOD_RES (1455)..(1476): Any amino acid
  MOD_RES (1489)..(1507): Any amino acid
  MOD_RES (1518)..(1518): Any amino acid
  MOD_RES (1537)..(1537): Any amino acid
  MOD_RES (1562)..(1564): Any amino acid
  MOD_RES (1588)..(1595): Any amino acid
  MOD_RES (1618)..(1618): Any amino acid
  MOD_RES (1645)..(1659): Any amino acid
  MOD_RES (1702)..(1703): Any amino acid
  MOD_RES (1736)..(1740): Any amino acid
  MOD_RES (1799)..(1799): Any amino acid
  MOD_RES (1826)..(1830): Any amino acid
  MOD_RES (1875)..(1875): Any amino acid
  MOD_RES (1887)..(1887): Any amino acid
  MOD_RES (1943)..(1943): Any amino acid
  MOD_RES (1967)..(1974): Any amino acid
  MOD_RES (2030)..(2044): Any amino acid
  MOD_RES (2096)..(2099): Any amino acid
  MOD_RES (2110)..(2116): Any amino acid
  MOD_RES (2131)..(2134): Any amino acid
  MOD_RES (2154)..(2194): Any amino acid
  MOD_RES (2222)..(2222): Any amino acid
  MOD_RES (2238)..(2245): Any amino acid
  MOD_RES (2258)..(2277): Any amino acid
  MOD_RES (2362)..(2365): Any amino acid
  MOD_RES (2376)..(2391): Any amino acid
  MOD_RES (2468)..(2479): Any amino acid
  MOD_RES (2493)..(2502): Any amino acid
  MOD_RES (2517)..(2525): Any amino acid
  MOD_RES (2548)..(2549): Any amino acid
  MOD_RES (2570)..(2570): Any amino acid
  MOD_RES (2633)..(2633): Any amino acid
  MOD_RES (2671)..(2674): Any amino acid
  MOD_RES (2691)..(2699): Any amino acid
  MOD_RES (2744)..(2747): Any amino acid
  MOD_RES (2767)..(2769): Any amino acid
  MOD_RES (2783)..(2788): Any amino acid
  MOD_RES (2849)..(2853): Any amino acid
  MOD_RES (2864)..(2899): Any amino acid
  MOD_RES (2925)..(2935): Any amino acid
  MOD_RES (2956)..(2980): Any amino acid
  MOD_RES (3019)..(3024): Any amino acid
  MOD_RES (3046)..(3069): Any amino acid
  MOD_RES (3084)..(3084): Any amino acid
  MOD_RES (3104)..(3105): Any amino acid
  MOD_RES (3127)..(3154): Any amino acid
  MOD_RES (3177)..(3178): Any amino acid
  MOD_RES (3225)..(3225): Any amino acid
  MOD_RES (3287)..(3288): Any amino acid
  MOD_RES (3321)..(3336): Any amino acid
  MOD_RES (3366)..(3382): Any amino acid
  MOD_RES (3393)..(3402): Any amino acid
XXXXXXXXXXPSINMLKRVRNRVSTXXQLTKRFSLGLLSGRGPLKLFMALVAFLRFLAIPPTAGILARWGXXXXXXXXXXXXGFKKEISSMLXXXXXXXXXXXXXXXXXXXXXXFHLTTRGGEPHMIVXXNEKGKSLLFKTEXXXNMCTLMAMDLGEXXXXXXXXXXXXXXXXXPDDVDCWCNATSTWVMYGTCXXXGERRREKRSVALAPHVGLGLDTRTQTWMSSEGAWKQIQXIETWILRHPGFXXXXXXXXXXXXXXXXXXXXXXXXXXXXXXXXXMRCVGISSRDFVEGVSGGSWVDLVLEHGGCVTTMAKNKPTLDIELQKTXXXXXXXXXXXXXXXXXXXXTTESRCPTQGEPXXXXXXXXXXXXXXXMVDRGWGNGCGLFGKGGIVTCAMFXXXXXXXXXXXXXXXXXXXXXXXXXXXXXXXXXXXXXXXXXXXXXXXXXXXXXXXXXXXXXXXLDCSPRSGIDFNEMILMXXXXKTWLVHRQWFLNLPLPWXXXXXXXXXXXXXXERMVTFKVPHAKKQDVVVLGSQEGAMHSALTGATEVDXXXXXXXFTGHLKCRLRMDKLXXXXXXXXXXXXXXXXXXXXXXXXXXXXXXXXXXXXXXXXXXXXXXXXXXXXXXXXXXXXXXXXXXXXXXXXVNIEAEPPFGDSXXXXXXXXXXXXXXXXXXXXXXXXXXETTMRGAKRMAILGETAWDFGSVGGLXXXXXXXXXXXXXXVYTTMFGGVSWXXXXXXXXLVLWIGTNSRNXXXXXXXXXXXXXXXXXXXXXXXXXXXXXXXXNKELKCGSGIFVVDNVHTWTEQYKFQPESPARLASAILNXXXXGVCGIRSTTRLENVMWKQIXXXXXXXXXXXXXXXXXXXXXXXXXXXXXXXXXXXXXXXXXYSWKAWGKAKXXXXXXXXXXXXXXXXXXXXXXXXXXXXXXLEVEDYGFGMFTTNIWMKXXXXXXXXCDHRLMSAAVKDERAVHADMGYWIESQKNXXXXXXXXXXXXXXXXXWPRSHTLWSNGVLESQMLIPKXXXXXXXXXXXXXXXXTQIMGPWHLGKLEMDFXXXXXXXXXXXXXXDTRGPSLRTTTVTGKIITEWCCRSCTLPPLRYMGEDGCWYGMEIRPIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTSRENLLLGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEAIMAVGLVSILLSSLLKNDVPLAGPLIAGGMLIACYVITGTSADLTVEKXXXXXXXXEAEQTGVSHNXXXXXSEDGSFSIRDVEETXTLTILLKATLLAVSGXXXXXXXXXXXXXXXXXXXXXXSGVLWDTPSPPEXXXXXXXXXXXXXXXXXXXGRSQVGVGVFXENVFHTMWHVTRGAVLMYXTKRLEPSWADVKKDMISYGGGWRLXXXWNTEEDVQVLAVEPGKNPKNVQTXXXXXXXXTGEVGAVTLDFSPGTSGSPIVDXEGKIVGLYGNGVVTRSGAYVSAIAQTXXXXXXXXXXXXXXXFRKRRLTIMDLHPGSGKTRKYLPAIIREAIKRKLRTLILAPTXXVAAEMEEALKGLPIRYQTPAIRAEHTGREIVDXXXXXTFTMRLLSPVRVPNYNMVIMDEAHFTDPSSIAARGYISTRVEMGEAAAIFMTATPPGAXEAFPQSNAPIMDIEREIPERSWNSGYXXXXXFPGKTVWFVPSIKSGNDIANCLRKSGKKVIQLSRKTFDSEYVKTXLNDWDYVVTTDXSEMGANFKAGRVIDPRRCLKPVILKDGEERVILAGPMPVTHASAAQRRGRIGRNHXKENDQYIYSGDPLKNDEDHAHWTXXXXXXXXIYTPEGIIPTLFGPEREKTAAIDGEYRLRGEARKTFVELMKRGDLPVWLAYKVAAXXXXXXXXXXXXXXXKNNQILEENVEVEIWTREGERKKLRPRWLDARTYSDPLALREFKEFAAGRRXXXXDLVTEIGRVPXXXXXXXRDALDNLVMLHNSEXXXXAYRHAMEELPDTIETLMLLXXXXXXXXXXXXXXXXXXXXXXXXXXXXXXXXXXXXXXXXXVELQWIASAIVLEFFLMVLLVPEPEKQXTPQDNQLIYVILTILXXXXXXXXNEMGLIEKTKTDXXXXXXXXXXXXXXXXXXXXLDIDLRPASAWTLYAVATTFITPMMRHTIENTTANISLTAIANQATVLMGLGKGWPISKMDIGVPLLAMGCYSQVNPTTLTASLXXXXTHYAIIGPGLXXXXXXXXXXXXXXXXMKNPTVDGIMTIDLDPVVYDSKFEKQLGQVMLLILCASQILLMRTTWAFCEVLTLATGPILTLWEGNPGKFWNTTIXXXXXXXXXXXXLAGAGLAFSLMKSXXXXXXXXXXIGETLGEKWKKKLNXXXXXXXXXYKRSGIMEVDRSEAKSALKDGSXXKHAVSRGTAKLQWFVERNMVXPEGRVIDLGCGRGGWSYYCGGLKNVTEVRGFTKGGPGHEEPVPMSTYGWNIVKLHSGKDVFFXPPERCDTLLCDIGESSPNPTIEESRTIRVLSLVENWLXXXXQFCIKILNPYMPSVVEXXXXXXXXXGGNLIRCPLSRNSTHEMYWVSGATGNIVSSVNMVSRMLLNRFTMXXXXPTYERDVDLGAGTRHVAVEXXXANLDIIGQRIENIXXXXXXTWHYDEDHPYKTWAYHGSYEVKPTGSASSMINGVVRLLTKPWDVLPMVTQIAMTDTTPFGXXXXXKEKVDTRTQEXXXXXXXXXXXXXXXXXXXXXXXXXXXXXXXXXXXXKVRSNAAIGAVFVDENQWNSAKEAVXXXXXXXXXXXERELHKQGKCATCVYNMMGKXXXXXXXXXXXXXXXXXXXXXXXXXYLEFEALGFLNEDHWFSRENSYSGVEGEGLHRLGYILRXXXXXXGDLMYADDTAGWDTRITIEDLXXXXXXXXXXXXXXXXXXXXXXXXTYQNKVVRVQRPAKXGTVMDIISRRDQRGSGQVVXXSLNTFTNMEAQLIRQMESEGIXXXXXXXXXXXXXXXXXXXXXXXXXXXXERLRRMAISGDDCVVKPLDDRFXXALLALNDMGKVRKDIQQWQPSKGWNNWQEVPFCSHHFHQLIMKDGRXLVVPCRPQDELIGRARISQGAGWSLKETACLGKSYAQMWTLMYFHRRDLRLASNAICSAVPXXWIPTSRTTWSIHATHQWMTTEDMLSVWNRVWIXXXXXXXXXXXXXXXXEIPYLGKREDQWCGSLIGLTSRATWAQNIXXXXXXXXXXXXXXXXXDYMPVMKRYSXXXXXXXXXX

SEQ ID NO: 265870 - protein, 3402 aa, Dengue virus
  MOD_RES (1)..(10): Any amino acid
  MOD_RES (21)..(27): Any amino acid
  MOD_RES (71)..(82): Any amino acid
  MOD_RES (93)..(114): Any amino acid
  MOD_RES (129)..(130): Any amino acid
  MOD_RES (143)..(145): Any amino acid
  MOD_RES (158)..(174): Any amino acid
  MOD_RES (195)..(197): Any amino acid
  MOD_RES (236)..(236): Any amino acid
  MOD_RES (248)..(280): Any amino acid
  MOD_RES (329)..(348): Any amino acid
  MOD_RES (361)..(375): Any amino acid
  MOD_RES (400)..(462): Any amino acid
  MOD_RES (480)..(483): Any amino acid
  MOD_RES (500)..(514): Any amino acid
  MOD_RES (537)..(539): Any amino acid
  MOD_RES (552)..(558): Any amino acid
  MOD_RES (573)..(644): Any amino acid
  MOD_RES (657)..(682): Any amino acid
  MOD_RES (693)..(695): Any amino acid
  MOD_RES (709)..(722): Any amino acid
  MOD_RES (734)..(741): Any amino acid
  MOD_RES (753)..(784): Any amino acid
  MOD_RES (824)..(827): Any amino acid
  MOD_RES (847)..(887): Any amino acid
  MOD_RES (898)..(927): Any amino acid
  MOD_RES (946)..(953): Any amino acid
  MOD_RES (983)..(1007): Any amino acid
  MOD_RES (1021)..(1036): Any amino acid
  MOD_RES (1053)..(1066): Any amino acid
  MOD_RES (1109)..(1222): Any amino acid
  MOD_RES (1233)..(1346): Any amino acid
  MOD_RES (1402)..(1409): Any amino acid
  MOD_RES (1420)..(1424): Any amino acid
  MOD_RES (1439)..(1439): Any amino acid
  MOD_RES (1455)..(1476): Any amino acid
  MOD_RES (1489)..(1507): Any amino acid
  MOD_RES (1518)..(1518): Any amino acid
  MOD_RES (1537)..(1537): Any amino acid
  MOD_RES (1562)..(1564): Any amino acid
  MOD_RES (1588)..(1595): Any amino acid
  MOD_RES (1618)..(1618): Any amino acid
  MOD_RES (1645)..(1659): Any amino acid
  MOD_RES (1701)..(1712): Any amino acid
  MOD_RES (1736)..(1747): Any amino acid
  MOD_RES (1779)..(1799): Any amino acid
  MOD_RES (1826)..(1830): Any amino acid
  MOD_RES (1875)..(1875): Any amino acid
  MOD_RES (1886)..(1887): Any amino acid
  MOD_RES (1943)..(1943): Any amino acid
  MOD_RES (1967)..(1983): Any amino acid
  MOD_RES (2016)..(2016): Any amino acid
  MOD_RES (2030)..(2044): Any amino acid
  MOD_RES (2096)..(2099): Any amino acid
  MOD_RES (2110)..(2116): Any amino acid
  MOD_RES (2131)..(2134): Any amino acid
  MOD_RES (2154)..(2194): Any amino acid
  MOD_RES (2221)..(2225): Any amino acid
  MOD_RES (2238)..(2246): Any amino acid
  MOD_RES (2258)..(2288): Any amino acid
  MOD_RES (2362)..(2391): Any amino acid
  MOD_RES (2462)..(2480): Any amino acid
  MOD_RES (2493)..(2502): Any amino acid
  MOD_RES (2517)..(2525): Any amino acid
  MOD_RES (2548)..(2549): Any amino acid
  MOD_RES (2570)..(2570): Any amino acid
  MOD_RES (2582)..(2584): Any amino acid
  MOD_RES (2609)..(2611): Any amino acid
  MOD_RES (2633)..(2644): Any amino acid
  MOD_RES (2670)..(2674): Any amino acid
  MOD_RES (2691)..(2699): Any amino acid
  MOD_RES (2744)..(2747): Any amino acid
  MOD_RES (2767)..(2769): Any amino acid
  MOD_RES (2783)..(2788): Any amino acid
  MOD_RES (2821)..(2823): Any amino acid
  MOD_RES (2845)..(2853): Any amino acid
  MOD_RES (2864)..(2900): Any amino acid
  MOD_RES (2925)..(2935): Any amino acid
  MOD_RES (2956)..(2989): Any amino acid
  MOD_RES (3012)..(3024): Any amino acid
  MOD_RES (3037)..(3072): Any amino acid
  MOD_RES (3084)..(3084): Any amino acid
  MOD_RES (3096)..(3113): Any amino acid
  MOD_RES (3127)..(3154): Any amino acid
  MOD_RES (3177)..(3178): Any amino acid
  MOD_RES (3225)..(3249): Any amino acid
  MOD_RES (3275)..(3292): Any amino acid
  MOD_RES (3321)..(3336): Any amino acid
  MOD_RES (3347)..(3353): Any amino acid
  MOD_RES (3366)..(3382): Any amino acid
  MOD_RES (3393)..(3402): Any amino acid
XXXXXXXXXXTPFNMLKRERXXXXXXXQLAKRFSRGMLQGQGPMKMVMAFIAFLRFLTIPPTAGILARWSXXXXXXXXXXXXGFKKEVSNMLXXXXXXXXXXXXXXXXXXXXXXFHLSTRDGEPLMIVXXHERGRPLLFKTTXXXNMCTLMALDLGEXXXXXXXXXXXXXXXXXPDDVDCWCNATSAWVMYGTCXXXGERRREKRSVALTPHSGMGLDTRAQTWMSSEGAWKHVQXVETWAFRHPGFXXXXXXXXXXXXXXXXXXXXXXXXXXXXXXXXXMRCVGIGSRDFVEGVSGGTWVDIVLEHGGCVTTMAKDKPTLDFELTKTXXXXXXXXXXXXXXXXXXXXTTASRCPTQGEPXXXXXXXXXXXXXXXVVDRGWGNGCGLFGKGSLITCAKFXXXXXXXXXXXXXXXXXXXXXXXXXXXXXXXXXXXXXXXXXXXXXXXXXXXXXXXXXXXXXXXMECSPRTSLDFNEMVLLXXXXKAWLVHKQWFLNLPLPXXXXXXXXXXXXXXXETLVTFKNPHAKRQDVVVLGSQXXXMRTVLTGATEIQXXXXXXXFMGHLKCKVRMERLXXXXXXXXXXXXXXXXXXXXXXXXXXXXXXXXXXXXXXXXXXXXXXXXXXXXXXXXXXXXXXXXXXXXXXXXINIETEPPFGESXXXXXXXXXXXXXXXXXXXXXXXXXXEATAKGARRMXXXGDTAWDFGSLGGVXXXXXXXXXXXXXXIYGAAFSGVSWXXXXXXXXIITWIGMNSRSXXXXXXXXXXXXXXXXXXXXXXXXXXXXXXXXGKELKCGSGIFVIDNVHTWTEQYKFQADSPKRLATAIAGXXXXGVCGIRSATRMENLLWKQIXXXXXXXXXXXXXXXXXXXXXXXXXXXXXXXXXXXXXXXXXYSWKTWGKARXXXXXXXXXXXXXXXXXXXXXXXXXXXXXXLEVEDYGFGVFSTNIWLKXXXXXXXXCDSKLMSAAVKDNRAVHADMGYWIESALNXXXXXXXXXXXXXXXXXXXXXXXXXSNGVLESQMLIPRXXXXXXXXXXXXXXXXTQTAGPWHLGRLEMDFXXXXXXXXXXXXXXGHRGSSLRTTTVSGKLIHEWCCRSCTLPPLRFKGEDGCWYGMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTSKELMMATXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEGIMAIGIVSILASSLLRNDVPMAGPLVAGGLLIACYVITGRSADLELEKXXXXXXXXEAEHSGASHNXXXXXDDDGTMRIKDDETEXILTVLLKTALLIVSGXXXXXXXXXXXXXXXXXXXXXXSGVLWDVPSPPEXXXXXXXXXXXXXXXXXXXGKTQVGVGVQXDGVFHTMWHVTRGAVLTYXGKRLEPNWANVKKDLISYGGGWRFXXXWQKGEEVQVIAVEPGKNPKNFQTXXXXXXXXTGEIGAIALDFSPGTSGSPIIDXEGKVVGLYGNGVVTKNGGYVSGIAQTXXXXXXXXXXXXXXXFRKRRLTIMDLHPGSGKTRKYLPAIVREAIKRKLRTLVLAPXXXXXXXXXXXXRGLPIRYQTTATKTEHTGREIVDXXXXXXXXXXXXSPIRVPNYNLVIMDEAHFTDPCSVAARGYISXXXXXXXXXXXXXXXXXXXXXDAFPQSNAPIIDEEKDIPERSWNSGNXXXXXFAGKTVWFVPSIKTGNDIAACLRKSGKRVIQLSRKTFDSEYIKTXTNDWDFVVTTXXSEMGANFKAERVIDPRRCLKPVILPDGPERVILAGPMPVTASSAAQRRGRIGRNQXKEGDQYIFTGDPLRNDEDHAHWTXXXXXXXXXXXXXXXXXTLFEPEREKSAAVDGEYRLKGESRKTFVELMRXGDLPVWLAYRVAAXXXXXXXXXXXXXXXKNNQILEENMEVEIWTKEGEKKKLRPKWLDARTYSDPLALKEFKDFAAGRKXXXXDILTEIASLPXXXXXXXRNALDNLVMLHTSEXXXXAYRHAVEELPETMETLLLLXXXXXXXXXXXXXXXXXXXXXXXXXXXXXXXXXXXXXXXXXIPLQWIASAIVLEFFMMVLLVPEPEKXXXXXDNQLAYVVIGILXXXXXXXXXEMGLLETTKRDXXXXXXXXXXXXXXXXXXXXXXXXXXXXXXXTLYAVATTIVTPMLRHTIENSTANVSLAAIANQAVVLMGLGKGWPIHRMDLGVPLLALGCYSQVNPLTLIAAVXXXXXXXXXXXXXXXXXXXXXXXXXXXXXXMKNPTIDGITVIDLEPVIYDSKFEKQLGQVMLLVLCAVQLLLMRTSWALCEVLTLATGPVMTLWEGNPGRXXXXXXXXXXXXXXXXXXXAGAGLAFSIMKSXXXXXXXXXXMGETLGEKWKNRLNXXXXXXXXXYKKSGITEVDRTEAKSALRDGSXXRHAVSRGSAKIRWIVERGMVXPEGRVIDLGCGXXXWSYYCGGLKNVKEVRGFTKGGPGHXXXVPMSTYGWNLVKLMSGKDVFYXXXXXXXXXXXXIGESSPNPTVEAGRTLRVLSLVENWXXXXXQFCVKVLNPYMPAVIEXXXXXXXXXGGSLVRCPLSRNSTHEMYWISNGTGNIVASVNTTSRLLLNRFTMXXXXPTIERDVDLGAGTRHVNAEXXXPNMDVIGERIKRIXXXXXXTWHYDDENPYKTWAYHGSYEVKATGSASSMINXXXRLLTKPWDVVPTVTQMAMTDTXXXXXXXXXKEKVDTRTPKXXXXXXXXXXXXXXXXXXXXXXXXXXXXXXXXXXXXXVRTNAAMGAVFTEENQWDSAKAAVXXXXXXXXXXXERELHKLGKCGSCVYNMMGKXXXXXXXXXXXXXXXXXXXXXXXXXXXXXXXXXXLNEDHWFSRGNSFSGVEGEGLHXXXXXXXXXXXXXGDLIYADDTAGWXXXXXXXXXXXXXXXXXXXXXXXXXXXXXXXXXXXXNKVVKVQRPTPXGTVMDIISRRDXXXXXXXXXXXXXXXXXXEAQLIRQMEGEGIXXXXXXXXXXXXXXXXXXXXXXXXXXXXERLRRMAISGDDCVVKPTDDRFXXALIALNDMGKIRKDIQQWEPSRGWHDWQQVPFCSHHFHELVMKDGRXXXXXXXXXXXXXXXXXXXXXXXXXLKETACLGKSYAQMWALMYFHRRDLXXXXXXXXXXXXXXXXXXSRTTWSIHASHEWMTTEDMLAVWNRVWIXXXXXXXXXXXXXXXXNVPYLGKREDXXXXXXXGLTARATWATNIXXXXXXXXXXXXXXXXXDYMPAMKRYSXXXXXXXXXX

SEQ ID NO: 265871 - protein, 3402 aa, Dengue virus
  MOD_RES (1)..(27): Any amino acid
  MOD_RES (55)..(82): Any amino acid
  MOD_RES (93)..(114): Any amino acid
  MOD_RES (129)..(132): Any amino acid
  MOD_RES (143)..(145): Any amino acid
  MOD_RES (157)..(176): Any amino acid
  MOD_RES (195)..(205): Any amino acid
  MOD_RES (221)..(225): Any amino acid
  MOD_RES (236)..(236): Any amino acid
  MOD_RES (248)..(280): Any amino acid
  MOD_RES (296)..(306): Any amino acid
  MOD_RES (326)..(350): Any amino acid
  MOD_RES (361)..(375): Any amino acid
  MOD_RES (400)..(462): Any amino acid
  MOD_RES (473)..(484): Any amino acid
  MOD_RES (497)..(517): Any amino acid
  MOD_RES (536)..(558): Any amino acid
  MOD_RES (569)..(644): Any amino acid
  MOD_RES (657)..(722): Any amino acid
  MOD_RES (734)..(741): Any amino acid
  MOD_RES (753)..(784): Any amino acid
  MOD_RES (824)..(832): Any amino acid
  MOD_RES (847)..(887): Any amino acid
  MOD_RES (898)..(927): Any amino acid
  MOD_RES (946)..(963): Any amino acid
  MOD_RES (983)..(1010): Any amino acid
  MOD_RES (1021)..(1036): Any amino acid
  MOD_RES (1047)..(1066): Any amino acid
  MOD_RES (1077)..(1089): Any amino acid
  MOD_RES (1108)..(1222): Any amino acid
  MOD_RES (1233)..(1347): Any amino acid
  MOD_RES (1374)..(1391): Any amino acid
  MOD_RES (1402)..(1409): Any amino acid
  MOD_RES (1420)..(1424): Any amino acid
  MOD_RES (1439)..(1439): Any amino acid
  MOD_RES (1455)..(1478): Any amino acid
  MOD_RES (1489)..(1507): Any amino acid
  MOD_RES (1518)..(1526): Any amino acid
  MOD_RES (1537)..(1537): Any amino acid
  MOD_RES (1553)..(1564): Any amino acid
  MOD_RES (1576)..(1595): Any amino acid
  MOD_RES (1606)..(1626): Any amino acid
  MOD_RES (1645)..(1674): Any amino acid
  MOD_RES (1700)..(1714): Any amino acid
  MOD_RES (1735)..(1748): Any amino acid
  MOD_RES (1760)..(1799): Any amino acid
  MOD_RES (1820)..(1830): Any amino acid
  MOD_RES (1842)..(1862): Any amino acid
  MOD_RES (1875)..(1875): Any amino acid
  MOD_RES (1886)..(1887): Any amino acid
  MOD_RES (1905)..(1905): Any amino acid
  MOD_RES (1922)..(1932): Any amino acid
  MOD_RES (1943)..(1943): Any amino acid
  MOD_RES (1962)..(1986): Any amino acid
  MOD_RES (2004)..(2005): Any amino acid
  MOD_RES (2016)..(2019): Any amino acid
  MOD_RES (2030)..(2044): Any amino acid
  MOD_RES (2055)..(2099): Any amino acid
  MOD_RES (2110)..(2116): Any amino acid
  MOD_RES (2127)..(2134): Any amino acid
  MOD_RES (2146)..(2194): Any amino acid
  MOD_RES (2205)..(2226): Any amino acid
  MOD_RES (2238)..(2246): Any amino acid
  MOD_RES (2258)..(2288): Any amino acid
  MOD_RES (2308)..(2320): Any amino acid
  MOD_RES (2347)..(2350): Any amino acid
  MOD_RES (2362)..(2392): Any amino acid
  MOD_RES (2416)..(2425): Any amino acid
  MOD_RES (2452)..(2482): Any amino acid
  MOD_RES (2493)..(2525): Any amino acid
  MOD_RES (2537)..(2537): Any amino acid
  MOD_RES (2548)..(2549): Any amino acid
  MOD_RES (2570)..(2570): Any amino acid
  MOD_RES (2582)..(2586): Any amino acid
  MOD_RES (2599)..(2615): Any amino acid
  MOD_RES (2633)..(2646): Any amino acid
  MOD_RES (2660)..(2677): Any amino acid
  MOD_RES (2690)..(2712): Any amino acid
  MOD_RES (2743)..(2747): Any amino acid
  MOD_RES (2767)..(2769): Any amino acid
  MOD_RES (2783)..(2789): Any amino acid
  MOD_RES (2801)..(2823): Any amino acid
  MOD_RES (2839)..(2902): Any amino acid
  MOD_RES (2925)..(2935): Any amino acid
  MOD_RES (2952)..(2997): Any amino acid
  MOD_RES (3009)..(3113): Any amino acid
  MOD_RES (3127)..(3166): Any amino acid
  MOD_RES (3177)..(3178): Any amino acid
  MOD_RES (3189)..(3194): Any amino acid
  MOD_RES (3213)..(3255): Any amino acid
  MOD_RES (3269)..(3303): Any amino acid
  MOD_RES (3314)..(3336): Any amino acid
  MOD_RES (3347)..(3353): Any amino acid
  MOD_RES (3366)..(3382): Any amino acid
  MOD_RES (3393)..(3402): Any amino acid
XXXXXXXXXXXXXXXXXXXXXXXXXXXGLVKRFSSELLSGRGPLKLFMAFVAFLXXXXXXXXXXXXXXXXXXXXXXXXXXXXGFKREISNMLXXXXXXXXXXXXXXXXXXXXXXFSLTTRGGEPHMVVXXXXKGKSLLFKTKXXXNMCTLMALDLGXXXXXXXXXXXXXXXXXXXXDVDCWCNTTETWVTYGTCXXXXXXXXXXXSVALTPHSGTGLETRXXXXXSSEGAWRQIQXIETWVLRHPGFXXXXXXXXXXXXXXXXXXXXXXXXXXXXXXXXXMRCIGIGNRDFVEGLXXXXXXXXXXXHGSCVTTIAKSKPTLDIELXXXXXXXXXXXXXXXXXXXXXXXXXDSRCPTQGEPXXXXXXXXXXXXXXXLVDRGWGNGCGLFGKGSLLTCAKFXXXXXXXXXXXXXXXXXXXXXXXXXXXXXXXXXXXXXXXXXXXXXXXXXXXXXXXXXXXXXXXMECSPRTSLDXXXXXXXXXXXXAWMVHRQWFLDLXXXXXXXXXXXXXXXXXXXXXVTFKNPHAKKQEVAVLGSXXXXXXXXXXXXXXXXXXXXXXXYAGHLKCKVRXXXXXXXXXXXXXXXXXXXXXXXXXXXXXXXXXXXXXXXXXXXXXXXXXXXXXXXXXXXXXXXXXXXXXXXXXXXXVNIEAEPPSGESXXXXXXXXXXXXXXXXXXXXXXXXXXXXXXXXXXXXXXXXXXXXXXXXXXXXXXXXXXXXXXXXXXAYTALFGGVSWXXXXXXXXVLTWLGLNSRNXXXXXXXXXXXXXXXXXXXXXXXXXXXXXXXXSKELKCGNGIFVADNVHTRTEQYQFQPESPARVASAILNXXXXXXXXXRSTTRMENLLWKQVXXXXXXXXXXXXXXXXXXXXXXXXXXXXXXXXXXXXXXXXXYSWKIWGKAKXXXXXXXXXXXXXXXXXXXXXXXXXXXXXXFEVEDYGFGVFTTNIWLRXXXXXXXXXXXXXXXXXXKDDRAVHADMGYWIESRLNXXXXXXXXXXXXXXXXXXXXXXXXXXXXVLESEMVIPKXXXXXXXXXXXXXXXXTQAAGPWHLGXXXXXXXXXXXXXXXXXXXXGHRGSSLRTTXXXXXXXXXXXXXSCTLPPLRFKGEDGCWYGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTSKELMMTTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWPLNEAVMAVGVVSILASSFLRNDVPXXXXXXXXXXXXXXXXXXGSSADLSLERXXXXXXXXEAEHSGTSHNXXXXXAEDGSFSIRDIEETXILTILLKATLLAISGXXXXXXXXXXXXXXXXXXXXXXXXALWDVPSPATXXXXXXXXXXXXXXXXXXXGKTQVGVGVHXXXXXXXXXHVTRGAVLTHXSGRLEPNWANVKKDLXXXXXXXXXXXXWDREEDVQVLAXXXXXXXXXXXXXXXXXXXXAGTIGAVSLDXXXXXXXXXXXXXXXXXXXXXGNGVVTRSGTYVSAIAQTXXXXXXXXXXXXXXXXXXXXXXXXXXXXXXGKTRRYLPAMVREAIRRGLRTLILAXXXXXXXXXXXXXXXLPIRYQTTAIKAEHTGREIVXXXXXXXXXXXXXXPVRVPNYNLVIXXXXXXXXXXXXXXXXXXXXXXXXXXXXXXXXXXXXXXXXEAFPQSNAPIQDEEKDIPERXXXXXXXXXXXFVGKTVWFVPSXXXXXXXXXXXXXXXXXXXXXSRKTFDSEYAKTXANDWDFVVTTXXSEMGANFRAERVIDPRRXLKPVISTDGEERVVLAXXXXXXXXXXXQRRGRIGRNLXKEGDQYVFSGDPLRNDEDXXXXXXXXXXXXXXXXXXXXXXXXXGPEREKNAAVDGEYRLRXXQRKTFVELMKXXXXPVWLAYKVASXXXXXXXXXXXXXXXRNNQILEENVXXXXXXXXXXXXXXXXXXXXXXXXXXXXXXXXXXXXXXXXXXXXXDILTEIATLPXXXXXXXRNALDNLAVLXXXXXXXXAYTHALSELPEXXXXXXXXXXXXXXXXXXXXXXXXXXXXXXXXXXXXXXXXXXXXXXXXXVPLQWIASAIXXXXXXXXXXXXXXXXXXXXXXNQLIYVILAILXXXXXXXXXEMGLIEKTKADXXXXXXXXXXXXXXXXXXXXXXXXXXXXXXXTLYAVATTFITPMLRHSIEXXXXXXXXXXXXXQATVLMGLGRGWPLHRVDLGVPLLAMXXXXQVNPTTLIASLXXXXXXXXXXXXXXXXXXXXXXXXXXXXXXXKNPTVDGVTVIDLDPIPYDPKFEXXXXXXXXXXLCVGQLLLMRTSWAFCEALTLATGPVXXXXXXXXXXXXXXXXXXXXXXXXXXXXXXXAGLLFSIMRNXXXXXXXXXXXXXXXXXXXXXXXXXXXXXXXXXYKRSGIIEVDRXEAKEGLRRGEXXKYAVSRGTSKIRWIVERGMIXPEGKVMDLGCGXXXXXYYCGGLKDVREVXXXXXXXXXXXXXXXXXTYGWNLVKLYSGKDVFFXXXXXXXXXXXXXXESSPNPTVEAGRTXXXXXXXXXXXXXXXXXXIKVLNPYMPTVVXXXXXXXXXXXXXXXXXXXXXXXTHEMYWVSGVSGNIVSSVNTISKMLLNRFTXXXXXPTYEKDADLGTGTRHVAVEXXXPNMDVIGERIRRIXXXXXXXWHYDHENPYRTXXXXXXXXXXXXXXXXXXXXXXXRLLTKPWDMIPMVTQXXXXXXXXXXXXXXXXXXXXXXXXXXXXXXXXXXXXXXXXXXXXXXXXXXXXXXXXXXXXXXXXSNAALGAVFTEENQWDSARAAVXXXXXXXXXXXERNLHLDGKCETCVYNXXXXXXXXXXXXXXXXXXXXXXXXXXXXXXXXXXXXXXXXXXXXXXRENSFSGVEGEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVQLVRQMEGEGVXXXXXXXXXXXXXXXXXXXXXXXXXXXXXXXXXXXXXXXXCVVKPVDDRFXXALFALNDMGKXXXXXXQWEPSKGWSDWTQVPFCSXXXXXXXXXXXXXXXXXXXXXXXXXXXXXXXXXXXXXXXXXXXLGKAYAQMWALMYXXXXXXXXXXXXXXXXXXXXXXXXXXXXXXXXXXXEWMTTEDMLTXXXXXXXXXXXXXXXXXXXXXXXEIPYLGKREDXXXXXXXGLTARATWASNIXXXXXXXXXXXXXXXXXDYMPVMRRYSXXXXXXXXXX

SEQ ID NO: 265872 - protein, 3402 aa, Dengue virus
  MOD_RES (1)..(10): Any amino acid
  MOD_RES (26)..(27): Any amino acid
  MOD_RES (39)..(39): Any amino acid
  MOD_RES (71)..(114): Any amino acid
  MOD_RES (129)..(130): Any amino acid
  MOD_RES (143)..(145): Any amino acid
  MOD_RES (158)..(173): Any amino acid
  MOD_RES (187)..(197): Any amino acid
  MOD_RES (234)..(236): Any amino acid
  MOD_RES (248)..(280): Any amino acid
  MOD_RES (329)..(348): Any amino acid
  MOD_RES (361)..(375): Any amino acid
  MOD_RES (400)..(462): Any amino acid
  MOD_RES (480)..(483): Any amino acid
  MOD_RES (501)..(514): Any amino acid
  MOD_RES (552)..(558): Any amino acid
  MOD_RES (573)..(645): Any amino acid
  MOD_RES (657)..(682): Any amino acid
  MOD_RES (709)..(722): Any amino acid
  MOD_RES (734)..(784): Any amino acid
  MOD_RES (824)..(827): Any amino acid
  MOD_RES (847)..(927): Any amino acid
  MOD_RES (946)..(953): Any amino acid
  MOD_RES (983)..(999): Any amino acid
  MOD_RES (1021)..(1040): Any amino acid
  MOD_RES (1053)..(1066): Any amino acid
  MOD_RES (1114)..(1346): Any amino acid
  MOD_RES (1402)..(1425): Any amino acid
  MOD_RES (1439)..(1439): Any amino acid
  MOD_RES (1455)..(1476): Any amino acid
  MOD_RES (1489)..(1518): Any amino acid
  MOD_RES (1537)..(1537): Any amino acid
  MOD_RES (1562)..(1564): Any amino acid
  MOD_RES (1588)..(1595): Any amino acid
  MOD_RES (1618)..(1618): Any amino acid
  MOD_RES (1645)..(1659): Any amino acid
  MOD_RES (1799)..(1808): Any amino acid
  MOD_RES (1826)..(1830): Any amino acid
  MOD_RES (1875)..(1875): Any amino acid
  MOD_RES (1943)..(1943): Any amino acid
  MOD_RES (2030)..(2045): Any amino acid
  MOD_RES (2096)..(2116): Any amino acid
  MOD_RES (2131)..(2134): Any amino acid
  MOD_RES (2154)..(2195): Any amino acid
  MOD_RES (2238)..(2245): Any amino acid
  MOD_RES (2258)..(2277): Any amino acid
  MOD_RES (2362)..(2365): Any amino acid
  MOD_RES (2493)..(2503): Any amino acid
  MOD_RES (2517)..(2525): Any amino acid
  MOD_RES (2544)..(2549): Any amino acid
  MOD_RES (2570)..(2570): Any amino acid
  MOD_RES (2628)..(2633): Any amino acid
  MOD_RES (2671)..(2674): Any amino acid
  MOD_RES (2691)..(2699): Any amino acid
  MOD_RES (2723)..(2728): Any amino acid
  MOD_RES (2744)..(2750): Any amino acid
  MOD_RES (2767)..(2788): Any amino acid
  MOD_RES (2864)..(2899): Any amino acid
  MOD_RES (2925)..(2938): Any amino acid
  MOD_RES (3019)..(3024): Any amino acid
  MOD_RES (3046)..(3064): Any amino acid
  MOD_RES (3084)..(3084): Any amino acid
  MOD_RES (3127)..(3154): Any amino acid
  MOD_RES (3177)..(3181): Any amino acid
  MOD_RES (3225)..(3225): Any amino acid
  MOD_RES (3287)..(3288): Any amino acid
  MOD_RES (3321)..(3337): Any amino acid
  MOD_RES (3366)..(3402): Any amino acid
XXXXXXXXXXPPFNMLKRERNRVSTXXQLAKRFSKGLLXGQGPMKLVMAFIAFLRFLAIPPTAGILKRWGXXXXXXXXXXXXXXXXXXXXXXXXXXXXXXXXXXXXXXXXXXXXFHLTTRNGEPHMIVXXQERGKSLLFKTAXXXNMCTLIAMDLGEXXXXXXXXXXXXXXXXEPEDIDCWCNLTSXXXXXXXXXXXGEHRRDKRSVALAPHVGMGLETRTETWMSSEGAWKHXXXVETWALRHPGFXXXXXXXXXXXXXXXXXXXXXXXXXXXXXXXXXMRCVGVGNRDFVEGLSGATWVDVVLEHGGCVTTMAKNKPTLDFELIKTXXXXXXXXXXXXXXXXXXXXTTDSRCPTQGEAXXXXXXXXXXXXXXXFVDRGWGNGCGLFGKGSLVTCAKFXXXXXXXXXXXXXXXXXXXXXXXXXXXXXXXXXXXXXXXXXXXXXXXXXXXXXXXXXXXXXXXLECSPRTGLDFNEMVLLXXXXKSWLVHKQWFLDLPLPWXXXXXXXXXXXXXXDLLVTFKTAHAKKQEVVVLGSQEGAMHTALTGATEIQXXXXXXXFAGHLKCRLKMDKLXXXXXXXXXXXXXXXXXXXXXXXXXXXXXXXXXXXXXXXXXXXXXXXXXXXXXXXXXXXXXXXXXXXXXXXXXNIEAEPPFGESXXXXXXXXXXXXXXXXXXXXXXXXXXEATARGARRMAILGDTAWDFGSVGGVXXXXXXXXXXXXXXAYGVLFSGVSWXXXXXXXXXXXXXXXXXXXXXXXXXXXXXXXXXXXXXXXXXXXXXXXXXXXGRELKCGSGIFVTNEVHTWTEQYKFQADSPSKLASAIQKXXXXGVCGIRSVTRLENIMWKQIXXXXXXXXXXXXXXXXXXXXXXXXXXXXXXXXXXXXXXXXXXXXXXXXXXXXXXXXXXXXXXXXXXXXXXXXXXXXXXXXXWEVEDYGFGVFTTNIWLKXXXXXXXXCDHRLMSAAIKDSKAVHADMGYWIESSKNXXXXXXXXXXXXXXXXXWPKSHTLWSNGVLESEMIIPKXXXXXXXXXXXXXXXXXXXXGPWHLGKLELDFXXXXXXXXXXXXXXGNRGPSLRTTTASGKLIHEWCCRSCTMPPLRFRGEDGCWYGMEIRPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEGIMAVGMVSILASALLKNDIPMTGPLVAGGLLTVCYVLSGSSADLSLEKXXXXXXXXXXXXXXXXXXXXXXXXEDGSMSIKNEEEEXMLTILIRTGLLVISGXXXXXXXXXXXXXXXXXXXXXXAGVLWDVPSPPPXXXXXXXXXXXXXXXXXXXXXXXXXXXXXXEGVFHTMWHVTRGSVICHXGGRLEPSWASVKKDLISYGGGWRLXXXWKEGEEVQVIALEPGKNPRAVQTXXXXXXXXTGTIGAIALDFKPGTSGSPIINXKGKVVGLYGNGVVTKSGDYVSAITQAXXXXXXXXXXXXXXXFRKRRLTIMDLHPGAGKTKRYLPAIVREALKRRLRTLILAPTRVVAAEMEEALRGLPIRYQTPAVKSEHTGREIVDLMCHATFTMRLLSPVRVPNYNLIIMDEAHFTDPASIAARGYISTRVGMGEAAAIFMTATPPGSXXXXXXXXXXIQDEEREIPERSWNTGFXXXXXFKGKTVWFVPSIKAGNDIANCLRKNGKKVIQLSRKTFDTEYQKTXLNDWDFVVTTDISEMGANFRADRVIDPRRCLKPVILTDGPERVILAGPMPVTVASAAQRRGRIGRNPXNENDQYIYMGQPLNNDEDHAHWTEAKMLLDNINTPEGIIPALFEPEREKSQAIDGEYRLRGEARKTFVELMRRGDLPVWLSYKVASXXXXXXXXXXXXXXXXNNQILEENMDVEIWTKEGERKKLRPRWLDARVYSDPLALKEFKEFAAGRKXXXXXXXXXXXXXXXXXXXXXKLALDNIVMLHTTEXXXXAYQHALSELPETLETLLLLXXXXXXXXXXXXXXXXXXXXXXXXXXXXXXXXXXXXXXXXXXQPHWIAASIILEFFLMVLLIPEPEKQRTPQDNQLTYVVIAILXXXXXXXXNEMGFLEKTKKDXXXXXXXXXXXXXXXXXXXXLDVDLRPASAWTLYAVATTVLTPMLRHSIENSSVNVSLTAIANQAAVLMGLGKGWPLSKMDLGVPLLALGCYSQVNPLTLTAAVXXXXAHYAIIGPGLQAKATREAQKRTAAGIMKNPTVDGITVIDLEPIPYDPKFEKQLGQVMLLVLCVTQVLLMRTTWALCEALTLATGPITTLWEGNPGKFWNTTIAVSMANIFRGSYLAGAGLAFSLIKNXXXXXXXXXXXGETLGEKWKRQLNXXXXXXXXXYKKSGIQEVDRTLAKEGIXXXXXXHHAVSRGSAKLRWFVERNLVXPKGKVVDLGCGRGGWSYYCAGLKKVTEVKGYTKGGPGHEEPIPMATYGWNLVKLHSGXXXXXXPPEKCDTLLCDIGESSSNPTIEEGRTLRVLKMVEPWLXXXXQFCIKVLNPYMPTVIEXXXXXXXXXGGMLVRNPLSRNSTHEMYWVSNAXXXXXXSVNMISRMLINRFTMXXXXXXXEPDVDLGAGTRSVSTEXXXXXXXXXXXXXXXXXXXXXXSWHYDQENPYKTWAYHGSYETKQTGSASSMVNGVVKLLTKPWDVIPMVTQMAMTDTTPFGQQRVFKEKVDTRTPRXXXXXXXXXXXXXXXXXXXXXXXXXXXXXXXXXXXXKVRSNAAIGAVFTDENKWKSAREAVXXXXXXXXXXXXXXLHQEGKCETCVYNMMGKREKKLGEFGKAKGSRAIWYMWLGARFLEFEALGFLNEDHWFSRENSLSGVEGEGLHKLGYILRXXXXXXGGAMYADDTAGWDTRITEDDLXXXXXXXXXXXXXXXXXXXAIFKLTYQNKVVKVLRPTPXGTVMDIISRKDQRGSGQVGTYGLNTFTNMEAQLIRQMEGEGVXXXXXXXXXXXXXXXXXXXXXXXXXXXXERLKRMAISGDDCVVKPIDDRFXXXXXALNDMGKVRKDIPQWEPSKGWKDWQQVPFCSHHFHELIMKDGRXLVVPCRNQDELIGRARISQGAGWSLRETACLGKAYAQMWSLMYFHRRDLRLAANAICSAVPXXWVPTSRTTWSIHAHHQWMTTEDMLTVWNRVWIXXXXXXXXXXXXXXXXXVPYLGKREDQWCGSLIGLTSRATWAKNIXXXXXXXXXXXXXXXXXXXXXXXXXXXXXXXXXXXXX

SEQ ID NO: 265873 - protein, 3402 aa, Dengue virus
  MOD_RES (1)..(10): Any amino acid
  MOD_RES (26)..(27): Any amino acid
  MOD_RES (39)..(39): Any amino acid
  MOD_RES (71)..(114): Any amino acid
  MOD_RES (129)..(130): Any amino acid
  MOD_RES (143)..(145): Any amino acid
  MOD_RES (158)..(173): Any amino acid
  MOD_RES (187)..(197): Any amino acid
  MOD_RES (234)..(236): Any amino acid
  MOD_RES (248)..(280): Any amino acid
  MOD_RES (329)..(348): Any amino acid
  MOD_RES (361)..(375): Any amino acid
  MOD_RES (400)..(462): Any amino acid
  MOD_RES (480)..(483): Any amino acid
  MOD_RES (501)..(514): Any amino acid
  MOD_RES (552)..(558): Any amino acid
  MOD_RES (573)..(645): Any amino acid
  MOD_RES (657)..(682): Any amino acid
  MOD_RES (709)..(722): Any amino acid
  MOD_RES (734)..(784): Any amino acid
  MOD_RES (824)..(827): Any amino acid
  MOD_RES (847)..(927): Any amino acid
  MOD_RES (946)..(953): Any amino acid
  MOD_RES (983)..(999): Any amino acid
  MOD_RES (1021)..(1040): Any amino acid
  MOD_RES (1053)..(1066): Any amino acid
  MOD_RES (1114)..(1346): Any amino acid
  MOD_RES (1402)..(1425): Any amino acid
  MOD_RES (1439)..(1439): Any amino acid
  MOD_RES (1455)..(1476): Any amino acid
  MOD_RES (1489)..(1518): Any amino acid
  MOD_RES (1537)..(1537): Any amino acid
  MOD_RES (1562)..(1564): Any amino acid
  MOD_RES (1588)..(1595): Any amino acid
  MOD_RES (1618)..(1618): Any amino acid
  MOD_RES (1645)..(1659): Any amino acid
  MOD_RES (1799)..(1808): Any amino acid
  MOD_RES (1826)..(1830): Any amino acid
  MOD_RES (1875)..(1875): Any amino acid
  MOD_RES (1943)..(1943): Any amino acid
  MOD_RES (2030)..(2045): Any amino acid
  MOD_RES (2096)..(2116): Any amino acid
  MOD_RES (2131)..(2134): Any amino acid
  MOD_RES (2154)..(2195): Any amino acid
  MOD_RES (2238)..(2245): Any amino acid
  MOD_RES (2258)..(2277): Any amino acid
  MOD_RES (2362)..(2365): Any amino acid
  MOD_RES (2493)..(2503): Any amino acid
  MOD_RES (2517)..(2525): Any amino acid
  MOD_RES (2544)..(2549): Any amino acid
  MOD_RES (2570)..(2570): Any amino acid
  MOD_RES (2628)..(2633): Any amino acid
  MOD_RES (2671)..(2674): Any amino acid
  MOD_RES (2691)..(2699): Any amino acid
  MOD_RES (2723)..(2728): Any amino acid
  MOD_RES (2744)..(2750): Any amino acid
  MOD_RES (2767)..(2788): Any amino acid
  MOD_RES (2850)..(2851): Any amino acid
  MOD_RES (2864)..(2899): Any amino acid
  MOD_RES (2925)..(2938): Any amino acid
  MOD_RES (3019)..(3024): Any amino acid
  MOD_RES (3046)..(3064): Any amino acid
  MOD_RES (3084)..(3084): Any amino acid
  MOD_RES (3127)..(3154): Any amino acid
  MOD_RES (3177)..(3181): Any amino acid
  MOD_RES (3225)..(3225): Any amino acid
  MOD_RES (3287)..(3288): Any amino acid
  MOD_RES (3321)..(3337): Any amino acid
  MOD_RES (3366)..(3402): Any amino acid
XXXXXXXXXXPSFNMLKRARNRVSTXXGLVKRFSTGLFXGKGPLRMVLAFITFLRVLSIPPTAGVLARWGXXXXXXXXXXXXXXXXXXXXXXXXXXXXXXXXXXXXXXXXXXXXFHLTSRDGEPRMIVXXQERGKSLLFKTSXXXNKCTLIAMDLGEXXXXXXXXXXXXXXXXEPEDIDCWCNSTSXXXXXXXXXXXGEHRREKRSVALVPHVGMGLETRAQTWMSAEGAWRQXXXVESWILRNPGFXXXXXXXXXXXXXXXXXXXXXXXXXXXXXXXXXMRCIGVGNRDFVEGVSGGTWVDVVLEHGSCVTTMAQGKPTLDIELLKTXXXXXXXXXXXXXXXXXXXXTTATRCPTQGEPXXXXXXXXXXXXXXXYVDRGWGNGCGLFGKGGVVTCAKFXXXXXXXXXXXXXXXXXXXXXXXXXXXXXXXXXXXXXXXXXXXXXXXXXXXXXXXXXXXXXXXLDCEPRTGLDFNEMILLXXXXKAWMVHRQWFFDLPLPWXXXXXXXXXXXXXXELLVTFKNPHAKRQDVTVLGSQEGAMHSALAGATEVDXXXXXXXFAGHLKCKVRMEKLXXXXXXXXXXXXXXXXXXXXXXXXXXXXXXXXXXXXXXXXXXXXXXXXXXXXXXXXXXXXXXXXXXXXXXXXXNIELEPPFGDSXXXXXXXXXXXXXXXXXXXXXXXXXXESTYRGAKRMAILGDTAWDFGSIGGVXXXXXXXXXXXXXXAYTALFSGVSWXXXXXXXXXXXXXXXXXXXXXXXXXXXXXXXXXXXXXXXXXXXXXXXXXXXGKELKCGSGIFITDNVHTWTEQYKFQPESPKRLSAAIGKXXXXGICGIRSTTRLENLMWKQIXXXXXXXXXXXXXXXXXXXXXXXXXXXXXXXXXXXXXXXXXXXXXXXXXXXXXXXXXXXXXXXXXXXXXXXXXXXXXXXXXWEVEDYGFGIFTTNIWLKXXXXXXXXCDSKLMSAAIKDQRAVHADMGYWIESEKNXXXXXXXXXXXXXXXXXWPKTHTLWSNGVLESDMIIPKXXXXXXXXXXXXXXXXXXXXGPWHLGKLEIDFXXXXXXXXXXXXXXGTRGPSLRTTTASGKLVTQWCCRSCTLPPLRYLGEDGCWYGMEIRPVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEGVMAVGLVSLLGSSLLKNDVPLAGPMVAGGLLLAAYVMTGRSADLELERXXXXXXXXXXXXXXXXXXXXXXXXDDGTMKIKDEERDXTITLLVKLALITVSGXXXXXXXXXXXXXXXXXXXXXXSGALWDVPSPAAXXXXXXXXXXXXXXXXXXXXXXXXXXXXXXEGTFHTMWHVTRGAVLMHXTKRIEPSWADVRKDLISYGGGWKLXXXWDKGEEVQVLAIEPGKNPKHVQTXXXXXXXXEGEIGAVSLDFKPGTSGSPIVNXKGKVIGLYGNGVVTTSGTYVSAIAQAXXXXXXXXXXXXXXXFKKKNLTIMDLHPGAGKTKRILPSIVREAIKRGLRTLILAPTRVVASEMAEALKGMPIRYQTTAVKSEHTGKEIVDLMCHATFTTRLLSSTRVPNYNLIVMDEAHFTDPSSVAARGYISTRVEMGEAAGIFMTATPPGSXXXXXXXXXXIEDIEREIPERSWNSGHXXXXXYQGKTVWFVPSIKAGNDIAACLRKNGKRVIQLSRKTFDTEYPKTXNTDWDYVVTTDISEMGANFRAERVIDPRRCMKPVILTDGPERVILAGPIPVTPSSAAQRRGRVGRNPXQEDDQYVFMGEPLENDEDCAHWKEAKMLLDNINTPEGIIPSMFEPEREKVDAIDGEFRLRGEQRKTFVDLMRRGDLPVWLAHKVASXXXXXXXXXXXXXXXXNNQVLEENMEVEIWTKEGEKKKLKPRWLDARIYADPMALKDFKEFASGRKXXXXXXXXXXXXXXXXXXXXXQNALDNLAVLHTAEXXXXAYNHALNELPESLETLMLVXXXXXXXXXXXXXXXXXXXXXXXXXXXXXXXXXXXXXXXXXXQPQWIAASIILEFFLIVLLIPEPDRQRTPQDNQLAYVVIGLLXXXXXXXXNEMGLLETTKKDXXXXXXXXXXXXXXXXXXXXLDVDLHPASAWTLYAVATTIITPMLRHTIENTSANLSLAAIANQAAILMGLDKGWPLHRMDIGVPLLAIGCYSQVNPITLTAALXXXXVHYAIIGPGLQAKATREAQKRAAAGIMKNPTVDGIVAIDLDPISYDAKFEKQLGQIMLLILCTGQLLMMRTTWALCESITLATGPLSTLWEGSPGRFWNTTIAVSTANIFRGSYLAGAGLLFSIMKNXXXXXXXXXXXGETLGEKWKSRLNXXXXXXXXXYKRSGILEVDRTEAKSALXXXXXXKHAVSRGSSKLRWFVERNMVXPEGKVIDLGCGRGGWSYYMATLKNVREVKGLTKGGPGHEEPIPMSTYGWNLVRLQSGXXXXXXPTEQVDTLLCDIGESSPSPTVEAGRTLRVLNLVENWLXXXXEFCIKVLNPYMPSVIEXXXXXXXXXGGALVRCPLSRNSTHEMYWVSCGXXXXXXAVNMTSRMLLNRFTMXXXXXXXEKDVDLGSGTRNIGIEXXXXXXXXXXXXXXXXXXXXXXTWHYDQDNPYRTWAYHGSYEAPSSGSASSMVNGVVKLLTKPWDVVPMVTQLAMTDTTPFGQXXVFKEKVDTRTPQXXXXXXXXXXXXXXXXXXXXXXXXXXXXXXXXXXXXKVRSNAALGAIFQEEQGWTSASEAVXXXXXXXXXXXXXXLHLEGKCESCVYNMMGKREKKLGEFGRAKGSRAIWYMWLGARFLEFEALGFMNEDHWFGRENSWSGVEGEGLHRLGYILEXXXXXXGGNIYADDTAGWDTRITLEDLXXXXXXXXXXXXXXXXXXXSIFKLTYQNKVVRVQRPTPXGAVMDVISRRDQRGSGQVVTYGLNTFTNMEVQLIRQMEAEGVXXXXXXXXXXXXXXXXXXXXXXXXXXXXDRLSRMAISGDDCVVKPLDERFXXXXXFLNDMGKVRKDIPQWEPSKGWNDWTEVPFCSHHFHKIFMKDGRXIVVPCRNQDELVGRARVSQGAGWSLRETACLGKSYAQMWQLMYFHRRDLRLASMAICSAVPXXWFPTSRTTWSIHAKHQWMTTEDMLKVWNRVWIXXXXXXXXXXXXXXXXXIPYLGKREDLWCGSLIGLSSRATWAKNIXXXXXXXXXXXXXXXXXXXXXXXXXXXXXXXXXXXXX

SEQ ID NO: 265874 - protein, 3402 aa, Dengue virus
  MOD_RES (1)..(10): Any amino acid
  MOD_RES (26)..(27): Any amino acid
  MOD_RES (39)..(39): Any amino acid
  MOD_RES (71)..(114): Any amino acid
  MOD_RES (129)..(130): Any amino acid
  MOD_RES (143)..(145): Any amino acid
  MOD_RES (158)..(173): Any amino acid
  MOD_RES (187)..(197): Any amino acid
  MOD_RES (234)..(236): Any amino acid
  MOD_RES (248)..(280): Any amino acid
  MOD_RES (329)..(348): Any amino acid
  MOD_RES (361)..(375): Any amino acid
  MOD_RES (400)..(462): Any amino acid
  MOD_RES (480)..(483): Any amino acid
  MOD_RES (501)..(514): Any amino acid
  MOD_RES (552)..(558): Any amino acid
  MOD_RES (573)..(645): Any amino acid
  MOD_RES (657)..(682): Any amino acid
  MOD_RES (709)..(722): Any amino acid
  MOD_RES (734)..(784): Any amino acid
  MOD_RES (824)..(827): Any amino acid
  MOD_RES (847)..(927): Any amino acid
  MOD_RES (946)..(953): Any amino acid
  MOD_RES (983)..(999): Any amino acid
  MOD_RES (1021)..(1040): Any amino acid
  MOD_RES (1053)..(1066): Any amino acid
  MOD_RES (1114)..(1346): Any amino acid
  MOD_RES (1402)..(1425): Any amino acid
  MOD_RES (1439)..(1439): Any amino acid
  MOD_RES (1455)..(1476): Any amino acid
  MOD_RES (1489)..(1518): Any amino acid
  MOD_RES (1537)..(1537): Any amino acid
  MOD_RES (1562)..(1564): Any amino acid
  MOD_RES (1588)..(1595): Any amino acid
  MOD_RES (1618)..(1618): Any amino acid
  MOD_RES (1645)..(1659): Any amino acid
  MOD_RES (1737)..(1739): Any amino acid
  MOD_RES (1799)..(1808): Any amino acid
  MOD_RES (1826)..(1830): Any amino acid
  MOD_RES (1875)..(1875): Any amino acid
  MOD_RES (1943)..(1943): Any amino acid
  MOD_RES (2030)..(2045): Any amino acid
  MOD_RES (2096)..(2116): Any amino acid
  MOD_RES (2131)..(2134): Any amino acid
  MOD_RES (2154)..(2195): Any amino acid
  MOD_RES (2238)..(2245): Any amino acid
  MOD_RES (2258)..(2277): Any amino acid
  MOD_RES (2362)..(2365): Any amino acid
  MOD_RES (2377)..(2390): Any amino acid
  MOD_RES (2472)..(2478): Any amino acid
  MOD_RES (2493)..(2503): Any amino acid
  MOD_RES (2517)..(2525): Any amino acid
  MOD_RES (2544)..(2549): Any amino acid
  MOD_RES (2570)..(2570): Any amino acid
  MOD_RES (2628)..(2633): Any amino acid
  MOD_RES (2671)..(2674): Any amino acid
  MOD_RES (2691)..(2699): Any amino acid
  MOD_RES (2723)..(2728): Any amino acid
  MOD_RES (2744)..(2750): Any amino acid
  MOD_RES (2767)..(2788): Any amino acid
  MOD_RES (2850)..(2852): Any amino acid
  MOD_RES (2864)..(2899): Any amino acid
  MOD_RES (2925)..(2938): Any amino acid
  MOD_RES (2957)..(2979): Any amino acid
  MOD_RES (3019)..(3024): Any amino acid
  MOD_RES (3046)..(3068): Any amino acid
  MOD_RES (3084)..(3084): Any amino acid
  MOD_RES (3127)..(3154): Any amino acid
  MOD_RES (3177)..(3181): Any amino acid
  MOD_RES (3225)..(3225): Any amino acid
  MOD_RES (3287)..(3288): Any amino acid
  MOD_RES (3321)..(3337): Any amino acid
  MOD_RES (3366)..(3402): Any amino acid
XXXXXXXXXXPSINMLKRVRNRVSTXXQLTKRFSLGMLXGRGPLKLFMALVAFLRFLAIPPTAGILARWGXXXXXXXXXXXXXXXXXXXXXXXXXXXXXXXXXXXXXXXXXXXXFHLTTRGGEPHMIVXXNEKGKSLLFKTEXXXNMCTLMAIDLGEXXXXXXXXXXXXXXXXEPDDVDCWCNATDXXXXXXXXXXXGERRREKRSVALAPHVGLGLDTRTETWMSSEGAWKQXXXIETWILRHPGFXXXXXXXXXXXXXXXXXXXXXXXXXXXXXXXXXMRCVGISSRDFVEGVSGGAWVDLVLEHGGCVTTIAKNKPTLDIELQKTXXXXXXXXXXXXXXXXXXXXTTESRCPTQGEPXXXXXXXXXXXXXXXMVDRGWGNGCGLFGKGGIVTCAMFXXXXXXXXXXXXXXXXXXXXXXXXXXXXXXXXXXXXXXXXXXXXXXXXXXXXXXXXXXXXXXXLDCSPRSGIDFNEMILMXXXXKTWLVHRQWFLDLPLPWXXXXXXXXXXXXXXERMVTFKVPHAKKQDVVVLGSQEGAMHSALTGATEVDXXXXXXXFTGHLKCRLRMDKLXXXXXXXXXXXXXXXXXXXXXXXXXXXXXXXXXXXXXXXXXXXXXXXXXXXXXXXXXXXXXXXXXXXXXXXXXNIEAEPPFGDSXXXXXXXXXXXXXXXXXXXXXXXXXXETTMRGAKRMAILGETAWDFGSVGGLXXXXXXXXXXXXXXVYTTMFGGVSWXXXXXXXXXXXXXXXXXXXXXXXXXXXXXXXXXXXXXXXXXXXXXXXXXXXNKELKCGSGIFVVDNVHTWTEQYKFQPESPARLASAILNXXXXGVCGIRSTTRLENVMWKQIXXXXXXXXXXXXXXXXXXXXXXXXXXXXXXXXXXXXXXXXXXXXXXXXXXXXXXXXXXXXXXXXXXXXXXXXXXXXXXXXXLEVEDYGFGMFTTNIWMKXXXXXXXXCDHRLMSAAVKDERAVHADMGYWIESQKNXXXXXXXXXXXXXXXXXWPRSHTLWSNGVLESQMLIPKXXXXXXXXXXXXXXXXXXXXGPWHLGKLEMDFXXXXXXXXXXXXXXDHRGPSLRTTTVTGKIITEWCCRSCTLPPLRYMGEDGCWYGMEIRPIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEAIMAVGLVSILLSSLLKNDVPLAGPLIAGGMLIACYVITGTSADLTVEKXXXXXXXXXXXXXXXXXXXXXXXXEDGSFSIRDVEETXTLTILLKATLLAVSGXXXXXXXXXXXXXXXXXXXXXXSGVLWDTPSPPEXXXXXXXXXXXXXXXXXXXXXXXXXXXXXXENVFHTMWHVTRGAVLMYXGKRLEPSWADVKNDMISYGGGWRLXXXWNTEEDVQVLAVEPGKNPKNVQTXXXXXXXXTGEVGAVTLDFSPGTSGSPIVDXEGKIVGLYGNGVVTRSGAYVSAIAQTXXXXXXXXXXXXXXXFRKRRLTIMDLHPGSGKTRKYLPAIIREAIKRKLRTLILAPTRVVAAEMEEALKGLPIRYQTPAIRAEHTGREIVDLXXXATFTMRLLSPVRVPNYNMVIMDEAHFTDPSSIAARGYISTRVEMGEAAAIFMTATPPGTXXXXXXXXXXIMDEERDIPERSWNSGYXXXXXFPGKTVWFVPSIKSGNDIANCLRKSGKKVIQLSRKTFDSEYVKTXLNDWDYVVTTDISEMGANFKAGRVIDPRRCLKPVILKDGEERVILAGPMPVTHASAAQRRGRIGRNHXKENDQYIYSGDPLKNDEDHAHWTEAKMLLDNIYTPEGIIPTLFGPEREKTAAIDGEYRLRGEARKTFVELMRRGDLPVWLAYKVAAXXXXXXXXXXXXXXXXNNQILEENVEVEIWTKEGERKKLRPRWLDARTYSDPLALREFKEFAAGRRXXXXXXXXXXXXXXXXXXXXXRNALDNLVMLHNSEXXXXAYRHAMEELPDTIETLMLLXXXXXXXXXXXXXXXXXXXXXXXXXXXXXXXXXXXXXXXXXXELQWIASAIVLEFFLMVLLVPEPEKQRTPQDNQLIYVILTILXXXXXXXXNEMGLIEKTKTDXXXXXXXXXXXXXXXXXXXXLDIDLRPASAWTLYAVATTFITPMMRHTIENTTANISLTAIANQAVVLMGLDKGWPISKMDIGVPLLAMGCYSQVNPTTLTASLXXXXTHYAIIGPGLQXXXXXXXXXXXXXXIMKNPTVDGIMTIDLDPVVYDSKFEKQLGQVMLLILCASQILLMRTTWAFCEVLTLATGPILTLWEGNPGRFWNTTIAVSMXXXXXXXYLAGAGLAFSLMKSXXXXXXXXXXXGETLGEKWKKKLNXXXXXXXXXYKRSGIMEVDRSEAKEGLXXXXXXKHAVSRGTAKLQWFVERNMVXPEGRVIDLGCGRGGWSYYCGGLKNVTEVRGFTKGGPGHEEPVPMSTYGWNIVKLMSGXXXXXXPPERCDTLLCDIGESSPNPTIEESRTIRVLKMVEPWLXXXXQFCIKILNPYMPSVVEXXXXXXXXXGGNLIRCPLSRNSTHEMYWVSGAXXXXXXSVNMVSRLLLNRFTMXXXXXXXEKDVDLGAGTRHVAVEXXXXXXXXXXXXXXXXXXXXXXTWHYDEDHPYKTWAYHGSYEVKPTGSASSMINGVVRLLTKPWDVLPMVTQIAMTDTTPFGQXXXFKEKVDTRTQEXXXXXXXXXXXXXXXXXXXXXXXXXXXXXXXXXXXXKVRSNAAIGAVFVDENQWNSAKEAVXXXXXXXXXXXXXXLHKQGKCATCVYNMMGKRXXXXXXXXXXXXXXXXXXXXXXXRYLEFEALGFLNEDHWFSRENSYSGVEGEGLHRLGYILRXXXXXXGDLMYADDTAGWDTRITIEDLXXXXXXXXXXXXXXXXXXXXXXXLTYQNKVVRVQRPAKXGTVMDIISRRDQRGSGQVVTYSLNTFTNMEAQLIRQMESEGIXXXXXXXXXXXXXXXXXXXXXXXXXXXXERLRRMAISGDDCVVKPLDDRFXXXXXALNDMGKVRKDIQQWQPSKGWNNWQQVPFCSHHFHQLIMKDGRXLVVPCRPQDELIGRARISQGAGWSLKETACLGKSYAQMWTLMYFHRRDLRLASNAICSAVPXXWIPTSRTTWSIHATHQWMTTEDMLSVWNRVWIXXXXXXXXXXXXXXXXXIPYLGKREDQWCGSLIGLTSRATWAQNIXXXXXXXXXXXXXXXXXXXXXXXXXXXXXXXXXXXXX

SEQ ID NO: 265875 - protein, 3402 aa, Dengue virus
  MOD_RES (1)..(10): Any amino acid
  MOD_RES (22)..(27): Any amino acid
  MOD_RES (39)..(39): Any amino acid
  MOD_RES (71)..(114): Any amino acid
  MOD_RES (129)..(130): Any amino acid
  MOD_RES (143)..(145): Any amino acid
  MOD_RES (158)..(173): Any amino acid
  MOD_RES (187)..(197): Any amino acid
  MOD_RES (234)..(236): Any amino acid
  MOD_RES (248)..(280): Any amino acid
  MOD_RES (314)..(314): Any amino acid
  MOD_RES (329)..(348): Any amino acid
  MOD_RES (361)..(375): Any amino acid
  MOD_RES (400)..(462): Any amino acid
  MOD_RES (480)..(483): Any amino acid
  MOD_RES (501)..(514): Any amino acid
  MOD_RES (552)..(558): Any amino acid
  MOD_RES (573)..(645): Any amino acid
  MOD_RES (657)..(682): Any amino acid
  MOD_RES (709)..(722): Any amino acid
  MOD_RES (734)..(784): Any amino acid
  MOD_RES (824)..(827): Any amino acid
  MOD_RES (847)..(927): Any amino acid
  MOD_RES (946)..(953): Any amino acid
  MOD_RES (983)..(1006): Any amino acid
  MOD_RES (1021)..(1040): Any amino acid
  MOD_RES (1053)..(1066): Any amino acid
  MOD_RES (1110)..(1346): Any amino acid
  MOD_RES (1402)..(1425): Any amino acid
  MOD_RES (1439)..(1439): Any amino acid
  MOD_RES (1455)..(1476): Any amino acid
  MOD_RES (1489)..(1518): Any amino acid
  MOD_RES (1537)..(1537): Any amino acid
  MOD_RES (1562)..(1564): Any amino acid
  MOD_RES (1588)..(1595): Any amino acid
  MOD_RES (1618)..(1618): Any amino acid
  MOD_RES (1645)..(1659): Any amino acid
  MOD_RES (1702)..(1711): Any amino acid
  MOD_RES (1737)..(1746): Any amino acid
  MOD_RES (1780)..(1787): Any amino acid
  MOD_RES (1799)..(1808): Any amino acid
  MOD_RES (1826)..(1830): Any amino acid
  MOD_RES (1875)..(1875): Any amino acid
  MOD_RES (1943)..(1943): Any amino acid
  MOD_RES (1968)..(1982): Any amino acid
  MOD_RES (2030)..(2045): Any amino acid
  MOD_RES (2096)..(2116): Any amino acid
  MOD_RES (2131)..(2134): Any amino acid
  MOD_RES (2154)..(2195): Any amino acid
  MOD_RES (2222)..(2224): Any amino acid
  MOD_RES (2238)..(2245): Any amino acid
  MOD_RES (2258)..(2287): Any amino acid
  MOD_RES (2362)..(2390): Any amino acid
  MOD_RES (2463)..(2479): Any amino acid
  MOD_RES (2493)..(2503): Any amino acid
  MOD_RES (2517)..(2525): Any amino acid
  MOD_RES (2544)..(2549): Any amino acid
  MOD_RES (2570)..(2570): Any amino acid
  MOD_RES (2583)..(2583): Any amino acid
  MOD_RES (2610)..(2610): Any amino acid
  MOD_RES (2628)..(2643): Any amino acid
  MOD_RES (2671)..(2674): Any amino acid
  MOD_RES (2691)..(2699): Any amino acid
  MOD_RES (2723)..(2728): Any amino acid
  MOD_RES (2744)..(2750): Any amino acid
  MOD_RES (2767)..(2788): Any amino acid
  MOD_RES (2822)..(2822): Any amino acid
  MOD_RES (2846)..(2852): Any amino acid
  MOD_RES (2864)..(2899): Any amino acid
  MOD_RES (2925)..(2938): Any amino acid
  MOD_RES (2957)..(2988): Any amino acid
  MOD_RES (3013)..(3024): Any amino acid
  MOD_RES (3038)..(3071): Any amino acid
  MOD_RES (3084)..(3084): Any amino acid
  MOD_RES (3097)..(3113): Any amino acid
  MOD_RES (3127)..(3154): Any amino acid
  MOD_RES (3177)..(3186): Any amino acid
  MOD_RES (3225)..(3248): Any amino acid
  MOD_RES (3276)..(3291): Any amino acid
  MOD_RES (3321)..(3352): Any amino acid
  MOD_RES (3366)..(3402): Any amino acid
XXXXXXXXXXTPFNMLKRERNXXXXXXQLAKRFSRGLLXGQGPMKMVMAFIAFLRFLTIPPTAGILARWSXXXXXXXXXXXXXXXXXXXXXXXXXXXXXXXXXXXXXXXXXXXXFHLSTRDGEPLMIVXXHERGRPLLFKTTXXXNMCTLMAMDLGEXXXXXXXXXXXXXXXXEPDDVDCWCNATEXXXXXXXXXXXGERRREKRSVALTPHSGMGLDTRAQTWMSSEGAWRQXXXVETWAFRHPGFXXXXXXXXXXXXXXXXXXXXXXXXXXXXXXXXXMRCVGIGSRDFVEGVSGGSWVDIVLEHGSCVTTXAKDKPTLDFELTKTXXXXXXXXXXXXXXXXXXXXTTASRCPTQGEPXXXXXXXXXXXXXXXVVDRGWGNGCGLFGKGSLITCAKFXXXXXXXXXXXXXXXXXXXXXXXXXXXXXXXXXXXXXXXXXXXXXXXXXXXXXXXXXXXXXXXMECSPRTSLDFNEMVLLXXXXKAWLVHKQWFLNLPLPWXXXXXXXXXXXXXXETLVTFKNPHAKRQDVIVLGSQEGAMRTALTGATEIQXXXXXXXFMGHLKCKVRMERLXXXXXXXXXXXXXXXXXXXXXXXXXXXXXXXXXXXXXXXXXXXXXXXXXXXXXXXXXXXXXXXXXXXXXXXXXNIETEPPFGESXXXXXXXXXXXXXXXXXXXXXXXXXXEATAKGARRMAILGDTAWDFGSLGGVXXXXXXXXXXXXXXIYGAAFSGVSWXXXXXXXXXXXXXXXXXXXXXXXXXXXXXXXXXXXXXXXXXXXXXXXXXXXGKELKCGSGIFVIDNVHTWTEQYQFQADSPKRLATAIAGXXXXGVCGIRSATRMENLLWKQIXXXXXXXXXXXXXXXXXXXXXXXXXXXXXXXXXXXXXXXXXXXXXXXXXXXXXXXXXXXXXXXXXXXXXXXXXXXXXXXXXLEVEDYGFGVFSTNIWLKXXXXXXXXCDSKLMSAAVKDNRAVHADMGYWIESALNXXXXXXXXXXXXXXXXXXXXXXXXWSNGVLESQMLIPRXXXXXXXXXXXXXXXXXXXXGPWHLGRLEMDFXXXXXXXXXXXXXXGHRGPSLRTTTVSGKLIHEWCCRSCTLPPLRFKGEDGCWYGMEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEGIMAIGIVSILASSLLRNDVPMAGPLVAGGLLIACYVITGRSADLELEKXXXXXXXXXXXXXXXXXXXXXXXXDDGTMRIKDDETEXILTVLLKTALLIVSGXXXXXXXXXXXXXXXXXXXXXXSGVLWDVPSPPEXXXXXXXXXXXXXXXXXXXXXXXXXXXXXXDGVFHTMWHVTRGAVLTYXGKRLEPNWANVKKDLISYGGGWRFXXXWQKGEEVQVIAVEPGKNPKNFQTXXXXXXXXTGEIGAIALDFSPGTSGSPIIDXEGKVVGLYGNGVVTKNGGYVSGIAQTXXXXXXXXXXXXXXXFRKRRLTIMDLHPGSGKTRKYLPAIVREAIKRKLRTLVLAPTXXXXXXXXXXLRGLPIRYQTTATKTEHTGREIVDLXXXXXXXXXXLSPIRVPNYNLVVMDEAHFTDPCSVAARGYISTXXXXXXXXAIFMTATPPGAXXXXXXXXXXIIDEEKDIPERSWNSGNXXXXXFAGKTVWFVPSIKTGNDIAACLRKSGKRVIQLSRKTFDSEYIKTXTNDWDFVVTTDISEMGANFKAERVIDPRRCLKPVILPDGPERVILAGPMPVTASSAAQRRGRIGRNQXKEGDQYIFTGDPLRNDEDHAHWTEXXXXXXXXXXXXXXXPTLFEPEREKSAAVDGEYRLKGESRKTFVELMKRGDLPVWLAYRVAAXXXXXXXXXXXXXXXXNNQILEENMDVEIWTREGEKKKLRPKWLDARTYSDPLALKEFKDFAAGRKXXXXXXXXXXXXXXXXXXXXXRDALDNLVMLHTSEXXXXAYRHAVEELPETMETLLLLXXXXXXXXXXXXXXXXXXXXXXXXXXXXXXXXXXXXXXXXXXPLQWIASAIILEFFMMVLLVPEPEKQXXXQDNQLAYVVIGILXXXXXXXXNEMGLLETTKRDXXXXXXXXXXXXXXXXXXXXXXXXXXXXXXWTLYAVATTIVTPMLRHTIENSTANVSLAAIANQATVLMGLGKGWPIHKMDLGVPLLALGCYSQVNPLTLIAAVXXXXXXXXXXXXXXXXXXXXXXXXXXXXXIMKNPTIDGITVIDLEPVIYDSKFEKQLGQVMLLVLCAVQLLLMRTSWALCEVLTLATGPVMTLWEGNPGRFXXXXXXXXXXXXXXXXXLAGAGLAFSIMKSXXXXXXXXXXXGETLGEKWKNRLNXXXXXXXXXYKKSGITEVDRTEAKEGLXXXXXXRHAVSRGSAKIRWIVERGMVXPEGRVIDLGCGRXGWSYYCGGLKNVKEVRGFTKGGPGHEXPVPMATYGWNLVKLYSGXXXXXXXXXXXXXXXXDIGESSPNPTVEAGRTLRVLSLVENWLXXXXQFCVKVLNPYMPAVIEXXXXXXXXXGGSLVRCPLSRNSTHEMYWISNGXXXXXXSVNTTSKMLLNRFTTXXXXXXXERDVDLGAGTRHVNAEXXXXXXXXXXXXXXXXXXXXXXTWHYDDENPYKTWAYHGSYEVKATGSASSMINGXVRLLTKPWDVVPTVTQMAMTDTTXXXXXXXFKEKVDTRTPKXXXXXXXXXXXXXXXXXXXXXXXXXXXXXXXXXXXXKVRTNAAMGAVFTEENQWDSAKAAVXXXXXXXXXXXXXXLHKLGKCGSCVYNMMGKRXXXXXXXXXXXXXXXXXXXXXXXXXXXXXXXXFLNEDHWFSRGNSLSGVEGEGLHRXXXXXXXXXXXXGDLIYADDTAGWDXXXXXXXXXXXXXXXXXXXXXXXXXXXXXXXXXXQNKVVKVQRPTPXGTVMDIISRRDQXXXXXXXXXXXXXXXXXEAQLIRQMEGEGIXXXXXXXXXXXXXXXXXXXXXXXXXXXXERLRRMAISGDDCVVKPTDDRFXXXXXXXXXXGKIRKDIQQWEPSRGWHDWQQVPFCSHHFHELVMKDGRXXXXXXXXXXXXXXXXXXXXXXXXSLKETACLGKSYAQMWALMYFHRRDLRXXXXXXXXXXXXXXXXTSRTTWSIHASHEWMTTEDMLAVWNRVWIXXXXXXXXXXXXXXXXXXXXXXXXXXXXXXXXIGLTARATWATNIXXXXXXXXXXXXXXXXXXXXXXXXXXXXXXXXXXXXX

SEQ ID NO: 265876 - protein, 3402 aa, Dengue virus
  MOD_RES (1)..(27): Any amino acid
  MOD_RES (39)..(39): Any amino acid
  MOD_RES (53)..(114): Any amino acid
  MOD_RES (129)..(131): Any amino acid
  MOD_RES (143)..(145): Any amino acid
  MOD_RES (158)..(175): Any amino acid
  MOD_RES (187)..(199): Any amino acid
  MOD_RES (221)..(236): Any amino acid
  MOD_RES (248)..(280): Any amino acid
  MOD_RES (297)..(298): Any amino acid
  MOD_RES (310)..(314): Any amino acid
  MOD_RES (326)..(349): Any amino acid
  MOD_RES (361)..(375): Any amino acid
  MOD_RES (400)..(462): Any amino acid
  MOD_RES (474)..(483): Any amino acid
  MOD_RES (498)..(515): Any amino acid
  MOD_RES (538)..(540): Any amino acid
  MOD_RES (552)..(558): Any amino acid
  MOD_RES (570)..(645): Any amino acid
  MOD_RES (657)..(682): Any amino acid
  MOD_RES (694)..(697): Any amino acid
  MOD_RES (709)..(722): Any amino acid
  MOD_RES (734)..(784): Any amino acid
  MOD_RES (798)..(801): Any amino acid
  MOD_RES (824)..(827): Any amino acid
  MOD_RES (847)..(927): Any amino acid
  MOD_RES (946)..(963): Any amino acid
  MOD_RES (983)..(1009): Any amino acid
  MOD_RES (1021)..(1066): Any amino acid
  MOD_RES (1078)..(1088): Any amino acid
  MOD_RES (1109)..(1346): Any amino acid
  MOD_RES (1375)..(1390): Any amino acid
  MOD_RES (1402)..(1425): Any amino acid
  MOD_RES (1439)..(1439): Any amino acid
  MOD_RES (1455)..(1477): Any amino acid
  MOD_RES (1489)..(1525): Any amino acid
  MOD_RES (1537)..(1537): Any amino acid
  MOD_RES (1553)..(1564): Any amino acid
  MOD_RES (1576)..(1595): Any amino acid
  MOD_RES (1607)..(1625): Any amino acid
  MOD_RES (1645)..(1673): Any amino acid
  MOD_RES (1701)..(1713): Any amino acid
  MOD_RES (1736)..(1747): Any amino acid
  MOD_RES (1761)..(1808): Any amino acid
  MOD_RES (1826)..(1830): Any amino acid
  MOD_RES (1843)..(1861): Any amino acid
  MOD_RES (1875)..(1875): Any amino acid
  MOD_RES (1923)..(1931): Any amino acid
  MOD_RES (1943)..(1943): Any amino acid
  MOD_RES (1963)..(1985): Any amino acid
  MOD_RES (2030)..(2060): Any amino acid
  MOD_RES (2072)..(2116): Any amino acid
  MOD_RES (2129)..(2134): Any amino acid
  MOD_RES (2147)..(2209): Any amino acid
  MOD_RES (2221)..(2225): Any amino acid
  MOD_RES (2238)..(2245): Any amino acid
  MOD_RES (2258)..(2287): Any amino acid
  MOD_RES (2309)..(2319): Any amino acid
  MOD_RES (2348)..(2349): Any amino acid
  MOD_RES (2362)..(2391): Any amino acid
  MOD_RES (2417)..(2425): Any amino acid
  MOD_RES (2463)..(2481): Any amino acid
  MOD_RES (2493)..(2525): Any amino acid
  MOD_RES (2537)..(2549): Any amino acid
  MOD_RES (2570)..(2570): Any amino acid
  MOD_RES (2583)..(2585): Any amino acid
  MOD_RES (2607)..(2614): Any amino acid
  MOD_RES (2628)..(2645): Any amino acid
  MOD_RES (2665)..(2676): Any amino acid
  MOD_RES (2691)..(2711): Any amino acid
  MOD_RES (2723)..(2728): Any amino acid
  MOD_RES (2744)..(2751): Any amino acid
  MOD_RES (2767)..(2788): Any amino acid
  MOD_RES (2802)..(2808): Any amino acid
  MOD_RES (2821)..(2822): Any amino acid
  MOD_RES (2839)..(2901): Any amino acid
  MOD_RES (2925)..(2938): Any amino acid
  MOD_RES (2953)..(2997): Any amino acid
  MOD_RES (3013)..(3113): Any amino acid
  MOD_RES (3127)..(3165): Any amino acid
  MOD_RES (3177)..(3194): Any amino acid
  MOD_RES (3214)..(3254): Any amino acid
  MOD_RES (3270)..(3302): Any amino acid
  MOD_RES (3315)..(3352): Any amino acid
  MOD_RES (3366)..(3402): Any amino acid
XXXXXXXXXXXXXXXXXXXXXXXXXXXGLVKRFSSGLFXGRGPLKLFMAFVAXXXXXXXXXXXXXXXXXXXXXXXXXXXXXXXXXXXXXXXXXXXXXXXXXXXXXXXXXXXXXXFSLTTRGGEPHMVVXXXEKGKSLLFKTKXXXNMCTLMALDLGEXXXXXXXXXXXXXXXXXXDDVDCWCNTTDXXXXXXXXXXXXXHRREKRSVALTPHSGTGLETRXXXXXXXXXXXXXXXXIETWVLRHPGFXXXXXXXXXXXXXXXXXXXXXXXXXXXXXXXXXMRCIGIGNRDFVEGLSXXTWVDLVLEHGGXXXXXAKSKPTLDIELXXXXXXXXXXXXXXXXXXXXXXXXTDSRCPTQGEPXXXXXXXXXXXXXXXLVDRGWGNGCGLFGKGSLLTCAKFXXXXXXXXXXXXXXXXXXXXXXXXXXXXXXXXXXXXXXXXXXXXXXXXXXXXXXXXXXXXXXXMECSPRTSLDFXXXXXXXXXXKAWMVHRQWFLDLPXXXXXXXXXXXXXXXXXXMLVTFKNAHAKRQDVIVLGSQEXXXHTVLTGATEIQXXXXXXXYAGHLKCKVRMXXXXXXXXXXXXXXXXXXXXXXXXXXXXXXXXXXXXXXXXXXXXXXXXXXXXXXXXXXXXXXXXXXXXXXXXXXXXNIEAEPPSGESXXXXXXXXXXXXXXXXXXXXXXXXXXATTMRGAKRMAXXXXTAWDFGSIGGLXXXXXXXXXXXXXXAYTALFGGVSWXXXXXXXXXXXXXXXXXXXXXXXXXXXXXXXXXXXXXXXXXXXXXXXXXXXSKELKCGNGIFVTXXXXTRTEQYKFQPESPARVASAILNXXXXGVCGVRSTTRMENLLWKQVXXXXXXXXXXXXXXXXXXXXXXXXXXXXXXXXXXXXXXXXXXXXXXXXXXXXXXXXXXXXXXXXXXXXXXXXXXXXXXXXXFEVEDYGFGVFTTNIWLRXXXXXXXXXXXXXXXXXXKDDRAVHADMGYWIESRLNXXXXXXXXXXXXXXXXXXXXXXXXXXXGVLESEMVIPKXXXXXXXXXXXXXXXXXXXXXXXXXXXXXXXXXXXXXXXXXXXXXXGHRGSSLRTTTXXXXXXXXXXXRSCTLPPLRFKGEDGCWYGMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPLNEAVMAVGVVSILASSFLRNDVPMXXXXXXXXXXXXXXXXSGSSADLSLERXXXXXXXXXXXXXXXXXXXXXXXXEDGSFSIRDIEETXILTILLKATLLAISGXXXXXXXXXXXXXXXXXXXXXXXGALWDVPSPATXXXXXXXXXXXXXXXXXXXXXXXXXXXXXXXXXXXXXWHVTRGAVLTHXSKRLEPNWANVKKDLXXXXXXXXXXXXWDREEDVQVLAXXXXXXXXXXXXXXXXXXXXAGTIGAVSLDFXXXXXXXXXXXXXXXXXXXYGNGVVTRSGTYVSAIAQTXXXXXXXXXXXXXXXXXXXXXXXXXXXXXSGKTRRYLPAMVREAIRRGLRTLILAPXXXXXXXXXXXXXGLPIRYQTTAIKAEHTGREIVDXXXXXXXXXXXXSPVRVPNYNLVIMXXXXXXXXXXXXXXXXXXXXXXXXXXXXXXXXXXXXXXXXXXXXXXXXIQDEEKEIPERSWSSGHXXXXXFVGKTVWFVPSIXXXXXXXXXXXXXXXXXXXLSRKTFDTEYTKTXANDWDFVVTTDISEMGANFRAERVIDPRRCLKPVISTDGEERVVLAGXXXXXXXXXAQRRGRIGRNLXKEGDQYVFSGDPLRNDEDHXXXXXXXXXXXXXXXXXXXXXXXFGPEREKNAAVDGEYRLRGEQRKTFVELMKRGDLPVWLAYKVASXXXXXXXXXXXXXXXXXXXXXXXXXXXXXXXREGEKKKLRPKXXXXXXXXXXXXXXXXXXXXXXXXXXXXXXXXXXXXXXXXXXXXXRNALDNLAVLHTXXXXXXAYTHALSELPETXXXXXXXXXXXXXXXXXXXXXXXXXXXXXXXXXXXXXXXXXXXXXXXXXXXXXXXXXXXXXXXLMVLLVPEPEKXXXXXDNQLIYVILAILXXXXXXXXNEMGLIEKTKADXXXXXXXXXXXXXXXXXXXXXXXXXXXXXXWTLYAVATTFITPMLRHSIENXXXXXXXXXXXNQATVLMGLGRGWPLHRVDLGVPLLAMGXXSQVNPTTLIASLXXXXXXXXXXXXXXXXXXXXXXXXXXXXXXMKNPTVDGVTVIDLDPIPYDPKFEKXXXXXXXXXLCVGQLLLMRTSWAFCEALTLATGPVSTLWEGNPGKFXXXXXXXXXXXXXXXXXXXGAGLLFSIMRNXXXXXXXXXXXXXXXXXXXXXXXXXXXXXXXXXYKRSGIIEVDRXXXXXXXXXXXXXKYAVSRGTSKIRWIVERGMIXPEGKVMDLGCGRXXXSYYCGGLKDVTEVRGFTKGGPXXXXXXXXSTYGWNLVKLMSGXXXXXXXXXXXXXXXXXXGESSPNPTIEAGRTLRVLSXXXXXXXXXXXXCIKVLNPYMPTVVEXXXXXXXXXXXXXXXXXXXXXSTHEMYWVSGVXXXXXXSVNTISKMLLNRFTTXXXXXXXXRDVDLGTGTRHVAVEXXXXXXXXXXXXXXXXXXXXXXTWHYDHENPYRTWXXXXXXXASSTGSASSMVNXXVRLLTKPWDMIPMVTQXXXXXXXXXXXXXXXXXXXXXXXXXXXXXXXXXXXXXXXXXXXXXXXXXXXXXXXXXXXXXXXRSNAALGAVFTEENQWDSARAAVXXXXXXXXXXXXXXLHLDGKCETCVYNMXXXXXXXXXXXXXXXXXXXXXXXXXXXXXXXXXXXXXXXXXXXXXRENSFSGVEGEGLHKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVQLVRQMEGEGVXXXXXXXXXXXXXXXXXXXXXXXXXXXXXXXXXXXXXXXDCVVKPVDDRFXXXXXXXXXXXXXXXXXXQWEPSKGWSDWTQVPFCSHXXXXXXXXXXXXXXXXXXXXXXXXXXXXXXXXXXXXXXXXXCLGKAYAQMWALMYFXXXXXXXXXXXXXXXXXXXXXXXXXXXXXXXXXHEWMTTEDMLTVXXXXXXXXXXXXXXXXXXXXXXXXXXXXXXXXXXXXXXIGLTARATWASNIXXXXXXXXXXXXXXXXXXXXXXXXXXXXXXXXXXXXX

SEQ ID NO: 265877 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(34): Any amino acid
  MOD_RES (46)..(166): Any amino acid
  MOD_RES (175)..(207): Any amino acid
  MOD_RES (217)..(338): Any amino acid
  MOD_RES (348)..(411): Any amino acid
  MOD_RES (429)..(464): Any amino acid
  MOD_RES (474)..(508): Any amino acid
  MOD_RES (517)..(582): Any amino acid
  MOD_RES (593)..(714): Any amino acid
  MOD_RES (724)..(752): Any amino acid
  MOD_RES (773)..(851): Any amino acid
  MOD_RES (861)..(864): Any amino acid
  MOD_RES (874)..(1002): Any amino acid
  MOD_RES (1011)..(1041): Any amino acid
  MOD_RES (1054)..(1075): Any amino acid
  MOD_RES (1087)..(1160): Any amino acid
  MOD_RES (1174)..(1175): Any amino acid
  MOD_RES (1189)..(1634): Any amino acid
  MOD_RES (1649)..(1722): Any amino acid
  MOD_RES (1732)..(1736): Any amino acid
  MOD_RES (1748)..(1785): Any amino acid
  MOD_RES (1800)..(1813): Any amino acid
  MOD_RES (1834)..(1834): Any amino acid
  MOD_RES (1843)..(1850): Any amino acid
  MOD_RES (1871)..(1871): Any amino acid
  MOD_RES (1920)..(1957): Any amino acid
  MOD_RES (1969)..(1983): Any amino acid
  MOD_RES (1994)..(2002): Any amino acid
  MOD_RES (2022)..(2022): Any amino acid
  MOD_RES (2037)..(2053): Any amino acid
  MOD_RES (2067)..(2089): Any amino acid
  MOD_RES (2101)..(2121): Any amino acid
  MOD_RES (2131)..(2137): Any amino acid
  MOD_RES (2151)..(2160): Any amino acid
  MOD_RES (2169)..(2216): Any amino acid
  MOD_RES (2225)..(2339): Any amino acid
  MOD_RES (2358)..(2407): Any amino acid
  MOD_RES (2424)..(2495): Any amino acid
  MOD_RES (2529)..(2548): Any amino acid
  MOD_RES (2557)..(2594): Any amino acid
  MOD_RES (2606)..(2606): Any amino acid
  MOD_RES (2621)..(2640): Any amino acid
  MOD_RES (2650)..(2689): Any amino acid
  MOD_RES (2704)..(2710): Any amino acid
  MOD_RES (2728)..(2734): Any amino acid
  MOD_RES (2750)..(2775): Any amino acid
  MOD_RES (2790)..(2818): Any amino acid
  MOD_RES (2827)..(2842): Any amino acid
  MOD_RES (2861)..(2937): Any amino acid
  MOD_RES (2950)..(2953): Any amino acid
  MOD_RES (2974)..(2978): Any amino acid
  MOD_RES (3004)..(3087): Any amino acid
  MOD_RES (3140)..(3143): Any amino acid
  MOD_RES (3153)..(3168): Any amino acid
  MOD_RES (3183)..(3206): Any amino acid
  MOD_RES (3223)..(3227): Any amino acid
  MOD_RES (3252)..(3299): Any amino acid
  MOD_RES (3313)..(3323): Any amino acid
  MOD_RES (3335)..(3344): Any amino acid
  MOD_RES (3360)..(3368): Any amino acid
  MOD_RES (3392)..(3392): Any amino acid
  MOD_RES (3405)..(3406): Any amino acid
  MOD_RES (3428)..(3431): Any amino acid
  MOD_RES (3443)..(3443): Any amino acid
  MOD_RES (3454)..(3454): Any amino acid
  MOD_RES (3463)..(3479): Any amino acid
  MOD_RES (3498)..(3556): Any amino acid
XXXXXXXXXXXXXXXXXXXXXXXXXXXXXXXXXXSQLAKRFSKGLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGKSLLFKTXXXXXXXXXXXXXXXXXXXXXXXXXXXXXXXXXEPEDIDCWCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLEHGSCVTXXXXXXXXXXXXXXXXXXXXXXXXXXXXXXXXXXXXXXXXXXXXXXXXXXXXXXXXXXXXXXXXVDRGWGNGCGLFGKGSLXXXXXXXXXXXXXXXXXXXXXXXXXXXXXXXXXXXXTGDQHQVGNXXXXXXXXXXXXXXXXXXXXXXXXXXXXXXXXXXXCSPRTGLDXXXXXXXXXXXXXXXXXXXXXXXXXXXXXXXXXXXXXXXXXXXXXXXXXXXXXXXXXXXXXXXXXXVLGSQEGAMHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEPPFGDSYIXXXXXXXXXXXXXXXXXXXXXXXXXXXXXGARRMAILGDTAWDFGSIGGXXXXXXXXXXXXXXXXXXXXXXXXXXXXXXXXXXXXXXXXXXXXXXXXXXXXXXXXXXXXXXXXXXXXXXXXXXXXXXXELKCGSGIFXXXXVHTWTEQYKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVEDYGFGXXXXXXXXXXXXXXXXXXXXXXXXXXXXXXXAVHADMGYWIESXXXXXXXXXXXXXXXXXXXXXXWPKSHTLWSNGXXXXXXXXXXXXXXXXXXXXXXXXXXXXXXXXXXXXXXXXXXXXXXXXXXXXXXXXXXXXXXXXXXXXXXXXXXEWCCRSCTLPPLRXXGEDGCWYGMEIRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFHTMWHVTRGAVLXXXXXXXXXXXXXXXXXXXXXXXXXXXXXXXXXXXXXXXXXXXXXXXXXXXXXXXXXXXXXXXXXXXXXXXXXXPGTSGSPIVXXXXXVVGLYGNGVVTXXXXXXXXXXXXXXXXXXXXXXXXXXXXXXXXXXXXXXLTIMDLHPGSGKTRXXXXXXXXXXXXXXLRTLILAPTRVVAAEMEEALXGLPIRYQTXXXXXXXXGREIVDLMCHATFTMRLLSPXRVPNYNLIIMDEAHFTDPASIAARGYISTRVGMGEAAAIFMTATPPGSXXXXXXXXXXXXXXXXXXXXXXXXXXXXXXXXXXXXXXGKTVWFVPSIKXXXXXXXXXXXXXXXVIQLSRKTFDXXXXXXXXXDWDFVVTTDISEMGANFKAXRVIDPRRCLKPVILXXXXXXXXXXXXXXXXXASAAQRRGRIGRNXXXXXXXXXXXXXXXXXXXXXXXWTEAKMLLDNIXXXXXXXXXXXXXXXXXXXXXDGEYRLRGEXXXXXXXLMRRGDLPVWLSYXXXXXXXXXXDRRWCFDGXXXXXXXXXXXXXXXXXXXXXXXXXXXXXXXXXXXXXXXXXXXXXXXXFAAGRRSVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLIPEPEKQRTPQDNQLAXXXXXXXXXXXXXXXXXXXXXXXXXXXXXXXXXXXXXXXXXXXXXXXXXXDLHPASAWTLYAVATTXXXXXXXXXXXXXXXXXXXXXXXXXXXXXXXXXXXXXXXXXXXXXXXXXXXXXXXXXXXXXXXXXXXXXXXXHYAIIGPGLQAKATREAQKRTAAGIMKNPTVDGXXXXXXXXXXXXXXXXXXXXFEKQLGQVXXXXXXXXXXXXXXXXXXXXXXXXXXXXXXXXXXXXXXGKFWNTTIAVSXANIFRGSYLAGAGLXXXXXXXXXXXXXXXXXXXXGETLGEKWKXXXXXXXXXXXXXXXXXXXXXXXXXXXXXXXXXXXXXXXXAVSRGTAKLRWFVEXXXXXXXGKVIDLGCGRGGWSYYCXXXXXXXEVKGYTKGGPGHEEPXXXXXXXXXXXXXXXXXXXXXXXXXXCDTLLCDIGESSPNXXXXXXXXXXXXXXXXXXXXXXXXXXXXXKVLNPYMPXXXXXXXXXXXXXXXXLVRNPLSRNSTHEMYWVSXXXXXXXXXXXXXXXXXXXXXXXXXXXXXXXXXXXXXXXXXXXXXXXXXXXXXXXXXXXXXXXXXXXXXXXXXXXXXPYKTWAYHGSYEXXXXGSASSMVNGVVKLLTKPWDVXXXXXQMAMTDTTPFGQQRVFKEKVDTRTPXXXXXXXXXXXXXXXXXXXXXXXXXXXXXXXXXXXXXXXXXXXXXXXXXXXXXXXXXXXXXXXXXXXXXXXXXXXXXXXXXXXXTCVYNMMGKREKKLGEFGKAKGSRAIWYMWLGARFLEFEALGFLNEDHWFSRXXXXSGVEGEGLHXXXXXXXXXXXXXXXXMYADDTAGWDTRITXXXXXXXXXXXXXXXXXXXXXXXXIFKLTYQNKVVRVQRPXXXXXTVMDVISRRDQRGSGQVGTYGLNTXXXXXXXXXXXXXXXXXXXXXXXXXXXXXXXXXXXXXXXXXXXXXXXXRMAISGDDCVVKPXXXXXXXXXXXLNDMGKVRKDIXXXXXXXXXXDWQQVPFCSHHFHELXXXXXXXXXVPCRNQDELIGRARISQGAGWSLXETACLGKSYAQMXXLMYFHRRDLRLAANAICSAVPXXXXPTSRTTWSIHAXHQWMTTEDMLXVWNRVWIEXXXXXXXXXXXXXXXXXPYLGKREDQWCGSLIGLTXXXXXXXXXXXXXXXXXXXXXXXXXXXXXXXXXXXXXXXXXXXXXXXXXXXXXXXXXXX

SEQ ID NO: 265878 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(34): Any amino acid
  MOD_RES (46)..(166): Any amino acid
  MOD_RES (175)..(207): Any amino acid
  MOD_RES (217)..(338): Any amino acid
  MOD_RES (348)..(411): Any amino acid
  MOD_RES (429)..(464): Any amino acid
  MOD_RES (474)..(508): Any amino acid
  MOD_RES (517)..(582): Any amino acid
  MOD_RES (593)..(714): Any amino acid
  MOD_RES (724)..(752): Any amino acid
  MOD_RES (773)..(851): Any amino acid
  MOD_RES (861)..(864): Any amino acid
  MOD_RES (874)..(1002): Any amino acid
  MOD_RES (1011)..(1041): Any amino acid
  MOD_RES (1054)..(1075): Any amino acid
  MOD_RES (1087)..(1160): Any amino acid
  MOD_RES (1174)..(1175): Any amino acid
  MOD_RES (1189)..(1634): Any amino acid
  MOD_RES (1649)..(1722): Any amino acid
  MOD_RES (1732)..(1736): Any amino acid
  MOD_RES (1748)..(1785): Any amino acid
  MOD_RES (1800)..(1813): Any amino acid
  MOD_RES (1834)..(1834): Any amino acid
  MOD_RES (1843)..(1850): Any amino acid
  MOD_RES (1871)..(1871): Any amino acid
  MOD_RES (1920)..(1957): Any amino acid
  MOD_RES (1969)..(1983): Any amino acid
  MOD_RES (1994)..(2002): Any amino acid
  MOD_RES (2022)..(2022): Any amino acid
  MOD_RES (2037)..(2053): Any amino acid
  MOD_RES (2067)..(2089): Any amino acid
  MOD_RES (2101)..(2121): Any amino acid
  MOD_RES (2131)..(2137): Any amino acid
  MOD_RES (2151)..(2160): Any amino acid
  MOD_RES (2169)..(2216): Any amino acid
  MOD_RES (2225)..(2339): Any amino acid
  MOD_RES (2358)..(2407): Any amino acid
  MOD_RES (2424)..(2495): Any amino acid
  MOD_RES (2529)..(2548): Any amino acid
  MOD_RES (2557)..(2594): Any amino acid
  MOD_RES (2606)..(2606): Any amino acid
  MOD_RES (2621)..(2640): Any amino acid
  MOD_RES (2650)..(2689): Any amino acid
  MOD_RES (2704)..(2710): Any amino acid
  MOD_RES (2728)..(2734): Any amino acid
  MOD_RES (2750)..(2775): Any amino acid
  MOD_RES (2790)..(2818): Any amino acid
  MOD_RES (2827)..(2842): Any amino acid
  MOD_RES (2861)..(2937): Any amino acid
  MOD_RES (2950)..(2953): Any amino acid
  MOD_RES (2974)..(2978): Any amino acid
  MOD_RES (3004)..(3087): Any amino acid
  MOD_RES (3140)..(3143): Any amino acid
  MOD_RES (3153)..(3168): Any amino acid
  MOD_RES (3183)..(3206): Any amino acid
  MOD_RES (3223)..(3227): Any amino acid
  MOD_RES (3252)..(3299): Any amino acid
  MOD_RES (3313)..(3323): Any amino acid
  MOD_RES (3335)..(3344): Any amino acid
  MOD_RES (3360)..(3368): Any amino acid
  MOD_RES (3392)..(3392): Any amino acid
  MOD_RES (3405)..(3406): Any amino acid
  MOD_RES (3428)..(3431): Any amino acid
  MOD_RES (3443)..(3443): Any amino acid
  MOD_RES (3453)..(3454): Any amino acid
  MOD_RES (3463)..(3479): Any amino acid
  MOD_RES (3498)..(3556): Any amino acid
XXXXXXXXXXXXXXXXXXXXXXXXXXXXXXXXXXQQLTKRFSLGMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTDVITIPTXXXXXXXXXXXXXXXXXXXXXXXXXXXXXXXXXEPDDVDCWCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLEHGGCVTXXXXXXXXXXXXXXXXXXXXXXXXXXXXXXXXXXXXXXXXXXXXXXXXXXXXXXXXXXXXXXXXTDRGWGNHCGLFGKGGIXXXXXXXXXXXXXXXXXXXXXXXXXXXXXXXXXXXXSGEEHAVGNXXXXXXXXXXXXXXXXXXXXXXXXXXXXXXXXXXXCEPRSGIDXXXXXXXXXXXXXXXXXXXXXXXXXXXXXXXXXXXXXXXXXXXXXXXXXXXXXXXXXXXXXXXXXXALGSQEGALHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEPPFGESYIXXXXXXXXXXXXXXXXXXXXXXXXXXXXXGAKRLAALGETAWDFGSVGGXXXXXXXXXXXXXXXXXXXXXXXXXXXXXXXXXXXXXXXXXXXXXXXXXXXXXXXXXXXXXXXXXXXXXXXXXXXXXXXELRCGSGVFXXXXVEAWMDRYKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVEDFGFGXXXXXXXXXXXXXXXXXXXXXXXXXXXXXXXAIHSDLSYWIESXXXXXXXXXXXXXXXXXXXXXXWPETHTLWGDGXXXXXXXXXXXXXXXXXXXXXXXXXXXXXXXXXXXXXXXXXXXXXXXXXXXXXXXXXXXXXXXXXXXXXXXXXXDWCCRSCTMPPLRXXTDSDCWYAMEIRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFHTLWHTTKGAALXXXXXXXXXXXXXXXXXXXXXXXXXXXXXXXXXXXXXXXXXXXXXXXXXXXXXXXXXXXXXXXXXXXXXXXXXXTGTSGSPIIXXXXXIIGLYGNGVIMXXXXXXXXXXXXXXXXXXXXXXXXXXXXXXXXXXXXXXITVMDLHPGAGKTKXXXXXXXXXXXXXXLRTAVLAPTRVVASEMAEALXGMPIRYQTXXXXXXXXGKEIVDVMCHATLTHRLMSPXRVPNYNMFVMDEAHFTDPSSVAARGYISTRVEMGEAAGVLMTATPPGTXXXXXXXXXXXXXXXXXXXXXXXXXXXXXXXXXXXXXXGKTVWFVPSVKXXXXXXXXXXXXXXXVVQLNRKSYEXXXXXXXXXDWDYVITTDISEMGANFRAXRVIDPRRCMKPVILXXXXXXXXXXXXXXXXXSSAAQRRGRVGRNXXXXXXXXXXXXXXXXXXXXXXXWKEARIMLDNIXXXXXXXXXXXXXXXXXXXXXDGEYRLKGEXXXXXXXLLRTGDLPVWLAYXXXXXXXXXXDRKWCFDGXXXXXXXXXXXXXXXXXXXXXXXXXXXXXXXXXXXXXXXXXXXXXXXXFAAGRKSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLIPEPDRQRTPQDNQLTXXXXXXXXXXXXXXXXXXXXXXXXXXXXXXXXXXXXXXXXXXXXXXXXXXDLRPATAWSLYAVTTAXXXXXXXXXXXXXXXXXXXXXXXXXXXXXXXXXXXXXXXXXXXXXXXXXXXXXXXXXXXXXXXXXXXXXXXXHYAYMVPGWQAEAMREAQKRAAAGIMKNAVVDGXXXXXXXXXXXXXXXXXXXXFEKQLGQIXXXXXXXXXXXXXXXXXXXXXXXXXXXXXXXXXXXXXXGRVWNATTAIGXCHIMRGGWLSCLSIXXXXXXXXXXXXXXXXXXXXGRTLGEVWKXXXXXXXXXXXXXXXXXXXXXXXXXXXXXXXXXXXXXXXXAVSRGSAKLQWFVEXXXXXXXGKVVDLGCGRGGWCYYMXXXXXXXEVKGLTKGGAGHEEPXXXXXXXXXXXXXXXXXXXXXXXXXXVDTLFCDIGESSPSXXXXXXXXXXXXXXXXXXXXXXXXXXXXXKILNPYMPXXXXXXXXXXXXXXXXLVRCPLSRNSTHEMYWISXXXXXXXXXXXXXXXXXXXXXXXXXXXXXXXXXXXXXXXXXXXXXXXXXXXXXXXXXXXXXXXXXXXXXXXXXXXXXPYRTWNYHGSYDXXXXGSASSMVNGVVRLLSKPWDTXXXXXQIAMTDTTAFGQQRVFKEKVDTRTQXXXXXXXXXXXXXXXXXXXXXXXXXXXXXXXXXXXXXXXXXXXXXXXXXXXXXXXXXXXXXXXXXXXXXXXXXXXXXXXXXXXXSCIYNMMGKREKKPGEFGRAKGSRAIWYMWLGARYLEFEALGFMNEDHWLGRXXXXGGVEGLGLQXXXXXXXXXXXXXXXXIYADDTAGWDTKVTXXXXXXXXXXXXXXXXXXXXXXXXIIELTYQNKVVKVQRPXXXXXTVMDIISRKDQRGSGQVVTYALNTXXXXXXXXXXXXXXXXXXXXXXXXXXXXXXXXXXXXXXXXXXXXXXXXRMAVSGDDCVVRPXXXXXXXXXXXLNDMGKIRKDIXXXXXXXXXXDWTQVPFCSHHFHQLXXXXXXXXXVPCRPQDELVGRARVSPGAGWNVXETACLGKAYAQMXXLLYFHRRDLRLASMAICSAVPXXXXPTGRTSWSIHSXHEWMTTEDMXXVWNRVWIQXXXXXXXXXXXXXXXXXPYSGKREDIWCGSLIGTRXXXXXXXXXXXXXXXXXXXXXXXXXXXXXXXXXXXXXXXXXXXXXXXXXXXXXXXXXXX

SEQ ID NO: 265879 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(34): Any amino acid
  MOD_RES (46)..(166): Any amino acid
  MOD_RES (175)..(207): Any amino acid
  MOD_RES (217)..(338): Any amino acid
  MOD_RES (348)..(411): Any amino acid
  MOD_RES (420)..(420): Any amino acid
  MOD_RES (429)..(464): Any amino acid
  MOD_RES (474)..(508): Any amino acid
  MOD_RES (517)..(582): Any amino acid
  MOD_RES (593)..(714): Any amino acid
  MOD_RES (724)..(752): Any amino acid
  MOD_RES (773)..(851): Any amino acid
  MOD_RES (861)..(864): Any amino acid
  MOD_RES (874)..(1002): Any amino acid
  MOD_RES (1011)..(1041): Any amino acid
  MOD_RES (1054)..(1075): Any amino acid
  MOD_RES (1087)..(1160): Any amino acid
  MOD_RES (1174)..(1175): Any amino acid
  MOD_RES (1186)..(1634): Any amino acid
  MOD_RES (1649)..(1722): Any amino acid
  MOD_RES (1732)..(1736): Any amino acid
  MOD_RES (1748)..(1785): Any amino acid
  MOD_RES (1800)..(1813): Any amino acid
  MOD_RES (1834)..(1834): Any amino acid
  MOD_RES (1843)..(1850): Any amino acid
  MOD_RES (1871)..(1871): Any amino acid
  MOD_RES (1920)..(1957): Any amino acid
  MOD_RES (1969)..(1983): Any amino acid
  MOD_RES (1994)..(2002): Any amino acid
  MOD_RES (2022)..(2022): Any amino acid
  MOD_RES (2037)..(2058): Any amino acid
  MOD_RES (2067)..(2089): Any amino acid
  MOD_RES (2101)..(2121): Any amino acid
  MOD_RES (2131)..(2137): Any amino acid
  MOD_RES (2151)..(2160): Any amino acid
  MOD_RES (2169)..(2216): Any amino acid
  MOD_RES (2225)..(2339): Any amino acid
  MOD_RES (2358)..(2407): Any amino acid
  MOD_RES (2424)..(2495): Any amino acid
  MOD_RES (2529)..(2548): Any amino acid
  MOD_RES (2557)..(2594): Any amino acid
  MOD_RES (2606)..(2606): Any amino acid
  MOD_RES (2621)..(2640): Any amino acid
  MOD_RES (2650)..(2689): Any amino acid
  MOD_RES (2704)..(2710): Any amino acid
  MOD_RES (2728)..(2734): Any amino acid
  MOD_RES (2750)..(2775): Any amino acid
  MOD_RES (2790)..(2818): Any amino acid
  MOD_RES (2827)..(2842): Any amino acid
  MOD_RES (2861)..(2937): Any amino acid
  MOD_RES (2950)..(2953): Any amino acid
  MOD_RES (2974)..(2978): Any amino acid
  MOD_RES (2988)..(2994): Any amino acid
  MOD_RES (3004)..(3087): Any amino acid
  MOD_RES (3128)..(3129): Any amino acid
  MOD_RES (3140)..(3143): Any amino acid
  MOD_RES (3153)..(3168): Any amino acid
  MOD_RES (3177)..(3206): Any amino acid
  MOD_RES (3223)..(3227): Any amino acid
  MOD_RES (3252)..(3299): Any amino acid
  MOD_RES (3310)..(3323): Any amino acid
  MOD_RES (3335)..(3344): Any amino acid
  MOD_RES (3360)..(3368): Any amino acid
  MOD_RES (3392)..(3392): Any amino acid
  MOD_RES (3405)..(3406): Any amino acid
  MOD_RES (3428)..(3431): Any amino acid
  MOD_RES (3443)..(3443): Any amino acid
  MOD_RES (3453)..(3454): Any amino acid
  MOD_RES (3463)..(3479): Any amino acid
  MOD_RES (3498)..(3556): Any amino acid
XXXXXXXXXXXXXXXXXXXXXXXXXXXXXXXXXXQQLAKRFSRGLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRPLLFKTXXXXXXXXXXXXXXXXXXXXXXXXXXXXXXXXXDPEDVDCWCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLEGDSCVTXXXXXXXXXXXXXXXXXXXXXXXXXXXXXXXXXXXXXXXXXXXXXXXXXXXXXXXXXXXXXXXXSDRGWGNHXGLFGKGSIXXXXXXXXXXXXXXXXXXXXXXXXXXXXXXXXXXXXNGDTHAVGNXXXXXXXXXXXXXXXXXXXXXXXXXXXXXXXXXXXCEPRSGLNXXXXXXXXXXXXXXXXXXXXXXXXXXXXXXXXXXXXXXXXXXXXXXXXXXXXXXXXXXXXXXXXXXALGSQEGGLHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEPPFGESNIXXXXXXXXXXXXXXXXXXXXXXXXXXXXXGAQRMAIIGETAWDFGSLGGXXXXXXXXXXXXXXXXXXXXXXXXXXXXXXXXXXXXXXXXXXXXXXXXXXXXXXXXXXXXXXXXXXXXXXXXXXXXXXXEMRCGSGIFXXXXVEAWVDRYKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQIEDFGFGXXXXXXXXXXXXXXXXXXXXXXXXXXXXXXXAVHTDQSLWMKSXXXXXXXXXXXXXXXXXXXXXXWPKTHTLWSNGXXXXXXXXXXXXXXXXXXXXXXXXXXXXXXXXXXXXXXXXXXXXXXXXXXXXXXXXXXXXXXXXXXXXXXXXXXQWCCRSCSLPPLRXXTENGCWYGMEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLHTMWHVTRGSVIXXXXXXXXXXXXXXXXXXXXXXXXXXXXXXXXXXXXXXXXXXXXXXXXXXXXXXXXXXXXXXXXXXXXXXXXXXRGTSGSPILXXXXXVVGLYGNGVELXXXXXXXXXXXXXXXXXXXXXXXXXXXXXXXXXXXXXXMTVLDMHPGAGKTRXXXXXXXXXXXXXXLRTLVLAPTRVVAAEMAEALXGLPVRYQTXXXXXXXXGNAIIDVMCHATFTTRLLSSXRVPNYNLIIMDEAHFTDPSSIAARGYISTKVELNKCALVLMTATPPGAXXXXXXXXXXXXXXXXXXXXXXXXXXXXXXXXXXXXXXGRTVWFVASVKXXXXXXXXXXXXXXXVIQLNRKSYDXXXXXXXXXDWDFVITTDISEMGANFGAXRVIDSRKSVKPTIIXXXXXXXXXXXXXXXXXXXXXXRRGRVGRQXXXXXXXXXXXXXXXXXXXXXXXWTEAKIMLDNIXXXXXXXXXXXXXXXXXXXXXDGEFRLRGEXXXXXXXLLTHADLPVWLAHXXXXXXXXXXDREWCFTGXXXXXXXXXXXXXXXXXXXXXXXXXXXXXXXXXXXXXXXXXXXXXXXXFAAGRKSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLQPEPEKQRSQTDNQLAXXXXXXXXXXXXXXXXXXXXXXXXXXXXXXXXXXXXXXXXXXXXXXXXXXDLRPATAWALYGGSTVXXXXXXXXXXXXXXXXXXXXXXXXXXXXXXXXXXXXXXXXXXXXXXXXXXXXXXXXXXXXXXXXXXXXXXXXHYGYMLPGWQAEALRSAQRVFFSGMVRNPMVDGXXXXXXXXXXXXXXXXXXXXMQKKVGQIXXXXXXXXXXXXXXXXXXXXXXXXXXXXXXXXXXXXXXSSVWNSTTATGXCHVMRGSYLAGGSIXXXXXXXXXXXXXXXXXXXXGRTLGEQWKXXXXXXXXXXXXXXXXXXXXXXXXXXXXXXXXXXXXXXXXPVSRGSAKLRWLVEXXXXXXXGRVMDLGCGRGGWSYYMXXXXXXXEVRGYTLGRDGHEKPXXXXXXXXXXXXXXXXXXXXXXXXXXSDTIMCDIGESSSSXXXXXXXXXXXXXXXXXXXXXXXXXXXXXKVLCPYMPXXXXXXXXXXXXXXXXLVRLPFSRNSNHEMYWVSXXXXXXXXXXXXXXXXXXXXXXXXXXXXXXXXXXXXXXXXXXXXXXXXXXXXXXXXXXXXXXXXXXXXXXXXXXXXXPYRTWTYHGSYEXXXXGSASSLINGVVRLMSKPWDAXXXXXTLAMTDTTPXXXXXXXKEKVDTKAPXXXXXXXXXXXXXXXXXXXXXXXXXXXXXXXXXXXXXXXXXXXXXXXXXXXXXXXXXXXXXXXXXXXXXXXXXXXXXXXXXXXXTCIYNMMGKREKKLGEFGVAKGSRAIWFMWLGSRFLEFEAXXFLNEDHWFGRXXXXGGVEGSGVQXXXXXXXXXXXXXXXXFYADDTAGXXXXXXXXXXXXXXXXXXXXXXXXXXXXXXIMQKTYRHKVVKVMRPXXXXXAVMDIISREDQRGSGQVVTYGLNTXXXXXXXXXXXXXXXXXXXXXXXXXXXXXXXXXXXXXXXXXXXXXXXXRMLVSGDDCVXXXXXXXXXXXXXXLNAMSKVRKDIXXXXXXXXXXNWQEVPFCSNHFTELXXXXXXXXXVPCRGQDELVGRARISPGCGWSVXDTACLAKSYAQMXXLSYFHRRDLRLMSLAVSSAVPXXXXPTGRTTWSIHGXGAWMTTEDMXXVWNRVWIRXXXXXXXXXXXXXXXXXPYVGKREDLLCGSLIGLSXXXXXXXXXXXXXXXXXXXXXXXXXXXXXXXXXXXXXXXXXXXXXXXXXXXXXXXXXXX

SEQ ID NO: 265880 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(34): Any amino acid
  MOD_RES (46)..(166): Any amino acid
  MOD_RES (175)..(207): Any amino acid
  MOD_RES (217)..(338): Any amino acid
  MOD_RES (348)..(420): Any amino acid
  MOD_RES (429)..(464): Any amino acid
  MOD_RES (474)..(508): Any amino acid
  MOD_RES (517)..(582): Any amino acid
  MOD_RES (593)..(714): Any amino acid
  MOD_RES (724)..(752): Any amino acid
  MOD_RES (773)..(851): Any amino acid
  MOD_RES (861)..(864): Any amino acid
  MOD_RES (874)..(1002): Any amino acid
  MOD_RES (1011)..(1041): Any amino acid
  MOD_RES (1054)..(1075): Any amino acid
  MOD_RES (1087)..(1160): Any amino acid
  MOD_RES (1174)..(1175): Any amino acid
  MOD_RES (1186)..(1634): Any amino acid
  MOD_RES (1649)..(1722): Any amino acid
  MOD_RES (1731)..(1736): Any amino acid
  MOD_RES (1748)..(1785): Any amino acid
  MOD_RES (1800)..(1822): Any amino acid
  MOD_RES (1834)..(1834): Any amino acid
  MOD_RES (1843)..(1850): Any amino acid
  MOD_RES (1871)..(1871): Any amino acid
  MOD_RES (1920)..(1957): Any amino acid
  MOD_RES (1969)..(1983): Any amino acid
  MOD_RES (1994)..(2002): Any amino acid
  MOD_RES (2012)..(2012): Any amino acid
  MOD_RES (2022)..(2022): Any amino acid
  MOD_RES (2037)..(2089): Any amino acid
  MOD_RES (2101)..(2121): Any amino acid
  MOD_RES (2131)..(2137): Any amino acid
  MOD_RES (2151)..(2160): Any amino acid
  MOD_RES (2169)..(2216): Any amino acid
  MOD_RES (2225)..(2339): Any amino acid
  MOD_RES (2358)..(2407): Any amino acid
  MOD_RES (2424)..(2495): Any amino acid
  MOD_RES (2529)..(2548): Any amino acid
  MOD_RES (2557)..(2594): Any amino acid
  MOD_RES (2606)..(2606): Any amino acid
  MOD_RES (2621)..(2640): Any amino acid
  MOD_RES (2650)..(2689): Any amino acid
  MOD_RES (2704)..(2710): Any amino acid
  MOD_RES (2728)..(2734): Any amino acid
  MOD_RES (2750)..(2775): Any amino acid
  MOD_RES (2790)..(2818): Any amino acid
  MOD_RES (2827)..(2842): Any amino acid
  MOD_RES (2861)..(2937): Any amino acid
  MOD_RES (2950)..(2953): Any amino acid
  MOD_RES (2974)..(2978): Any amino acid
  MOD_RES (2988)..(2995): Any amino acid
  MOD_RES (3004)..(3087): Any amino acid
  MOD_RES (3096)..(3098): Any amino acid
  MOD_RES (3110)..(3114): Any amino acid
  MOD_RES (3123)..(3129): Any amino acid
  MOD_RES (3140)..(3143): Any amino acid
  MOD_RES (3153)..(3206): Any amino acid
  MOD_RES (3223)..(3227): Any amino acid
  MOD_RES (3242)..(3323): Any amino acid
  MOD_RES (3335)..(3344): Any amino acid
  MOD_RES (3360)..(3368): Any amino acid
  MOD_RES (3392)..(3392): Any amino acid
  MOD_RES (3405)..(3406): Any amino acid
  MOD_RES (3428)..(3431): Any amino acid
  MOD_RES (3441)..(3443): Any amino acid
  MOD_RES (3452)..(3454): Any amino acid
  MOD_RES (3463)..(3479): Any amino acid
  MOD_RES (3498)..(3556): Any amino acid
XXXXXXXXXXXXXXXXXXXXXXXXXXXXXXXXXXSGLVKRFSTGLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXADVIVIPTXXXXXXXXXXXXXXXXXXXXXXXXXXXXXXXXXDPVDVDCFCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLEGDSCLTXXXXXXXXXXXXXXXXXXXXXXXXXXXXXXXXXXXXXXXXXXXXXXXXXXXXXXXXXXXXXXXXXXXXXXXXXGLFGKGGVXXXXXXXXXXXXXXXXXXXXXXXXXXXXXXXXXXXXSGEENAVGNXXXXXXXXXXXXXXXXXXXXXXXXXXXXXXXXXXXCRVASGVDXXXXXXXXXXXXXXXXXXXXXXXXXXXXXXXXXXXXXXXXXXXXXXXXXXXXXXXXXXXXXXXXXXNLGDQTGVLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQLPPGDNIIXXXXXXXXXXXXXXXXXXXXXXXXXXXXXGIERLTVMGDHAWDFSSAGGXXXXXXXXXXXXXXXXXXXXXXXXXXXXXXXXXXXXXXXXXXXXXXXXXXXXXXXXXXXXXXXXXXXXXXXXXXXXXXXELRCGEGLVXXXXVSEWYDNYAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVAEFGVGXXXXXXXXXXXXXXXXXXXXXXXXXXXXXXXSAHGSPTFWMGSXXXXXXXXXXXXXXXXXXXXXXWPASHTIDNAEXXXXXXXXXXXXXXXXXXXXXXXXXXXXXXXXXXXXXXXXXXXXXXXXXXXXXXXXXXXXXXXXXXXXXXXXXXDWCCRSCTMPPVSXXTGTDCWYAMEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLHTLWHTTRGAAIXXXXXXXXXXXXXXXXXXXXXXXXXXXXXXXXXXXXXXXXXXXXXXXXXXXXXXXXXXXXXXXXXXXXXXXXXXKGTSGSPIXXXXXXIIGLYGNGLKTXXXXXXXXXXXXXXXXXXXXXXXXXXXXXXXXXXXXXXITILDLHPGSGKTHXXXXXXXXXXXXXXXXXXXXXXXRVVLKEMERALXGKRVRFHSXXXXXXXXGGEVIDAMCHATYVNRRLLPXRVPNYNLVIMDEAHWTDPHSIAARGYIATLAKENESATILMTATPPGKXXXXXXXXXXXXXXXXXXXXXXXXXXXXXXXXXXXXXXRPTAWFVPSIAXXXXXXXXXXXXXXXVICLNSKTFEXXXXXXXXXKPDFVVTTDXSEMGANLDVXRVIDCRKSVKPTILXXXXXXXXXXXXXXXXXXXXXXXXXXXXXXXXXXXXXXXXXXXXXXXXXXXXXWTEAQILLDNIXXXXXXXXXXXXXXXXXXXXXAGHFRLTEEXXXXXXXLVRNCDFTPWLAWXXXXXXXXXXDRKWCFEGXXXXXXXXXXXXXXXXXXXXXXXXXXXXXXXXXXXXXXXXXXXXXXXXFASGRKSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVIPEAGKQRTPQDNQLIXXXXXXXXXXXXXXXXXXXXXXXXXXXXXXXXXXXXXXXXXXXXXXXXXXDIQPARSWGTYVLVVSXXXXXXXXXXXXXXXXXXXXXXXXXXXXXXXXXXXXXXXXXXXXXXXXXXXXXXXXXXXXXXXXXXXXXXXXHLAIVVSGLEAELTRAAHKVFFHAIMKNPTIDGXXXXXXXXXXXXXXXXXXXXMQKKVGQVXXXXXXXXXXXXXXXXXXXXXXXXXXXXXXXXXXXXXXSALWTMPVACGXSGVVRGSLWGFLPLXXXXXXXXXXXXXXXXXXXXGDTLGDLWKXXXXXXXXXXXXXXXXXXXXXXXXXXXXXXXXXXXXXXXXAVSRGSSKIRWIVEXXXXXXXGEVVDLGCGRGGWSYYAXXXXXXXGVKAYTIGGKGHETPXXXXXXXXXXXXXXXXXXXXXXXXXXADTIMCDIGESSSNXXXXXXXXXXXXXXXXXXXXXXXXXXXXXKVLAPYRPXXXXXXXXXXXXXXXXLVRTPFSRNSTHEMYYSTXXXXXXXXXXXXXXXXXXXXXXXXXXXXXXXXXXXXXXXXXXXXXXXXXXXXXXXXXXXXXXXXXXXXXXXXXXXXXPYRTWQYWGSYRXXXXGSAASLVNGVVKLLSWPWNAXXXXXQMAMTDTTAXXXXXXXXEKVDTRAKXXXXXXXXXXXXXXXXXXXXXXXXXXXXXXXXXXXXXXXXXXXXXXXXXXXXXXXXXXXXXXXXXXXXXXXXXXXXXXXXXXXXHCVYNMMGXXXKKLSEFGKAKGXXXXXFMWLGARYXXXXXXXFLNEDHWLSRXXXXGGVEGISLNXXXXXXXXXXXXXXXXXXXXXXXXXXXXXXXXXXXXXXXXXXXXXXXXXXXXXXVMEMAYHNKVVKVLRPXXXXXCIMDVITRRDQRGSXXXXXXXXXXXXXXXXXXXXXXXXXXXXXXXXXXXXXXXXXXXXXXXXXXXXXXXXXXXXXXXXXXXXXXXXXXXXXXXXXXLNDMAKTRKDIXXXXXXXXXXDWENVPFCSHHFHKIXXXXXXXXXVPCRDQDELIGRGRVSPGNGWMIXDTACLAKAYAQMXXLMYFHRRDLRTLSLAICSAVPXXXXPQGRTTWSIXXXGAWMTTEDXXXVWNRVWILXXXXXXXXXXXXXXXXXPYLTKRQDMLCSSLVGRKXXXXXXXXXXXXXXXXXXXXXXXXXXXXXXXXXXXXXXXXXXXXXXXXXXXXXXXXXXX

SEQ ID NO: 265881 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(35): Any amino acid
  MOD_RES (46)..(166): Any amino acid
  MOD_RES (175)..(207): Any amino acid
  MOD_RES (216)..(338): Any amino acid
  MOD_RES (348)..(464): Any amino acid
  MOD_RES (474)..(508): Any amino acid
  MOD_RES (517)..(582): Any amino acid
  MOD_RES (593)..(714): Any amino acid
  MOD_RES (723)..(752): Any amino acid
  MOD_RES (773)..(851): Any amino acid
  MOD_RES (861)..(864): Any amino acid
  MOD_RES (874)..(1041): Any amino acid
  MOD_RES (1051)..(1075): Any amino acid
  MOD_RES (1087)..(1160): Any amino acid
  MOD_RES (1174)..(1175): Any amino acid
  MOD_RES (1185)..(1639): Any amino acid
  MOD_RES (1649)..(1739): Any amino acid
  MOD_RES (1748)..(1785): Any amino acid
  MOD_RES (1797)..(1822): Any amino acid
  MOD_RES (1834)..(1834): Any amino acid
  MOD_RES (1843)..(1850): Any amino acid
  MOD_RES (1871)..(1871): Any amino acid
  MOD_RES (1912)..(1960): Any amino acid
  MOD_RES (1969)..(1983): Any amino acid
  MOD_RES (1994)..(2023): Any amino acid
  MOD_RES (2037)..(2089): Any amino acid
  MOD_RES (2101)..(2121): Any amino acid
  MOD_RES (2131)..(2137): Any amino acid
  MOD_RES (2151)..(2160): Any amino acid
  MOD_RES (2169)..(2216): Any amino acid
  MOD_RES (2225)..(2339): Any amino acid
  MOD_RES (2358)..(2407): Any amino acid
  MOD_RES (2424)..(2495): Any amino acid
  MOD_RES (2529)..(2594): Any amino acid
  MOD_RES (2604)..(2606): Any amino acid
  MOD_RES (2621)..(2640): Any amino acid
  MOD_RES (2650)..(2689): Any amino acid
  MOD_RES (2704)..(2711): Any amino acid
  MOD_RES (2728)..(2734): Any amino acid
  MOD_RES (2747)..(2775): Any amino acid
  MOD_RES (2790)..(2842): Any amino acid
  MOD_RES (2861)..(2937): Any amino acid
  MOD_RES (2950)..(2953): Any amino acid
  MOD_RES (2974)..(2978): Any amino acid
  MOD_RES (2987)..(2995): Any amino acid
  MOD_RES (3004)..(3098): Any amino acid
  MOD_RES (3109)..(3114): Any amino acid
  MOD_RES (3123)..(3131): Any amino acid
  MOD_RES (3140)..(3143): Any amino acid
  MOD_RES (3153)..(3210): Any amino acid
  MOD_RES (3223)..(3227): Any amino acid
  MOD_RES (3240)..(3326): Any amino acid
  MOD_RES (3335)..(3344): Any amino acid
  MOD_RES (3360)..(3368): Any amino acid
  MOD_RES (3378)..(3379): Any amino acid
  MOD_RES (3391)..(3392): Any amino acid
  MOD_RES (3405)..(3411): Any amino acid
  MOD_RES (3427)..(3454): Any amino acid
  MOD_RES (3463)..(3479): Any amino acid
  MOD_RES (3498)..(3556): Any amino acid
XXXXXXXXXXXXXXXXXXXXXXXXXXXXXXXXXXXNKIKQKTKQIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDAATQVRVXXXXXXXXXXXXXXXXXXXXXXXXXXXXXXXXXEPVDVDCFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLELGGCVTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVGAKQENWNXXXXXXXXXXXXXXXXXXXXXXXXXXXXXXXXXXXCQVQTAVDXXXXXXXXXXXXXXXXXXXXXXXXXXXXXXXXXXXXXXXXXXXXXXXXXXXXXXXXXXXXXXXXXXALGNQEGSLKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNPPFGDSYXXXXXXXXXXXXXXXXXXXXXXXXXXXXXXGVERLAVMGDTAWDFGSTGGXXXXXXXXXXXXXXXXXXXXXXXXXXXXXXXXXXXXXXXXXXXXXXXXXXXXXXXXXXXXXXXXXXXXXXXXXXXXXXXELKCGDGIFXXXXSDDWLNKYSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAVHTDQSLWXXXXXXXXXXXXXXXXXXXXXXXXXWPRTHTLWGEGXXXXXXXXXXXXXXXXXXXXXXXXXXXXXXXXXXXXXXXXXXXXXXXXXXXXXXXXXXXXXXXXXXXXXXXXXXEWCCRTCTLPPVTXXGSDGCWYPMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWHVTRGAALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLYGNGILVXXXXXXXXXXXXXXXXXXXXXXXXXXXXXXXXXXXXXXTTILDMHPGSGXXXXXXXXXXXXXXXXXXXXXXXXXXRVVLSEMKEAFXGLDVKFHTXXXXXXXXGREVIDAMCHATLTYRMLEPXGRQNWEVAIMDEAHFLDPASIAARGHLYHRARANESATILXXXXXXXXXXXXXXXXXXXXXXXXXXXXXXXXXXXXXXXXXXXXXXXXXAWFLPSIRXXXXXXXXXXXXXXXVVVLNRKTFEXXXXXXXXXXXXXXXXXXXXXXXXXXXXXXVIDCRTAFKPVLVXXXXXXXXXXXXXXXXXXXXXXXXXXXXXXXXXXXXXXXXXXXXXXXXXXXXXWKEASMLLDNMXXXXXXXXXXXXXXXXXXXXXPGEMRLRDDXXXXXXXLMKRGDLPVWLSWXXXXXXXXXXSRNWTWEGXXXXXXXXXXXXXXXXXXXXXXXXXXXXXXXXXXXXXXXXXXXXXXXXYASGRRSFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVIPEPGQQRSSDDNKLAXXXXXXXXXXXXXXXXXXXXXXXXXXXXXXXXXXXXXXXXXXXXXXXXXXDLKPGAAWTVYVGIVTXXXXXXXXXXXXXXXXXXXXXXXXXXXXXXXXXXXXXXXXXXXXXXXXXXXXXXXXXXXXXXXXXXXXXXXXHWSLILPGIKAQQSQRAHKVFFSGVAKNPVVDGXXXXXXXXXXXXXXXXXXXXXXXXXXXXXXXXXXXXXXXXXXXXXXXXXXXXXXXXXXXXXXXXXXDTLWTMPVAXXXTGVMRGNHYAFVGVXXXXXXXXXXXXXXXXXXXXGKTLGEVWKXXXXXXXXXXXXXXXXXXXXXXXXXXXXXXXXXXXXXXXXPVSRGTAKLAWLEEXXXXXXXXKVMDLGCGRGGWCYYAXXXXXXXSVKGFTLGRDGHXXXXXXXXXXXXXXXXXXXXXXXXXXXXXSDTLLCDIGESNPDXXXXXXXXXXXXXXXXXXXXXXXXXXXXXXXXXXXXXXXXXXXXXXXXXXXXXVIRNPLSRNSTHEMYYVSXXXXXXXXXXXXXXXXXXXXXXXXXXXXXXXXXXXXXXXXXXXXXXXXXXXXXXXXXXXXXXXXXXXXXXXXXXXXXPYRTWHYCGSYVXXXXGSAASMVNGVVKILTYPWDRXXXXXRMAMTDTTXXXXXXXXXEKVDTKAQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKLSEFGKAKXXXXXXYMWLGSRFXXXXXXXXXNEDHWASRXXXXSGVEGIGLQXXXXXXXXXXXXXXXXXXXXXXXXXXXXXXXXXXXXXXXXXXXXXXXXXXXXXXXXXXTYKAKVVKVARPXXXXXAYMDVITRRDQRXXXXXXXXXXXXXXXXXXXXXXXXXXXXXXXXXXXXXXXXXXXXXXXXXXXXXXXXXXXXXXXXXXXXXXXXXXXXXXXXXXXXXXXMGKVRKDVXXXXXXXXXXNWENVPFCSNHFQEIXXXXXXXXXVPCREQDELXXRARVSPGCGWSXXETACLSKAYGQMXXXXXXXKRDMRLLGLAICSAVXXXXXXXXXXXXXXXXXXXXXXXXXXXXVWNRVWITXXXXXXXXXXXXXXXXXPYLPKSHDKLCGSLIGMTXXXXXXXXXXXXXXXXXXXXXXXXXXXXXXXXXXXXXXXXXXXXXXXXXXXXXXXXXXX

SEQ ID NO: 265882 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(34): Any amino acid
  MOD_RES (47)..(207): Any amino acid
  MOD_RES (217)..(338): Any amino acid
  MOD_RES (348)..(411): Any amino acid
  MOD_RES (429)..(464): Any amino acid
  MOD_RES (474)..(582): Any amino acid
  MOD_RES (593)..(714): Any amino acid
  MOD_RES (724)..(752): Any amino acid
  MOD_RES (773)..(851): Any amino acid
  MOD_RES (861)..(864): Any amino acid
  MOD_RES (874)..(1041): Any amino acid
  MOD_RES (1054)..(1075): Any amino acid
  MOD_RES (1086)..(1161): Any amino acid
  MOD_RES (1174)..(1175): Any amino acid
  MOD_RES (1189)..(1634): Any amino acid
  MOD_RES (1649)..(1738): Any amino acid
  MOD_RES (1748)..(1785): Any amino acid
  MOD_RES (1800)..(1813): Any amino acid
  MOD_RES (1834)..(1850): Any amino acid
  MOD_RES (1871)..(1879): Any amino acid
  MOD_RES (1920)..(1957): Any amino acid
  MOD_RES (1969)..(1983): Any amino acid
  MOD_RES (1993)..(2002): Any amino acid
  MOD_RES (2022)..(2022): Any amino acid
  MOD_RES (2037)..(2053): Any amino acid
  MOD_RES (2067)..(2089): Any amino acid
  MOD_RES (2101)..(2121): Any amino acid
  MOD_RES (2131)..(2137): Any amino acid
  MOD_RES (2150)..(2339): Any amino acid
  MOD_RES (2358)..(2410): Any amino acid
  MOD_RES (2424)..(2495): Any amino acid
  MOD_RES (2529)..(2548): Any amino acid
  MOD_RES (2558)..(2594): Any amino acid
  MOD_RES (2606)..(2606): Any amino acid
  MOD_RES (2621)..(2640): Any amino acid
  MOD_RES (2650)..(2689): Any amino acid
  MOD_RES (2701)..(2710): Any amino acid
  MOD_RES (2728)..(2734): Any amino acid
  MOD_RES (2750)..(2775): Any amino acid
  MOD_RES (2790)..(2842): Any amino acid
  MOD_RES (2861)..(2937): Any amino acid
  MOD_RES (2950)..(2953): Any amino acid
  MOD_RES (2973)..(2979): Any amino acid
  MOD_RES (3004)..(3087): Any amino acid
  MOD_RES (3138)..(3168): Any amino acid
  MOD_RES (3183)..(3206): Any amino acid
  MOD_RES (3223)..(3229): Any amino acid
  MOD_RES (3252)..(3299): Any amino acid
  MOD_RES (3313)..(3323): Any amino acid
  MOD_RES (3335)..(3344): Any amino acid
  MOD_RES (3360)..(3368): Any amino acid
  MOD_RES (3392)..(3392): Any amino acid
  MOD_RES (3405)..(3406): Any amino acid
  MOD_RES (3428)..(3431): Any amino acid
  MOD_RES (3443)..(3443): Any amino acid
  MOD_RES (3454)..(3482): Any amino acid
  MOD_RES (3498)..(3556): Any amino acid
XXXXXXXXXXXXXXXXXXXXXXXXXXXXXXXXXXSQLAKRFSKGLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEPEDIDCWCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLEHGSCVTXXXXXXXXXXXXXXXXXXXXXXXXXXXXXXXXXXXXXXXXXXXXXXXXXXXXXXXXXXXXXXXXVDRGWGNGCGLFGKGSLXXXXXXXXXXXXXXXXXXXXXXXXXXXXXXXXXXXXTGDQHQVGNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLGSQEGAMHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEPPFGESYIXXXXXXXXXXXXXXXXXXXXXXXXXXXXXGARRMAILGDTAWDFGSIGGXXXXXXXXXXXXXXXXXXXXXXXXXXXXXXXXXXXXXXXXXXXXXXXXXXXXXXXXXXXXXXXXXXXXXXXXXXXXXXXELKCGSGIFXXXXVHTWTEQYKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAVHADMGYWIESXXXXXXXXXXXXXXXXXXXXXXWPKSHTLWSNXXXXXXXXXXXXXXXXXXXXXXXXXXXXXXXXXXXXXXXXXXXXXXXXXXXXXXXXXXXXXXXXXXXXXXXXXXXXWCCRSCTLPPLRXXGEDGCWYGMEIRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFHTMWHVTRGAVLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGLYGNGVVTXXXXXXXXXXXXXXXXXXXXXXXXXXXXXXXXXXXXXXLTIMDLHPGSGKTRXXXXXXXXXXXXXXLRTLILAPTRVVAAEMEEALXXXXXXXXXXXXXXXXXGREIVDLMCHATFTMRLLSPXXXXXXXXXIMDEAHFTDPASIAARGYISTRVGMGEAAAIFMTATPPGSXXXXXXXXXXXXXXXXXXXXXXXXXXXXXXXXXXXXXXGKTVWFVPSIKXXXXXXXXXXXXXXXVIQLSRKTFXXXXXXXXXXDWDFVVTTDISEMGANFKAXRVIDPRRCLKPVILXXXXXXXXXXXXXXXXXASAAQRRGRIGRNXXXXXXXXXXXXXXXXXXXXXXXWTEAKMLLDNIXXXXXXXXXXXXXXXXXXXXXDGEYRLRGEXXXXXXXLMRRGDLPVWLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLIPEPEKQRTPQDNQLAXXXXXXXXXXXXXXXXXXXXXXXXXXXXXXXXXXXXXXXXXXXXXXXXXXXXXPASAWTLYAVATTXXXXXXXXXXXXXXXXXXXXXXXXXXXXXXXXXXXXXXXXXXXXXXXXXXXXXXXXXXXXXXXXXXXXXXXXHYAIIGPGLQAKATREAQKRTAAGIMKNPTVDGXXXXXXXXXXXXXXXXXXXXFEKQLGQVMXXXXXXXXXXXXXXXXXXXXXXXXXXXXXXXXXXXXXGKFWNTTIAVSXANIFRGSYLAGAGLXXXXXXXXXXXXXXXXXXXXGETLGEKWKXXXXXXXXXXXXXXXXXXXXXXXXXXXXXXXXXXXXXXXXAVSRGTAKLRWXXXXXXXXXXGKVIDLGCGRGGWSYYCXXXXXXXEVKGYTKGGPGHEEPXXXXXXXXXXXXXXXXXXXXXXXXXXCDTLLCDIGESSPNXXXXXXXXXXXXXXXXXXXXXXXXXXXXXXXXXXXXXXXXXXXXXXXXXXXXXLVRNPLSRNSTHEMYWVSXXXXXXXXXXXXXXXXXXXXXXXXXXXXXXXXXXXXXXXXXXXXXXXXXXXXXXXXXXXXXXXXXXXXXXXXXXXXXPYKTWAYHGSYEXXXXGSASSMVNGVVKLLTKPWDXXXXXXXMAMTDTTPFGQQRVFKEKVDTRTPXXXXXXXXXXXXXXXXXXXXXXXXXXXXXXXXXXXXXXXXXXXXXXXXXXXXXXXXXXXXXXXXXXXXXXXXXXXXXXXXXXXXTCVYNMMGKREKKLGEFGKAKGSRAIWYMWLGARFLEFEALGFLNEDHWFXXXXXXXXXXXXXXXXXXXXXXXXXXXXXXXMYADDTAGWDTRITXXXXXXXXXXXXXXXXXXXXXXXXIFKLTYQNKVVRVQRPXXXXXXXMDVISRRDQRGSGQVGTYGLNTXXXXXXXXXXXXXXXXXXXXXXXXXXXXXXXXXXXXXXXXXXXXXXXXRMAISGDDCVVKPXXXXXXXXXXXLNDMGKVRKDIXXXXXXXXXXDWQQVPFCSHHFHELXXXXXXXXXVPCRNQDELIGRARISQGAGWSLXETACLGKSYAQMXXLMYFHRRDLRLAANAICSAVPXXXXPTSRTTWSIHAXHQWMTTEDMLXXXXXXXXXXXXXXXXXXXXXXXXXXXXXGKREDQWCGSLIGLTXXXXXXXXXXXXXXXXXXXXXXXXXXXXXXXXXXXXXXXXXXXXXXXXXXXXXXXXXXX

SEQ ID NO: 265883 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(34): Any amino acid
  MOD_RES (47)..(207): Any amino acid
  MOD_RES (217)..(338): Any amino acid
  MOD_RES (348)..(411): Any amino acid
  MOD_RES (429)..(464): Any amino acid
  MOD_RES (474)..(582): Any amino acid
  MOD_RES (593)..(714): Any amino acid
  MOD_RES (724)..(752): Any amino acid
  MOD_RES (773)..(851): Any amino acid
  MOD_RES (861)..(864): Any amino acid
  MOD_RES (874)..(1041): Any amino acid
  MOD_RES (1054)..(1075): Any amino acid
  MOD_RES (1086)..(1161): Any amino acid
  MOD_RES (1174)..(1175): Any amino acid
  MOD_RES (1189)..(1634): Any amino acid
  MOD_RES (1649)..(1738): Any amino acid
  MOD_RES (1748)..(1785): Any amino acid
  MOD_RES (1800)..(1813): Any amino acid
  MOD_RES (1834)..(1850): Any amino acid
  MOD_RES (1871)..(1879): Any amino acid
  MOD_RES (1920)..(1957): Any amino acid
  MOD_RES (1969)..(1983): Any amino acid
  MOD_RES (1993)..(2002): Any amino acid
  MOD_RES (2022)..(2022): Any amino acid
  MOD_RES (2037)..(2053): Any amino acid
  MOD_RES (2067)..(2089): Any amino acid
  MOD_RES (2101)..(2121): Any amino acid
  MOD_RES (2131)..(2137): Any amino acid
  MOD_RES (2150)..(2339): Any amino acid
  MOD_RES (2358)..(2410): Any amino acid
  MOD_RES (2424)..(2495): Any amino acid
  MOD_RES (2529)..(2548): Any amino acid
  MOD_RES (2558)..(2594): Any amino acid
  MOD_RES (2606)..(2606): Any amino acid
  MOD_RES (2621)..(2640): Any amino acid
  MOD_RES (2650)..(2689): Any amino acid
  MOD_RES (2701)..(2710): Any amino acid
  MOD_RES (2728)..(2734): Any amino acid
  MOD_RES (2750)..(2775): Any amino acid
  MOD_RES (2790)..(2842): Any amino acid
  MOD_RES (2861)..(2937): Any amino acid
  MOD_RES (2950)..(2953): Any amino acid
  MOD_RES (2973)..(2979): Any amino acid
  MOD_RES (3004)..(3087): Any amino acid
  MOD_RES (3138)..(3168): Any amino acid
  MOD_RES (3183)..(3206): Any amino acid
  MOD_RES (3223)..(3229): Any amino acid
  MOD_RES (3252)..(3299): Any amino acid
  MOD_RES (3313)..(3323): Any amino acid
  MOD_RES (3335)..(3344): Any amino acid
  MOD_RES (3360)..(3368): Any amino acid
  MOD_RES (3392)..(3392): Any amino acid
  MOD_RES (3405)..(3406): Any amino acid
  MOD_RES (3428)..(3431): Any amino acid
  MOD_RES (3443)..(3443): Any amino acid
  MOD_RES (3454)..(3482): Any amino acid
  MOD_RES (3498)..(3556): Any amino acid
XXXXXXXXXXXXXXXXXXXXXXXXXXXXXXXXXXQQLTKRFSLGMLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEPDDVDCWCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLEHGGCVTXXXXXXXXXXXXXXXXXXXXXXXXXXXXXXXXXXXXXXXXXXXXXXXXXXXXXXXXXXXXXXXXTDRGWGNGCGLFGKGGIXXXXXXXXXXXXXXXXXXXXXXXXXXXXXXXXXXXXSGEEHAVGNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXALGSQEGALHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEPPFGDSYIXXXXXXXXXXXXXXXXXXXXXXXXXXXXXGAKRLAALGETAWDFGSVGGXXXXXXXXXXXXXXXXXXXXXXXXXXXXXXXXXXXXXXXXXXXXXXXXXXXXXXXXXXXXXXXXXXXXXXXXXXXXXXXELRCGSGVFXXXXVEAWMDRYKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAIHSDLSYWIESXXXXXXXXXXXXXXXXXXXXXXWPETHTLWGDXXXXXXXXXXXXXXXXXXXXXXXXXXXXXXXXXXXXXXXXXXXXXXXXXXXXXXXXXXXXXXXXXXXXXXXXXXXXWCCRSCTMPPLRXXTDSDCWYAMEIRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFHTLWHTTKGAALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGLYGNGVIMXXXXXXXXXXXXXXXXXXXXXXXXXXXXXXXXXXXXXXITVMDLHPGAGKTKXXXXXXXXXXXXXXLRTAVLAPTRVVASEMAEALXXXXXXXXXXXXXXXXXGKEIVDVMCHATLTHRLMSPXXXXXXXXXVMDEAHFTDPSSVAARGYISTRVEMGEAAGVFMTATPPGTXXXXXXXXXXXXXXXXXXXXXXXXXXXXXXXXXXXXXXGKTVWFVPSVKXXXXXXXXXXXXXXXVVQLNRKSYXXXXXXXXXXDWDYVITTDISEMGANFRAXRVIDPRRCMKPVILXXXXXXXXXXXXXXXXXSSAAQRRGRVGRNXXXXXXXXXXXXXXXXXXXXXXXWKEARIMLDNIXXXXXXXXXXXXXXXXXXXXXDGEYRLKGEXXXXXXXLLRRGDLPVWLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLIPEPDRQRTPQDNQLTXXXXXXXXXXXXXXXXXXXXXXXXXXXXXXXXXXXXXXXXXXXXXXXXXXXXXPATAWSLYAVTTAXXXXXXXXXXXXXXXXXXXXXXXXXXXXXXXXXXXXXXXXXXXXXXXXXXXXXXXXXXXXXXXXXXXXXXXXHYAYMVPGWQAEAMREAQKRAAAGIMKNAVVDGXXXXXXXXXXXXXXXXXXXXFEKQLGQIMXXXXXXXXXXXXXXXXXXXXXXXXXXXXXXXXXXXXXGRVWNATTAIGXCHIMRGGWLSCLSIXXXXXXXXXXXXXXXXXXXXGRTLGEVWKXXXXXXXXXXXXXXXXXXXXXXXXXXXXXXXXXXXXXXXXAVSRGSAKLRWXXXXXXXXXXGKVVDLGCGRGGWCYYMXXXXXXXEVKGLTKGGAGHEEPXXXXXXXXXXXXXXXXXXXXXXXXXXVDTLLCDIGESSPSXXXXXXXXXXXXXXXXXXXXXXXXXXXXXXXXXXXXXXXXXXXXXXXXXXXXXLVRCPLSRNSTHEMYWISXXXXXXXXXXXXXXXXXXXXXXXXXXXXXXXXXXXXXXXXXXXXXXXXXXXXXXXXXXXXXXXXXXXXXXXXXXXXXPYRTWNYHGSYDXXXXGSASSMINGVVRLLTKPWDXXXXXXXIAMTDTTAFGQQRVFKEKVDTRTQXXXXXXXXXXXXXXXXXXXXXXXXXXXXXXXXXXXXXXXXXXXXXXXXXXXXXXXXXXXXXXXXXXXXXXXXXXXXXXXXXXXXSCIYNMMGKREKKPGEFGRAKGSRAIWYMWLGARYLEFEALGFMNEDHWFXXXXXXXXXXXXXXXXXXXXXXXXXXXXXXXIYADDTAGWDTKVTXXXXXXXXXXXXXXXXXXXXXXXXIIELTYQNKVVKVQRPXXXXXXXMDIISRKDQRGSGQVVTYALNTXXXXXXXXXXXXXXXXXXXXXXXXXXXXXXXXXXXXXXXXXXXXXXXXRMAVSGDDCVVRPXXXXXXXXXXXLNDMGKIRKDIXXXXXXXXXXDWTQVPFCSHHFHQLXXXXXXXXXVPCRPQDELVGRARVSQGAGWSLXETACLGKAYAQMXXLLYFHRRDLRLASNAICSAVPXXXXPTGRTTWSIHAXHEWMTTEDMLXXXXXXXXXXXXXXXXXXXXXXXXXXXXXGKREDIWCGSLIGTRXXXXXXXXXXXXXXXXXXXXXXXXXXXXXXXXXXXXXXXXXXXXXXXXXXXXXXXXXXX

SEQ ID NO: 265884 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(34): Any amino acid
  MOD_RES (47)..(207): Any amino acid
  MOD_RES (217)..(338): Any amino acid
  MOD_RES (348)..(411): Any amino acid
  MOD_RES (429)..(464): Any amino acid
  MOD_RES (474)..(582): Any amino acid
  MOD_RES (593)..(714): Any amino acid
  MOD_RES (724)..(752): Any amino acid
  MOD_RES (773)..(851): Any amino acid
  MOD_RES (861)..(864): Any amino acid
  MOD_RES (874)..(1041): Any amino acid
  MOD_RES (1054)..(1075): Any amino acid
  MOD_RES (1086)..(1161): Any amino acid
  MOD_RES (1174)..(1175): Any amino acid
  MOD_RES (1187)..(1634): Any amino acid
  MOD_RES (1649)..(1738): Any amino acid
  MOD_RES (1748)..(1785): Any amino acid
  MOD_RES (1800)..(1813): Any amino acid
  MOD_RES (1834)..(1850): Any amino acid
  MOD_RES (1871)..(1879): Any amino acid
  MOD_RES (1920)..(1957): Any amino acid
  MOD_RES (1969)..(1983): Any amino acid
  MOD_RES (1993)..(2002): Any amino acid
  MOD_RES (2022)..(2022): Any amino acid
  MOD_RES (2037)..(2057): Any amino acid
  MOD_RES (2067)..(2089): Any amino acid
  MOD_RES (2101)..(2121): Any amino acid
  MOD_RES (2131)..(2137): Any amino acid
  MOD_RES (2150)..(2339): Any amino acid
  MOD_RES (2358)..(2410): Any amino acid
  MOD_RES (2424)..(2495): Any amino acid
  MOD_RES (2529)..(2548): Any amino acid
  MOD_RES (2558)..(2594): Any amino acid
  MOD_RES (2606)..(2606): Any amino acid
  MOD_RES (2621)..(2640): Any amino acid
  MOD_RES (2650)..(2689): Any amino acid
  MOD_RES (2701)..(2710): Any amino acid
  MOD_RES (2728)..(2734): Any amino acid
  MOD_RES (2750)..(2775): Any amino acid
  MOD_RES (2790)..(2842): Any amino acid
  MOD_RES (2861)..(2937): Any amino acid
  MOD_RES (2950)..(2953): Any amino acid
  MOD_RES (2973)..(2979): Any amino acid
  MOD_RES (2989)..(2993): Any amino acid
  MOD_RES (3004)..(3087): Any amino acid
  MOD_RES (3138)..(3168): Any amino acid
  MOD_RES (3178)..(3206): Any amino acid
  MOD_RES (3223)..(3229): Any amino acid
  MOD_RES (3252)..(3299): Any amino acid
  MOD_RES (3312)..(3323): Any amino acid
  MOD_RES (3335)..(3344): Any amino acid
  MOD_RES (3360)..(3368): Any amino acid
  MOD_RES (3392)..(3392): Any amino acid
  MOD_RES (3405)..(3406): Any amino acid
  MOD_RES (3428)..(3431): Any amino acid
  MOD_RES (3443)..(3443): Any amino acid
  MOD_RES (3454)..(3482): Any amino acid
  MOD_RES (3498)..(3556): Any amino acid
XXXXXXXXXXXXXXXXXXXXXXXXXXXXXXXXXXSQLAKRFSRGLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDPEDIDCWCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLEGDSCVTXXXXXXXXXXXXXXXXXXXXXXXXXXXXXXXXXXXXXXXXXXXXXXXXXXXXXXXXXXXXXXXXSDRGWGNHCGLFGKGSIXXXXXXXXXXXXXXXXXXXXXXXXXXXXXXXXXXXXNGDTHAVGNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXALGSQEGGLHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEPPFGESNIXXXXXXXXXXXXXXXXXXXXXXXXXXXXXGAQRMAIIGETAWDFGSLGGXXXXXXXXXXXXXXXXXXXXXXXXXXXXXXXXXXXXXXXXXXXXXXXXXXXXXXXXXXXXXXXXXXXXXXXXXXXXXXXEMRCGSGIFXXXXVEAWVDRYKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAVHGSPTFWMGSXXXXXXXXXXXXXXXXXXXXXXWPKTHTLWSNXXXXXXXXXXXXXXXXXXXXXXXXXXXXXXXXXXXXXXXXXXXXXXXXXXXXXXXXXXXXXXXXXXXXXXXXXXXXWCCRSCSLPPLRXXTENGCWYGMEIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFHTMWHVTRGSVIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGLYGNGVELXXXXXXXXXXXXXXXXXXXXXXXXXXXXXXXXXXXXXXMTVLDLHPGAGKTRXXXXXXXXXXXXXXLRTLVLAPTRVVAAEMAEALXXXXXXXXXXXXXXXXXGNAVVDLMCHATFTTRLLSSXXXXXXXXXIMDEAHFTDPSSIAARGYISTKVELNKCALVFMTATPPGAXXXXXXXXXXXXXXXXXXXXXXXXXXXXXXXXXXXXXXGKTVWFVASVKXXXXXXXXXXXXXXXVIQLNRKSYXXXXXXXXXXDWDFVITTDISEMGANFGAXRVIDSRKSVKPTIIXXXXXXXXXXXXXXXXXXXXXQRRGRVGRQXXXXXXXXXXXXXXXXXXXXXXXWTEAKIMLDNIXXXXXXXXXXXXXXXXXXXXXDGEFRLRGEXXXXXXXLLTTADLPVWLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLIPEPEKQRSQTDNQLAXXXXXXXXXXXXXXXXXXXXXXXXXXXXXXXXXXXXXXXXXXXXXXXXXXXXXPATAWALYGGSTVXXXXXXXXXXXXXXXXXXXXXXXXXXXXXXXXXXXXXXXXXXXXXXXXXXXXXXXXXXXXXXXXXXXXXXXXHYGYMLPGWQAEALRSAQRVTFSAMVRNPMVDGXXXXXXXXXXXXXXXXXXXXMQKKVGQIMXXXXXXXXXXXXXXXXXXXXXXXXXXXXXXXXXXXXXSSVWNSTTATGXCHVMRGSYLAGGSIXXXXXXXXXXXXXXXXXXXXGRTLGEQWKXXXXXXXXXXXXXXXXXXXXXXXXXXXXXXXXXXXXXXXXPVSRGSAKLQWXXXXXXXXXXGRVMDLGCGRGGWSYYMXXXXXXXEVRGYTLGRDGHEKPXXXXXXXXXXXXXXXXXXXXXXXXXXSDTIFCDIGESSSSXXXXXXXXXXXXXXXXXXXXXXXXXXXXXXXXXXXXXXXXXXXXXXXXXXXXXLVRLPFSRNSNHEMYWVSXXXXXXXXXXXXXXXXXXXXXXXXXXXXXXXXXXXXXXXXXXXXXXXXXXXXXXXXXXXXXXXXXXXXXXXXXXXXXPYRTWTYHGSYEXXXXGSASSLVNGVVRLLSKPWDXXXXXXXLAMTDTTPFXXXXXFKEKVDTKAPXXXXXXXXXXXXXXXXXXXXXXXXXXXXXXXXXXXXXXXXXXXXXXXXXXXXXXXXXXXXXXXXXXXXXXXXXXXXXXXXXXXXTCIYNMMGKREKKLGEFGVAKGSRAIWFMWLGSRFLEFEALGFLNEDHWLXXXXXXXXXXXXXXXXXXXXXXXXXXXXXXXFYADDTAGWXXXXXXXXXXXXXXXXXXXXXXXXXXXXXIMQLTYRHKVVKVMRPXXXXXXXMDIISREDQRGSGQVVTYGLNTXXXXXXXXXXXXXXXXXXXXXXXXXXXXXXXXXXXXXXXXXXXXXXXXRMLVSGDDCVVRXXXXXXXXXXXXLNAMSKVRKDIXXXXXXXXXXNWQEVPFCSNHFTELXXXXXXXXXVPCRGQDELVGRARISPGAGWNVXDTACLAKSYAQMXXLSYFHRRDLRLMSMAICSAVPXXXXPTGRTSWSIHSXGAWMTTEDMLXXXXXXXXXXXXXXXXXXXXXXXXXXXXXGKREDLWCGSLIGLSXXXXXXXXXXXXXXXXXXXXXXXXXXXXXXXXXXXXXXXXXXXXXXXXXXXXXXXXXXX

SEQ ID NO: 265885 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(34): Any amino acid
  MOD_RES (47)..(207): Any amino acid
  MOD_RES (217)..(338): Any amino acid
  MOD_RES (348)..(419): Any amino acid
  MOD_RES (429)..(464): Any amino acid
  MOD_RES (474)..(582): Any amino acid
  MOD_RES (593)..(714): Any amino acid
  MOD_RES (724)..(752): Any amino acid
  MOD_RES (773)..(851): Any amino acid
  MOD_RES (861)..(864): Any amino acid
  MOD_RES (874)..(1041): Any amino acid
  MOD_RES (1054)..(1075): Any amino acid
  MOD_RES (1086)..(1161): Any amino acid
  MOD_RES (1174)..(1175): Any amino acid
  MOD_RES (1187)..(1634): Any amino acid
  MOD_RES (1649)..(1738): Any amino acid
  MOD_RES (1748)..(1785): Any amino acid
  MOD_RES (1800)..(1821): Any amino acid
  MOD_RES (1834)..(1850): Any amino acid
  MOD_RES (1871)..(1881): Any amino acid
  MOD_RES (1920)..(1957): Any amino acid
  MOD_RES (1969)..(1983): Any amino acid
  MOD_RES (1993)..(2002): Any amino acid
  MOD_RES (2022)..(2022): Any amino acid
  MOD_RES (2037)..(2089): Any amino acid
  MOD_RES (2101)..(2121): Any amino acid
  MOD_RES (2131)..(2137): Any amino acid
  MOD_RES (2150)..(2339): Any amino acid
  MOD_RES (2358)..(2410): Any amino acid
  MOD_RES (2424)..(2495): Any amino acid
  MOD_RES (2529)..(2548): Any amino acid
  MOD_RES (2558)..(2594): Any amino acid
  MOD_RES (2606)..(2606): Any amino acid
  MOD_RES (2621)..(2640): Any amino acid
  MOD_RES (2650)..(2689): Any amino acid
  MOD_RES (2701)..(2710): Any amino acid
  MOD_RES (2728)..(2734): Any amino acid
  MOD_RES (2750)..(2775): Any amino acid
  MOD_RES (2790)..(2842): Any amino acid
  MOD_RES (2861)..(2937): Any amino acid
  MOD_RES (2950)..(2953): Any amino acid
  MOD_RES (2973)..(2979): Any amino acid
  MOD_RES (2989)..(2994): Any amino acid
  MOD_RES (3004)..(3087): Any amino acid
  MOD_RES (3097)..(3097): Any amino acid
  MOD_RES (3111)..(3113): Any amino acid
  MOD_RES (3124)..(3128): Any amino acid
  MOD_RES (3138)..(3206): Any amino acid
  MOD_RES (3223)..(3229): Any amino acid
  MOD_RES (3243)..(3323): Any amino acid
  MOD_RES (3335)..(3344): Any amino acid
  MOD_RES (3360)..(3368): Any amino acid
  MOD_RES (3392)..(3392): Any amino acid
  MOD_RES (3405)..(3406): Any amino acid
  MOD_RES (3428)..(3431): Any amino acid
  MOD_RES (3443)..(3443): Any amino acid
  MOD_RES (3453)..(3482): Any amino acid
  MOD_RES (3498)..(3556): Any amino acid
XXXXXXXXXXXXXXXXXXXXXXXXXXXXXXXXXXQGLVKRFSTGLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDPEDVDCWCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLEGDSCLTXXXXXXXXXXXXXXXXXXXXXXXXXXXXXXXXXXXXXXXXXXXXXXXXXXXXXXXXXXXXXXXXXXXXXXXXCGLFGKGGVXXXXXXXXXXXXXXXXXXXXXXXXXXXXXXXXXXXXSGEENAVGNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNLGDQTGVLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQLPPGDNIIXXXXXXXXXXXXXXXXXXXXXXXXXXXXXGIERLTVMGDHAWDFGSTGGXXXXXXXXXXXXXXXXXXXXXXXXXXXXXXXXXXXXXXXXXXXXXXXXXXXXXXXXXXXXXXXXXXXXXXXXXXXXXXXELRCGEGLVXXXXVSEWYDNYAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSAHTDQSLWMKSXXXXXXXXXXXXXXXXXXXXXXWPASHTIDNAXXXXXXXXXXXXXXXXXXXXXXXXXXXXXXXXXXXXXXXXXXXXXXXXXXXXXXXXXXXXXXXXXXXXXXXXXXXXWCCRSCTMPPVSXXTGTDCWYAMEIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLHTLWHTTRGAAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGLYGNGLKTXXXXXXXXXXXXXXXXXXXXXXXXXXXXXXXXXXXXXXITVLDMHPGSGKTHXXXXXXXXXXXXXXXXXXXXXXTRVVLKEMERALXXXXXXXXXXXXXXXXXGGEVIDVMCHATYVNRRLLPXXXXXXXXXXXDEAHWTDPHSIAARGYIATLAKENESATILMTATPPGKXXXXXXXXXXXXXXXXXXXXXXXXXXXXXXXXXXXXXXRRTAWFVPSIAXXXXXXXXXXXXXXXVICLNSKTFXXXXXXXXXXKPDFVVTTDISEMGANLDVXRVIDCRKSVKPTILXXXXXXXXXXXXXXXXXXXXXXXXXXXXXXXXXXXXXXXXXXXXXXXXXXXXXWTEAQILLDNIXXXXXXXXXXXXXXXXXXXXXAGHFRLTEEXXXXXXXLVRHCDFTPWLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVQPEAGKQRTPQDNQLIXXXXXXXXXXXXXXXXXXXXXXXXXXXXXXXXXXXXXXXXXXXXXXXXXXXXXPARSWGTYVLVVSXXXXXXXXXXXXXXXXXXXXXXXXXXXXXXXXXXXXXXXXXXXXXXXXXXXXXXXXXXXXXXXXXXXXXXXXHLAIVVSGLEAELTRAAHKVFFAGIMKNPTIDGXXXXXXXXXXXXXXXXXXXXMQKKVGQVLXXXXXXXXXXXXXXXXXXXXXXXXXXXXXXXXXXXXXSALWTMPVACGXSGVVRGSLWGFLPLXXXXXXXXXXXXXXXXXXXXGDTLGDLWKXXXXXXXXXXXXXXXXXXXXXXXXXXXXXXXXXXXXXXXXAVSRGSSKIRWXXXXXXXXXXGEVVDLGCGRGGWSYYAXXXXXXXGVKAYTIGGKGHETPXXXXXXXXXXXXXXXXXXXXXXXXXXADTIMCDIGESSSNXXXXXXXXXXXXXXXXXXXXXXXXXXXXXXXXXXXXXXXXXXXXXXXXXXXXXLVRTPFSRNSTHEMYYSTXXXXXXXXXXXXXXXXXXXXXXXXXXXXXXXXXXXXXXXXXXXXXXXXXXXXXXXXXXXXXXXXXXXXXXXXXXXXXPYRTWQYWGSYRXXXXGSAASLINGVVKLMSKPWDXXXXXXXMAMTDTTAFXXXXXXKEKVDTRAKXXXXXXXXXXXXXXXXXXXXXXXXXXXXXXXXXXXXXXXXXXXXXXXXXXXXXXXXXXXXXXXXXXXXXXXXXXXXXXXXXXXXHCVYNMMGKXEKKLSEFGKAKGSXXXWFMWLGARYLXXXXXGFLNEDHWAXXXXXXXXXXXXXXXXXXXXXXXXXXXXXXXXXXXXXXXXXXXXXXXXXXXXXXXXXXXXXXXXXXXXXVMEKAYHNKVVKVLRPXXXXXXXMDVITRRDQRGSGXXXXXXXXXXXXXXXXXXXXXXXXXXXXXXXXXXXXXXXXXXXXXXXXXXXXXXXXXXXXXXXXXXXXXXXXXXXXXXXXXLNDMAKTRKDIXXXXXXXXXXDWENVPFCSHHFHKIXXXXXXXXXVPCRDQDELIGRGRVSPGNGWMIXDTACLAKAYAQMXXLMYFHRRDLRTLSLAVSSAVPXXXXPQGRTTWSIHGXGAWMTTEDMXXXXXXXXXXXXXXXXXXXXXXXXXXXXXXTKRQDMLCSSLVGRKXXXXXXXXXXXXXXXXXXXXXXXXXXXXXXXXXXXXXXXXXXXXXXXXXXXXXXXXXXX

SEQ ID NO: 265886 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(34): Any amino acid
  MOD_RES (47)..(207): Any amino acid
  MOD_RES (217)..(338): Any amino acid
  MOD_RES (348)..(464): Any amino acid
  MOD_RES (474)..(582): Any amino acid
  MOD_RES (593)..(714): Any amino acid
  MOD_RES (724)..(752): Any amino acid
  MOD_RES (773)..(851): Any amino acid
  MOD_RES (861)..(864): Any amino acid
  MOD_RES (874)..(1041): Any amino acid
  MOD_RES (1052)..(1075): Any amino acid
  MOD_RES (1086)..(1163): Any amino acid
  MOD_RES (1174)..(1175): Any amino acid
  MOD_RES (1186)..(1638): Any amino acid
  MOD_RES (1649)..(1738): Any amino acid
  MOD_RES (1748)..(1785): Any amino acid
  MOD_RES (1800)..(1821): Any amino acid
  MOD_RES (1834)..(1850): Any amino acid
  MOD_RES (1871)..(1883): Any amino acid
  MOD_RES (1920)..(1958): Any amino acid
  MOD_RES (1969)..(1983): Any amino acid
  MOD_RES (1993)..(2022): Any amino acid
  MOD_RES (2037)..(2089): Any amino acid
  MOD_RES (2101)..(2121): Any amino acid
  MOD_RES (2131)..(2137): Any amino acid
  MOD_RES (2147)..(2339): Any amino acid
  MOD_RES (2358)..(2412): Any amino acid
  MOD_RES (2424)..(2495): Any amino acid
  MOD_RES (2529)..(2594): Any amino acid
  MOD_RES (2605)..(2606): Any amino acid
  MOD_RES (2621)..(2640): Any amino acid
  MOD_RES (2650)..(2689): Any amino acid
  MOD_RES (2701)..(2710): Any amino acid
  MOD_RES (2728)..(2734): Any amino acid
  MOD_RES (2747)..(2775): Any amino acid
  MOD_RES (2790)..(2842): Any amino acid
  MOD_RES (2861)..(2937): Any amino acid
  MOD_RES (2950)..(2953): Any amino acid
  MOD_RES (2973)..(2994): Any amino acid
  MOD_RES (3004)..(3097): Any amino acid
  MOD_RES (3110)..(3113): Any amino acid
  MOD_RES (3124)..(3209): Any amino acid
  MOD_RES (3223)..(3229): Any amino acid
  MOD_RES (3241)..(3325): Any amino acid
  MOD_RES (3335)..(3344): Any amino acid
  MOD_RES (3360)..(3368): Any amino acid
  MOD_RES (3378)..(3378): Any amino acid
  MOD_RES (3392)..(3392): Any amino acid
  MOD_RES (3405)..(3410): Any amino acid
  MOD_RES (3428)..(3482): Any amino acid
  MOD_RES (3498)..(3556): Any amino acid
XXXXXXXXXXXXXXXXXXXXXXXXXXXXXXXXXXSNKIKQKTKQIGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEPVDVDCFCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLELGGCVTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVGAKQENWNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXALGNQEGSLKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNPPFGDSYIXXXXXXXXXXXXXXXXXXXXXXXXXXXXXGVERLAVMGDTAWDFSSAGGXXXXXXXXXXXXXXXXXXXXXXXXXXXXXXXXXXXXXXXXXXXXXXXXXXXXXXXXXXXXXXXXXXXXXXXXXXXXXXXELKCGDGIFXXXXSDDWLNKYSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAVHTDQSLWMXXXXXXXXXXXXXXXXXXXXXXXXWPRSHTLWSNXXXXXXXXXXXXXXXXXXXXXXXXXXXXXXXXXXXXXXXXXXXXXXXXXXXXXXXXXXXXXXXXXXXXXXXXXXXXXXCRTCTLPPVTXXGSDGCWYPMEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMWHVTRGAALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGLYGNGILVXXXXXXXXXXXXXXXXXXXXXXXXXXXXXXXXXXXXXXTTILDFHPGAGKTRXXXXXXXXXXXXXXXXXXXXXXTRVVLSEMKEAFXXXXXXXXXXXXXXXXXGREVIDAMCHATLTYRMLEPXXXXXXXXXXXXXAHFLDPASIAARGHLYHRARANESATILMTATPPGTXXXXXXXXXXXXXXXXXXXXXXXXXXXXXXXXXXXXXXXPTAWFLPSIRXXXXXXXXXXXXXXXVVVLNRKTFXXXXXXXXXXXXXXXXXXXXXXXXXXXXXXRVIDCRTAFKPVLVXXXXXXXXXXXXXXXXXXXXXXXXXXXXXXXXXXXXXXXXXXXXXXXXXXXXXWKEASMLLDNMXXXXXXXXXXXXXXXXXXXXXPGEMRLRDDXXXXXXXLMKRGDLPVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVIPEPGQQRSSDDNKLAXXXXXXXXXXXXXXXXXXXXXXXXXXXXXXXXXXXXXXXXXXXXXXXXXXXXXXXAAWTVYVGIVTXXXXXXXXXXXXXXXXXXXXXXXXXXXXXXXXXXXXXXXXXXXXXXXXXXXXXXXXXXXXXXXXXXXXXXXXHWSLILPGIKAQQSQRAQRRVFHGVAKNPVVDGXXXXXXXXXXXXXXXXXXXXXXXXXXXXXXXXXXXXXXXXXXXXXXXXXXXXXXXXXXXXXXXXXXDTLWTMPVACXXTGVMRGNHYAFVGVXXXXXXXXXXXXXXXXXXXXGKTLGEVWKXXXXXXXXXXXXXXXXXXXXXXXXXXXXXXXXXXXXXXXXPVSRGTAKLAWXXXXXXXXXXGKVMDLGCGRGGWCYYAXXXXXXXSVKGFTLGRDGHXXXXXXXXXXXXXXXXXXXXXXXXXXXXXSDTLLCDIGESNPDXXXXXXXXXXXXXXXXXXXXXXXXXXXXXXXXXXXXXXXXXXXXXXXXXXXXXVIRNPLSRNSTHEMYYVSXXXXXXXXXXXXXXXXXXXXXXXXXXXXXXXXXXXXXXXXXXXXXXXXXXXXXXXXXXXXXXXXXXXXXXXXXXXXXPYRTWHYCGSYVXXXXGSAASMVNGVVKLLSWPWNXXXXXXXXXXXXXXXXXXXXXXKEKVDTKAQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEKKLSEFGKAKGXXXXWYMWLGSRFLXXXXXXXXXXXXXXXXXXXXXXXXXXXXXXXXXXXXXXXXXXXXXXXXXXXXXXXXXXXXXXXXXXXXXXXXXXXXXXXXXXXXXXMTYKAKVVKVARPXXXXXXXMDVITRRDQRGXXXXXXXXXXXXXXXXXXXXXXXXXXXXXXXXXXXXXXXXXXXXXXXXXXXXXXXXXXXXXXXXXXXXXXXXXXXXXXXXXXXXXDMGKVRKDVXXXXXXXXXXNWEEVPFCSNHFQEIXXXXXXXXXVPCREQDELXGRARVSPGCGWSVXETACLSKAYGQMXXXXXXHKRDMRLLGLAICSAVPXXXXXXXXXXXXXXXXXXXXXXXXXXXXXXXXXXXXXXXXXXXXXXXXXXXXXXXPKSHDKLCGSLIGMTXXXXXXXXXXXXXXXXXXXXXXXXXXXXXXXXXXXXXXXXXXXXXXXXXXXXXXXXXXX

SEQ ID NO: 265887 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(34): Any amino acid
  MOD_RES (47)..(411): Any amino acid
  MOD_RES (429)..(582): Any amino acid
  MOD_RES (593)..(755): Any amino acid
  MOD_RES (773)..(1041): Any amino acid
  MOD_RES (1054)..(1075): Any amino acid
  MOD_RES (1086)..(1161): Any amino acid
  MOD_RES (1174)..(1175): Any amino acid
  MOD_RES (1189)..(1634): Any amino acid
  MOD_RES (1649)..(1788): Any amino acid
  MOD_RES (1800)..(1813): Any amino acid
  MOD_RES (1834)..(1850): Any amino acid
  MOD_RES (1871)..(1879): Any amino acid
  MOD_RES (1903)..(1903): Any amino acid
  MOD_RES (1920)..(1957): Any amino acid
  MOD_RES (1968)..(2002): Any amino acid
  MOD_RES (2022)..(2022): Any amino acid
  MOD_RES (2037)..(2053): Any amino acid
  MOD_RES (2067)..(2137): Any amino acid
  MOD_RES (2150)..(2339): Any amino acid
  MOD_RES (2358)..(2410): Any amino acid
  MOD_RES (2424)..(2495): Any amino acid
  MOD_RES (2529)..(2548): Any amino acid
  MOD_RES (2559)..(2594): Any amino acid
  MOD_RES (2606)..(2606): Any amino acid
  MOD_RES (2621)..(2690): Any amino acid
  MOD_RES (2701)..(2710): Any amino acid
  MOD_RES (2728)..(2737): Any amino acid
  MOD_RES (2750)..(2775): Any amino acid
  MOD_RES (2789)..(2842): Any amino acid
  MOD_RES (2861)..(2937): Any amino acid
  MOD_RES (2949)..(2953): Any amino acid
  MOD_RES (2973)..(2979): Any amino acid
  MOD_RES (3004)..(3087): Any amino acid
  MOD_RES (3138)..(3168): Any amino acid
  MOD_RES (3183)..(3206): Any amino acid
  MOD_RES (3220)..(3229): Any amino acid
  MOD_RES (3252)..(3299): Any amino acid
  MOD_RES (3313)..(3323): Any amino acid
  MOD_RES (3335)..(3347): Any amino acid
  MOD_RES (3360)..(3373): Any amino acid
  MOD_RES (3392)..(3393): Any amino acid
  MOD_RES (3405)..(3406): Any amino acid
  MOD_RES (3420)..(3431): Any amino acid
  MOD_RES (3443)..(3443): Any amino acid
  MOD_RES (3454)..(3482): Any amino acid
  MOD_RES (3498)..(3556): Any amino acid
XXXXXXXXXXXXXXXXXXXXXXXXXXXXXXXXXXSQLAKRFSKGLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVDRGWGNGCGLFGKGSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLGSQEGAMHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRMAILGDTAWDFGSIGGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAVHADMGYWIESXXXXXXXXXXXXXXXXXXXXXXWPKSHTLWSNXXXXXXXXXXXXXXXXXXXXXXXXXXXXXXXXXXXXXXXXXXXXXXXXXXXXXXXXXXXXXXXXXXXXXXXXXXXXWCCRSCTLPPLRXXGEDGCWYGMEIRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFHTMWHVTRGAVLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMDLHPGSGKTRXXXXXXXXXXXXXXLRTLILAPTRVVAAEMEEALXXXXXXXXXXXXXXXXXGREIVDLMCHATFTMRLLSPXXXXXXXXXIMDEAHFTDPASIAARGYISTRVXMGEAAAIFMTATPPGSXXXXXXXXXXXXXXXXXXXXXXXXXXXXXXXXXXXXXXGKTVWFVPSIXXXXXXXXXXXXXXXXXXXXXXXXXXXXXXXXXXXDWDFVVTTDISEMGANFKAXRVIDPRRCLKPVILXXXXXXXXXXXXXXXXXASAAQRRGRIGRNXXXXXXXXXXXXXXXXXXXXXXXXXXXXXXXXXXXXXXXXXXXXXXXXXXXXXXXXXXXXXXXXXXXXXXXLMRRGDLPVWLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLIPEPEKQRTPQDNQLAXXXXXXXXXXXXXXXXXXXXXXXXXXXXXXXXXXXXXXXXXXXXXXXXXXXXXPASAWTLYAVATTXXXXXXXXXXXXXXXXXXXXXXXXXXXXXXXXXXXXXXXXXXXXXXXXXXXXXXXXXXXXXXXXXXXXXXXXHYAIIGPGLQAKATREAQKRTAAGIMKNPTVDGXXXXXXXXXXXXXXXXXXXXFEKQLGQVMLXXXXXXXXXXXXXXXXXXXXXXXXXXXXXXXXXXXXGKFWNTTIAVSXANIFRGSYLAGAGLXXXXXXXXXXXXXXXXXXXXXXXXXXXXXXXXXXXXXXXXXXXXXXXXXXXXXXXXXXXXXXXXXXXXXXVSRGTAKLRWXXXXXXXXXXGKVIDLGCGRGGWSYYCXXXXXXXXXXGYTKGGPGHEEPXXXXXXXXXXXXXXXXXXXXXXXXXXCDTLLCDIGESSPXXXXXXXXXXXXXXXXXXXXXXXXXXXXXXXXXXXXXXXXXXXXXXXXXXXXXXLVRNPLSRNSTHEMYWVSXXXXXXXXXXXXXXXXXXXXXXXXXXXXXXXXXXXXXXXXXXXXXXXXXXXXXXXXXXXXXXXXXXXXXXXXXXXXXPYKTWAYHGSYXXXXXGSASSMVNGVVKLLTKPWDXXXXXXXMAMTDTTPFGQQRVFKEKVDTRTPXXXXXXXXXXXXXXXXXXXXXXXXXXXXXXXXXXXXXXXXXXXXXXXXXXXXXXXXXXXXXXXXXXXXXXXXXXXXXXXXXXXXTCVYNMMGKREKKLGEFGKAKGSRAIWYMWLGARFLEFEALGFLNEDHWFXXXXXXXXXXXXXXXXXXXXXXXXXXXXXXXMYADDTAGWDTRITXXXXXXXXXXXXXXXXXXXXXXXXIFKLTYQNKVVRVXXXXXXXXXXMDVISRRDQRGSGQVGTYGLNTXXXXXXXXXXXXXXXXXXXXXXXXXXXXXXXXXXXXXXXXXXXXXXXXRMAISGDDCVVKPXXXXXXXXXXXLNDMGKVRKDIXXXXXXXXXXXXXQVPFCSHHFHELXXXXXXXXXXXXXXQDELIGRARISQGAGWSLXXTACLGKSYAQMXXLMYFHRRDLRLAAXXXXXXXXXXXXPTSRTTWSIHAXHQWMTTEDMLXXXXXXXXXXXXXXXXXXXXXXXXXXXXXGKREDQWCGSLIGLTXXXXXXXXXXXXXXXXXXXXXXXXXXXXXXXXXXXXXXXXXXXXXXXXXXXXXXXXXXX

SEQ ID NO: 265888 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(34): Any amino acid
  MOD_RES (47)..(411): Any amino acid
  MOD_RES (429)..(582): Any amino acid
  MOD_RES (593)..(755): Any amino acid
  MOD_RES (773)..(1041): Any amino acid
  MOD_RES (1054)..(1075): Any amino acid
  MOD_RES (1086)..(1161): Any amino acid
  MOD_RES (1174)..(1175): Any amino acid
  MOD_RES (1189)..(1634): Any amino acid
  MOD_RES (1649)..(1788): Any amino acid
  MOD_RES (1800)..(1813): Any amino acid
  MOD_RES (1834)..(1850): Any amino acid
  MOD_RES (1871)..(1879): Any amino acid
  MOD_RES (1903)..(1903): Any amino acid
  MOD_RES (1920)..(1957): Any amino acid
  MOD_RES (1968)..(2002): Any amino acid
  MOD_RES (2022)..(2022): Any amino acid
  MOD_RES (2037)..(2053): Any amino acid
  MOD_RES (2067)..(2137): Any amino acid
  MOD_RES (2150)..(2339): Any amino acid
  MOD_RES (2358)..(2410): Any amino acid
  MOD_RES (2424)..(2495): Any amino acid
  MOD_RES (2529)..(2548): Any amino acid
  MOD_RES (2559)..(2594): Any amino acid
  MOD_RES (2606)..(2606): Any amino acid
  MOD_RES (2621)..(2690): Any amino acid
  MOD_RES (2701)..(2710): Any amino acid
  MOD_RES (2728)..(2737): Any amino acid
  MOD_RES (2750)..(2775): Any amino acid
  MOD_RES (2789)..(2842): Any amino acid
  MOD_RES (2861)..(2937): Any amino acid
  MOD_RES (2949)..(2953): Any amino acid
  MOD_RES (2973)..(2979): Any amino acid
  MOD_RES (3004)..(3087): Any amino acid
  MOD_RES (3138)..(3168): Any amino acid
  MOD_RES (3183)..(3206): Any amino acid
  MOD_RES (3220)..(3229): Any amino acid
  MOD_RES (3252)..(3299): Any amino acid
  MOD_RES (3313)..(3323): Any amino acid
  MOD_RES (3335)..(3347): Any amino acid
  MOD_RES (3360)..(3373): Any amino acid
  MOD_RES (3392)..(3393): Any amino acid
  MOD_RES (3405)..(3406): Any amino acid
  MOD_RES (3420)..(3431): Any amino acid
  MOD_RES (3443)..(3443): Any amino acid
  MOD_RES (3454)..(3482): Any amino acid
  MOD_RES (3498)..(3556): Any amino acid
XXXXXXXXXXXXXXXXXXXXXXXXXXXXXXXXXXQQLTKRFSLGMLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTDRGWGNGCGLFGKGGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXALGSQEGALHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLAALGETAWDFGSVGGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAIHSDLSYWIESXXXXXXXXXXXXXXXXXXXXXXWPETHTLWGDXXXXXXXXXXXXXXXXXXXXXXXXXXXXXXXXXXXXXXXXXXXXXXXXXXXXXXXXXXXXXXXXXXXXXXXXXXXXWCCRSCTMPPLRXXTDSDCWYAMEIRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFHTLWHTTKGAALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMDLHPGAGKTKXXXXXXXXXXXXXXLRTAILAPTRVVASEMAEALXXXXXXXXXXXXXXXXXGKEIVDVMCHATLTHRLMSPXXXXXXXXXVMDEAHFTDPSSVAARGYISTKVXMGEAAGIFMTATPPGTXXXXXXXXXXXXXXXXXXXXXXXXXXXXXXXXXXXXXXGKTVWFVPSVXXXXXXXXXXXXXXXXXXXXXXXXXXXXXXXXXXXDWDYVITTDISEMGANFRAXRVIDPRRCMKPVILXXXXXXXXXXXXXXXXXSSAAQRRGRVGRNXXXXXXXXXXXXXXXXXXXXXXXXXXXXXXXXXXXXXXXXXXXXXXXXXXXXXXXXXXXXXXXXXXXXXXXLLRRGDLPVWLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLIPEPDRQRTPQDNQLTXXXXXXXXXXXXXXXXXXXXXXXXXXXXXXXXXXXXXXXXXXXXXXXXXXXXXPATAWSLYAVTTAXXXXXXXXXXXXXXXXXXXXXXXXXXXXXXXXXXXXXXXXXXXXXXXXXXXXXXXXXXXXXXXXXXXXXXXXHYAYMVPGWQAEAMREAQKRAAAGIMKNAVVDGXXXXXXXXXXXXXXXXXXXXFEKQLGQIMLXXXXXXXXXXXXXXXXXXXXXXXXXXXXXXXXXXXXGRFWNTTIAVSXCHIMRGGWLSCLSIXXXXXXXXXXXXXXXXXXXXXXXXXXXXXXXXXXXXXXXXXXXXXXXXXXXXXXXXXXXXXXXXXXXXXXVSRGSAKLRWXXXXXXXXXXGKVVDLGCGRGGWCYYMXXXXXXXXXXGLTKGGAGHEEPXXXXXXXXXXXXXXXXXXXXXXXXXXVDTLLCDIGESSSXXXXXXXXXXXXXXXXXXXXXXXXXXXXXXXXXXXXXXXXXXXXXXXXXXXXXXLVRCPLSRNSTHEMYWISXXXXXXXXXXXXXXXXXXXXXXXXXXXXXXXXXXXXXXXXXXXXXXXXXXXXXXXXXXXXXXXXXXXXXXXXXXXXXPYRTWNYHGSYXXXXXGSASSMINGVVRLLTKPWDXXXXXXXIAMTDTTAFGQQRVFKEKVDTRTQXXXXXXXXXXXXXXXXXXXXXXXXXXXXXXXXXXXXXXXXXXXXXXXXXXXXXXXXXXXXXXXXXXXXXXXXXXXXXXXXXXXXSCIYNMMGKREKKPGEFGKAKGSRAIWYMWLGARFLEFEALGFMNEDHWFXXXXXXXXXXXXXXXXXXXXXXXXXXXXXXXIYADDTAGWDTKVTXXXXXXXXXXXXXXXXXXXXXXXXIIKLTYQNKVVKVXXXXXXXXXXMDIISRKDQRGSGQVVTYALNTXXXXXXXXXXXXXXXXXXXXXXXXXXXXXXXXXXXXXXXXXXXXXXXXRMAVSGDDCVVKPXXXXXXXXXXXLNDMGKIRKDIXXXXXXXXXXXXXQVPFCSHHFHQLXXXXXXXXXXXXXXQDELVGRARVSQGAGWSLXXTACLGKAYAQMXXLLYFHRRDLRLASXXXXXXXXXXXXPTGRTTWSIHAXHEWMTTEDMLXXXXXXXXXXXXXXXXXXXXXXXXXXXXXGKREDIWCGSLIGTRXXXXXXXXXXXXXXXXXXXXXXXXXXXXXXXXXXXXXXXXXXXXXXXXXXXXXXXXXXX

SEQ ID NO: 265889 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(34): Any amino acid
  MOD_RES (47)..(411): Any amino acid
  MOD_RES (429)..(582): Any amino acid
  MOD_RES (593)..(755): Any amino acid
  MOD_RES (773)..(1041): Any amino acid
  MOD_RES (1054)..(1075): Any amino acid
  MOD_RES (1086)..(1161): Any amino acid
  MOD_RES (1174)..(1175): Any amino acid
  MOD_RES (1188)..(1634): Any amino acid
  MOD_RES (1649)..(1788): Any amino acid
  MOD_RES (1800)..(1813): Any amino acid
  MOD_RES (1834)..(1850): Any amino acid
  MOD_RES (1871)..(1879): Any amino acid
  MOD_RES (1903)..(1903): Any amino acid
  MOD_RES (1920)..(1957): Any amino acid
  MOD_RES (1968)..(2002): Any amino acid
  MOD_RES (2022)..(2022): Any amino acid
  MOD_RES (2037)..(2053): Any amino acid
  MOD_RES (2067)..(2137): Any amino acid
  MOD_RES (2150)..(2339): Any amino acid
  MOD_RES (2358)..(2410): Any amino acid
  MOD_RES (2424)..(2495): Any amino acid
  MOD_RES (2529)..(2548): Any amino acid
  MOD_RES (2559)..(2594): Any amino acid
  MOD_RES (2606)..(2606): Any amino acid
  MOD_RES (2621)..(2690): Any amino acid
  MOD_RES (2701)..(2710): Any amino acid
  MOD_RES (2728)..(2737): Any amino acid
  MOD_RES (2750)..(2775): Any amino acid
  MOD_RES (2789)..(2842): Any amino acid
  MOD_RES (2861)..(2937): Any amino acid
  MOD_RES (2949)..(2953): Any amino acid
  MOD_RES (2973)..(2979): Any amino acid
  MOD_RES (2990)..(2992): Any amino acid
  MOD_RES (3004)..(3087): Any amino acid
  MOD_RES (3138)..(3168): Any amino acid
  MOD_RES (3179)..(3206): Any amino acid
  MOD_RES (3220)..(3229): Any amino acid
  MOD_RES (3252)..(3299): Any amino acid
  MOD_RES (3313)..(3323): Any amino acid
  MOD_RES (3335)..(3347): Any amino acid
  MOD_RES (3360)..(3373): Any amino acid
  MOD_RES (3392)..(3393): Any amino acid
  MOD_RES (3405)..(3406): Any amino acid
  MOD_RES (3420)..(3431): Any amino acid
  MOD_RES (3443)..(3443): Any amino acid
  MOD_RES (3454)..(3482): Any amino acid
  MOD_RES (3498)..(3556): Any amino acid
XXXXXXXXXXXXXXXXXXXXXXXXXXXXXXXXXXSQLAKRFSRGLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDRGWGNGCGLFGKGSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXALGSQEGGLHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRMAIIGETAWDFGSLGGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAVHTDQSLWMKSXXXXXXXXXXXXXXXXXXXXXXWPKTHTLWSNXXXXXXXXXXXXXXXXXXXXXXXXXXXXXXXXXXXXXXXXXXXXXXXXXXXXXXXXXXXXXXXXXXXXXXXXXXXXWCCRSCSLPPLRXXTENGCWYGMEIRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFHTMWHVTRGSVIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLDLHPGAGKTRXXXXXXXXXXXXXXLRTLVLAPTRVVAAEMAEALXXXXXXXXXXXXXXXXXGNAIVDLMCHATFTTRLLSSXXXXXXXXXIMDEAHFTDPSSIAARGYIATKVXLNKCALIFMTATPPGAXXXXXXXXXXXXXXXXXXXXXXXXXXXXXXXXXXXXXXGKTVWFVASVXXXXXXXXXXXXXXXXXXXXXXXXXXXXXXXXXXXDWDFVITTDISEMGANFGAXRVIDSRKSVKPTIIXXXXXXXXXXXXXXXXXASAAQRRGRVGRQXXXXXXXXXXXXXXXXXXXXXXXXXXXXXXXXXXXXXXXXXXXXXXXXXXXXXXXXXXXXXXXXXXXXXXXLLRTADLPVWLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLIPEPEKQRSQTDNQLAXXXXXXXXXXXXXXXXXXXXXXXXXXXXXXXXXXXXXXXXXXXXXXXXXXXXXPATAWALYGGSTVXXXXXXXXXXXXXXXXXXXXXXXXXXXXXXXXXXXXXXXXXXXXXXXXXXXXXXXXXXXXXXXXXXXXXXXXHYGYMLPGWQAEALRSAQRRTASAMVRNPMVDGXXXXXXXXXXXXXXXXXXXXMQKKVGQIMLXXXXXXXXXXXXXXXXXXXXXXXXXXXXXXXXXXXXSSVWNATTAIGXCHVMRGSYLAGGSIXXXXXXXXXXXXXXXXXXXXXXXXXXXXXXXXXXXXXXXXXXXXXXXXXXXXXXXXXXXXXXXXXXXXXXVSRGSAKLQWXXXXXXXXXXGRVMDLGCGRGGWSYYMXXXXXXXXXXGYTLGRDGHEKPXXXXXXXXXXXXXXXXXXXXXXXXXXSDTLFCDIGESSPXXXXXXXXXXXXXXXXXXXXXXXXXXXXXXXXXXXXXXXXXXXXXXXXXXXXXXLVRLPFSRNSNHEMYWVSXXXXXXXXXXXXXXXXXXXXXXXXXXXXXXXXXXXXXXXXXXXXXXXXXXXXXXXXXXXXXXXXXXXXXXXXXXXXXPYRTWAYHGSYXXXXXGSASSLVNGVVRLLSKPWDXXXXXXXLAMTDTTPFGXXXVFKEKVDTKAPXXXXXXXXXXXXXXXXXXXXXXXXXXXXXXXXXXXXXXXXXXXXXXXXXXXXXXXXXXXXXXXXXXXXXXXXXXXXXXXXXXXXTCIYNMMGKREKKLGEFGRAKGSRAIWFMWLGSRYLEFEALGFLNEDHWLXXXXXXXXXXXXXXXXXXXXXXXXXXXXXXXFYADDTAGWDXXXXXXXXXXXXXXXXXXXXXXXXXXXXIMELTYRHKVVKVXXXXXXXXXXMDIISREDQRGSGQVVTYGLNTXXXXXXXXXXXXXXXXXXXXXXXXXXXXXXXXXXXXXXXXXXXXXXXXRMLVSGDDCVVRPXXXXXXXXXXXLNAMSKVRKDIXXXXXXXXXXXXXEVPFCSNHFTELXXXXXXXXXXXXXXQDELVGRARISPGAGWNVXXTACLAKSYAQMXXLSYFHRRDLRLMAXXXXXXXXXXXXPTGRTSWSIHSXGEWMTTEDMLXXXXXXXXXXXXXXXXXXXXXXXXXXXXXGKREDLWCGSLIGLSXXXXXXXXXXXXXXXXXXXXXXXXXXXXXXXXXXXXXXXXXXXXXXXXXXXXXXXXXXX

SEQ ID NO: 265890 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(34): Any amino acid
  MOD_RES (47)..(418): Any amino acid
  MOD_RES (429)..(582): Any amino acid
  MOD_RES (593)..(755): Any amino acid
  MOD_RES (773)..(1041): Any amino acid
  MOD_RES (1054)..(1075): Any amino acid
  MOD_RES (1086)..(1161): Any amino acid
  MOD_RES (1174)..(1175): Any amino acid
  MOD_RES (1188)..(1634): Any amino acid
  MOD_RES (1649)..(1788): Any amino acid
  MOD_RES (1800)..(1816): Any amino acid
  MOD_RES (1834)..(1850): Any amino acid
  MOD_RES (1871)..(1880): Any amino acid
  MOD_RES (1903)..(1903): Any amino acid
  MOD_RES (1920)..(1957): Any amino acid
  MOD_RES (1968)..(2002): Any amino acid
  MOD_RES (2022)..(2022): Any amino acid
  MOD_RES (2037)..(2053): Any amino acid
  MOD_RES (2064)..(2137): Any amino acid
  MOD_RES (2150)..(2339): Any amino acid
  MOD_RES (2358)..(2410): Any amino acid
  MOD_RES (2424)..(2495): Any amino acid
  MOD_RES (2529)..(2548): Any amino acid
  MOD_RES (2559)..(2594): Any amino acid
  MOD_RES (2606)..(2606): Any amino acid
  MOD_RES (2621)..(2690): Any amino acid
  MOD_RES (2701)..(2710): Any amino acid
  MOD_RES (2728)..(2737): Any amino acid
  MOD_RES (2750)..(2775): Any amino acid
  MOD_RES (2789)..(2842): Any amino acid
  MOD_RES (2861)..(2937): Any amino acid
  MOD_RES (2949)..(2953): Any amino acid
  MOD_RES (2973)..(2979): Any amino acid
  MOD_RES (2990)..(2993): Any amino acid
  MOD_RES (3004)..(3087): Any amino acid
  MOD_RES (3125)..(3127): Any amino acid
  MOD_RES (3138)..(3206): Any amino acid
  MOD_RES (3220)..(3229): Any amino acid
  MOD_RES (3246)..(3301): Any amino acid
  MOD_RES (3312)..(3323): Any amino acid
  MOD_RES (3335)..(3347): Any amino acid
  MOD_RES (3360)..(3373): Any amino acid
  MOD_RES (3392)..(3393): Any amino acid
  MOD_RES (3405)..(3406): Any amino acid
  MOD_RES (3420)..(3431): Any amino acid
  MOD_RES (3443)..(3443): Any amino acid
  MOD_RES (3454)..(3482): Any amino acid
  MOD_RES (3498)..(3556): Any amino acid
XXXXXXXXXXXXXXXXXXXXXXXXXXXXXXXXXXQGLVKRFSTGLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGCGLFGKGGVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNLGDQTGVLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLTVMGDHAWDFGSTGGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSAHGSPTFWMGSXXXXXXXXXXXXXXXXXXXXXXWPASHTIDNAXXXXXXXXXXXXXXXXXXXXXXXXXXXXXXXXXXXXXXXXXXXXXXXXXXXXXXXXXXXXXXXXXXXXXXXXXXXXWCCRSCTMPPVSXXTGTDCWYAMEIRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLHTLWHTTRGAAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLDMHPGSGKTHXXXXXXXXXXXXXXXXXLVLAPTRVVLKEMERALXXXXXXXXXXXXXXXXXGGEVIDVMCHATYVNRRLLPXXXXXXXXXXMDEAHWTDPHSIAARGHLYTLAXENESATVLMTATPPGKXXXXXXXXXXXXXXXXXXXXXXXXXXXXXXXXXXXXXXGRTAWFVPSIXXXXXXXXXXXXXXXXXXXXXXXXXXXXXXXXXXXKPDFVVTTDISEMGANLDVXRVIDCRKSVKPTILXXXXXXXXXXXXXXXXXSSAAQRRGRVXXXXXXXXXXXXXXXXXXXXXXXXXXXXXXXXXXXXXXXXXXXXXXXXXXXXXXXXXXXXXXXXXXXXXXXXXXLVTHCDFTPWLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLQPEAGKQRTPQDNQLIXXXXXXXXXXXXXXXXXXXXXXXXXXXXXXXXXXXXXXXXXXXXXXXXXXXXXPARSWGTYVLVVSXXXXXXXXXXXXXXXXXXXXXXXXXXXXXXXXXXXXXXXXXXXXXXXXXXXXXXXXXXXXXXXXXXXXXXXXHLAIVVSGLEAELTRAAHKVFFAGIMKNPTIDGXXXXXXXXXXXXXXXXXXXXMQKKVGQVLLXXXXXXXXXXXXXXXXXXXXXXXXXXXXXXXXXXXXSAVWNSTTATGXSGVVRGSLWGFLPLXXXXXXXXXXXXXXXXXXXXXXXXXXXXXXXXXXXXXXXXXXXXXXXXXXXXXXXXXXXXXXXXXXXXXXVSRGSSKIRWXXXXXXXXXXGEVVDLGCGRGGWSYYAXXXXXXXXXXAYTIGGKGHETPXXXXXXXXXXXXXXXXXXXXXXXXXXADTIMCDIGESNPXXXXXXXXXXXXXXXXXXXXXXXXXXXXXXXXXXXXXXXXXXXXXXXXXXXXXXLVRTPFSRNSTHEMYYSTXXXXXXXXXXXXXXXXXXXXXXXXXXXXXXXXXXXXXXXXXXXXXXXXXXXXXXXXXXXXXXXXXXXXXXXXXXXXXPYRTWTYHGSYXXXXXGSAASLINGVVKLMSKPWDXXXXXXXMAMTDTTAFGXXXXFKEKVDTRAKXXXXXXXXXXXXXXXXXXXXXXXXXXXXXXXXXXXXXXXXXXXXXXXXXXXXXXXXXXXXXXXXXXXXXXXXXXXXXXXXXXXXHCVYNMMGKREKKLSEFGVAKGSRAIWFMWLGARYLEXXXLGFLNEDHWAXXXXXXXXXXXXXXXXXXXXXXXXXXXXXXXXXXXXXXXXXXXXXXXXXXXXXXXXXXXXXXXXXXXXXVMQKAYHAKVVKVXXXXXXXXXXMDVITRRDQRGSGQVVXXXXXXXXXXXXXXXXXXXXXXXXXXXXXXXXXXXXXXXXXXXXXXXXXXXXXXXXAVSGDDCVVRXXXXXXXXXXXXLNDMAKTRKDIXXXXXXXXXXXXXQVPFCSHHFHKIXXXXXXXXXXXXXXQDELIGRGRVSPGNGWMIXXTACLAKAYAQMXXLMYFHRRDLRTLGXXXXXXXXXXXXPQGRTTWSIHGXGAWMTTEDMLXXXXXXXXXXXXXXXXXXXXXXXXXXXXXTKRQDMLCSSLVGRKXXXXXXXXXXXXXXXXXXXXXXXXXXXXXXXXXXXXXXXXXXXXXXXXXXXXXXXXXXX

SEQ ID NO: 265891 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(34): Any amino acid
  MOD_RES (47)..(418): Any amino acid
  MOD_RES (429)..(582): Any amino acid
  MOD_RES (593)..(755): Any amino acid
  MOD_RES (773)..(1041): Any amino acid
  MOD_RES (1053)..(1075): Any amino acid
  MOD_RES (1086)..(1162): Any amino acid
  MOD_RES (1174)..(1175): Any amino acid
  MOD_RES (1187)..(1634): Any amino acid
  MOD_RES (1649)..(1788): Any amino acid
  MOD_RES (1800)..(1817): Any amino acid
  MOD_RES (1834)..(1850): Any amino acid
  MOD_RES (1871)..(1882): Any amino acid
  MOD_RES (1903)..(1903): Any amino acid
  MOD_RES (1920)..(1957): Any amino acid
  MOD_RES (1968)..(2022): Any amino acid
  MOD_RES (2037)..(2137): Any amino acid
  MOD_RES (2150)..(2339): Any amino acid
  MOD_RES (2358)..(2411): Any amino acid
  MOD_RES (2424)..(2495): Any amino acid
  MOD_RES (2529)..(2594): Any amino acid
  MOD_RES (2606)..(2606): Any amino acid
  MOD_RES (2621)..(2690): Any amino acid
  MOD_RES (2701)..(2710): Any amino acid
  MOD_RES (2728)..(2737): Any amino acid
  MOD_RES (2748)..(2775): Any amino acid
  MOD_RES (2786)..(2842): Any amino acid
  MOD_RES (2861)..(2937): Any amino acid
  MOD_RES (2949)..(2953): Any amino acid
  MOD_RES (2973)..(2993): Any amino acid
  MOD_RES (3004)..(3096): Any amino acid
  MOD_RES (3111)..(3112): Any amino acid
  MOD_RES (3125)..(3208): Any amino acid
  MOD_RES (3220)..(3229): Any amino acid
  MOD_RES (3242)..(3324): Any amino acid
  MOD_RES (3335)..(3347): Any amino acid
  MOD_RES (3360)..(3378): Any amino acid
  MOD_RES (3392)..(3393): Any amino acid
  MOD_RES (3405)..(3409): Any amino acid
  MOD_RES (3420)..(3482): Any amino acid
  MOD_RES (3498)..(3556): Any amino acid
XXXXXXXXXXXXXXXXXXXXXXXXXXXXXXXXXXSNKIKQKTKQIGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHCGLFGKGSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXALGNQEGSLKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLAVMGDTAWDFSSAGGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAVHTDQSLWMKXXXXXXXXXXXXXXXXXXXXXXXWPRSHTLWSNXXXXXXXXXXXXXXXXXXXXXXXXXXXXXXXXXXXXXXXXXXXXXXXXXXXXXXXXXXXXXXXXXXXXXXXXXXXXXCCRTCTLPPVTXXGSDGCWYPMEIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLHTMWHVTRGAALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLDFHPGAGKTRXXXXXXXXXXXXXXXXXXVLAPTRVVLSEMKEAFXXXXXXXXXXXXXXXXXGREVIDAMCHATLTYRMLEPXXXXXXXXXXXXEAHFLDPASIAARGWAAHRAXANESATILMTATPPGTXXXXXXXXXXXXXXXXXXXXXXXXXXXXXXXXXXXXXXRPTAWFLPSIXXXXXXXXXXXXXXXXXXXXXXXXXXXXXXXXXXXXXXXXXXXXXXXXXXXXXXXRVLDCRTAFKPVLVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLMRNCDLPVWLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVIPEPGQQRSSDDNKLAXXXXXXXXXXXXXXXXXXXXXXXXXXXXXXXXXXXXXXXXXXXXXXXXXXXXXXGAAWTVYVGIVTXXXXXXXXXXXXXXXXXXXXXXXXXXXXXXXXXXXXXXXXXXXXXXXXXXXXXXXXXXXXXXXXXXXXXXXXHWSLILPGIKAQQSQRAQRRVFHGVAKNPVVDGXXXXXXXXXXXXXXXXXXXXXXXXXXXXXXXXXXXXXXXXXXXXXXXXXXXXXXXXXXXXXXXXXXDTLWTMPVACGXTGVMRGNHYAFVGVXXXXXXXXXXXXXXXXXXXXXXXXXXXXXXXXXXXXXXXXXXXXXXXXXXXXXXXXXXXXXXXXXXXXXXVSRGTAKLAWXXXXXXXXXXGKVMDLGCGRGGWCYYAXXXXXXXXXXGFTLGRDGHEXXXXXXXXXXXXXXXXXXXXXXXXXXXXSDTLLCDIGEXXXXXXXXXXXXXXXXXXXXXXXXXXXXXXXXXXXXXXXXXXXXXXXXXXXXXXXXXVIRNPLSRNSTHEMYYVSXXXXXXXXXXXXXXXXXXXXXXXXXXXXXXXXXXXXXXXXXXXXXXXXXXXXXXXXXXXXXXXXXXXXXXXXXXXXXPYRTWQYWGSYXXXXXGSAASMVNGVVKLLSWPWNXXXXXXXXXXXXXXXXXXXXXFKEKVDTKAQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXREKKLSEFGKAKGSXXIWYMWLGSRFLEXXXXXXXXXXXXXXXXXXXXXXXXXXXXXXXXXXXXXXXXXXXXXXXXXXXXXXXXXXXXXXXXXXXXXXXXXXXXXXXXXXXXEMTYKNKVVKVXXXXXXXXXXMDVITRRDQRGSXXXXXXXXXXXXXXXXXXXXXXXXXXXXXXXXXXXXXXXXXXXXXXXXXXXXXXXXXXXXXXXXXXXXXXXXXXXXXXXXXXXNDMGKVRKDVXXXXXXXXXXXXXNVPFCSNHFQEIXXXXXXXXXXXXXXXXXXXGRARVSPGCGWSVXXTACLSKAYGQMXXXXXFHKRDMRLLSXXXXXXXXXXXXXXXXXXXXXXXXXXXXXXXXXXXXXXXXXXXXXXXXXXXXXXXXXXXXXXXPKSHDKLCGSLIGMTXXXXXXXXXXXXXXXXXXXXXXXXXXXXXXXXXXXXXXXXXXXXXXXXXXXXXXXXXXX

SEQ ID NO: 265892 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(35): Any amino acid
  MOD_RES (47)..(411): Any amino acid
  MOD_RES (429)..(755): Any amino acid
  MOD_RES (770)..(1041): Any amino acid
  MOD_RES (1054)..(1161): Any amino acid
  MOD_RES (1174)..(1175): Any amino acid
  MOD_RES (1189)..(1634): Any amino acid
  MOD_RES (1648)..(1813): Any amino acid
  MOD_RES (1834)..(1850): Any amino acid
  MOD_RES (1871)..(1880): Any amino acid
  MOD_RES (1899)..(1903): Any amino acid
  MOD_RES (1919)..(2002): Any amino acid
  MOD_RES (2022)..(2022): Any amino acid
  MOD_RES (2037)..(2053): Any amino acid
  MOD_RES (2067)..(2137): Any amino acid
  MOD_RES (2150)..(2339): Any amino acid
  MOD_RES (2357)..(2410): Any amino acid
  MOD_RES (2424)..(2495): Any amino acid
  MOD_RES (2529)..(2548): Any amino acid
  MOD_RES (2560)..(2594): Any amino acid
  MOD_RES (2606)..(2606): Any amino acid
  MOD_RES (2621)..(2710): Any amino acid
  MOD_RES (2728)..(2775): Any amino acid
  MOD_RES (2789)..(2842): Any amino acid
  MOD_RES (2861)..(2937): Any amino acid
  MOD_RES (2949)..(2953): Any amino acid
  MOD_RES (2973)..(2979): Any amino acid
  MOD_RES (3004)..(3087): Any amino acid
  MOD_RES (3138)..(3168): Any amino acid
  MOD_RES (3183)..(3206): Any amino acid
  MOD_RES (3220)..(3229): Any amino acid
  MOD_RES (3252)..(3299): Any amino acid
  MOD_RES (3313)..(3323): Any amino acid
  MOD_RES (3335)..(3348): Any amino acid
  MOD_RES (3360)..(3373): Any amino acid
  MOD_RES (3392)..(3393): Any amino acid
  MOD_RES (3405)..(3406): Any amino acid
  MOD_RES (3420)..(3431): Any amino acid
  MOD_RES (3443)..(3482): Any amino acid
  MOD_RES (3498)..(3556): Any amino acid
XXXXXXXXXXXXXXXXXXXXXXXXXXXXXXXXXXXQLAKRFSKGLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVDRGWGNGCGLFGKGSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRMAILGDTAWDFGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAVHADMGYWIESXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWCCRSCTLPPLRXXGEDGCWYGMEIRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFHTMWHVTRGAVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLRTLILAPTRVVAAEMEEALXXXXXXXXXXXXXXXXXGREIVDLMCHATFTMRLLSPXXXXXXXXXXMDEAHFTDPASIAARGYIXXXXXMGEAAAIFMTATPPGXXXXXXXXXXXXXXXXXXXXXXXXXXXXXXXXXXXXXXXXXXXXXXXXXXXXXXXXXXXXXXXXXXXXXXXXXXXXXXXXXXXXDWDFVVTTDISEMGANFKAXRVIDPRRCLKPVILXXXXXXXXXXXXXXXXXASAAQRRGRIGRNXXXXXXXXXXXXXXXXXXXXXXXXXXXXXXXXXXXXXXXXXXXXXXXXXXXXXXXXXXXXXXXXXXXXXXXLMRRGDLPVWLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLIPEPEKQRTPQDNQLXXXXXXXXXXXXXXXXXXXXXXXXXXXXXXXXXXXXXXXXXXXXXXXXXXXXXXPASAWTLYAVATTXXXXXXXXXXXXXXXXXXXXXXXXXXXXXXXXXXXXXXXXXXXXXXXXXXXXXXXXXXXXXXXXXXXXXXXXHYAIIGPGLQAKATREAQKRTAAGIMKNPTVDGXXXXXXXXXXXXXXXXXXXXFEKQLGQVMLLXXXXXXXXXXXXXXXXXXXXXXXXXXXXXXXXXXXGKFWNTTIAVSXANIFRGSYLAGAGLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGKVIDLGCGRGGWSYYCXXXXXXXXXXXXXXXXXXXXXXXXXXXXXXXXXXXXXXXXXXXXXXXXCDTLLCDIGESSPXXXXXXXXXXXXXXXXXXXXXXXXXXXXXXXXXXXXXXXXXXXXXXXXXXXXXXLVRNPLSRNSTHEMYWVSXXXXXXXXXXXXXXXXXXXXXXXXXXXXXXXXXXXXXXXXXXXXXXXXXXXXXXXXXXXXXXXXXXXXXXXXXXXXXPYKTWAYHGSYXXXXXGSASSMVNGVVKLLTKPWDXXXXXXXMAMTDTTPFGQQRVFKEKVDTRTPXXXXXXXXXXXXXXXXXXXXXXXXXXXXXXXXXXXXXXXXXXXXXXXXXXXXXXXXXXXXXXXXXXXXXXXXXXXXXXXXXXXXTCVYNMMGKREKKLGEFGKAKGSRAIWYMWLGARFLEFEALGFLNEDHWFXXXXXXXXXXXXXXXXXXXXXXXXXXXXXXXMYADDTAGWDTRITXXXXXXXXXXXXXXXXXXXXXXXXIFKLTYQNKVVRVXXXXXXXXXXMDVISRRDQRGSGQVGTYGLNTXXXXXXXXXXXXXXXXXXXXXXXXXXXXXXXXXXXXXXXXXXXXXXXXRMAISGDDCVVKPXXXXXXXXXXXLNDMGKVRKDIXXXXXXXXXXXXXXVPFCSHHFHELXXXXXXXXXXXXXXQDELIGRARISQGAGWSLXXTACLGKSYAQMXXLMYFHRRDLRLAAXXXXXXXXXXXXPTSRTTWSIHAXXXXXXXXXXXXXXXXXXXXXXXXXXXXXXXXXXXXXXXXGKREDQWCGSLIGLTXXXXXXXXXXXXXXXXXXXXXXXXXXXXXXXXXXXXXXXXXXXXXXXXXXXXXXXXXXX

SEQ ID NO: 265893 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(35): Any amino acid
  MOD_RES (47)..(411): Any amino acid
  MOD_RES (429)..(755): Any amino acid
  MOD_RES (770)..(1041): Any amino acid
  MOD_RES (1054)..(1161): Any amino acid
  MOD_RES (1174)..(1175): Any amino acid
  MOD_RES (1189)..(1634): Any amino acid
  MOD_RES (1648)..(1813): Any amino acid
  MOD_RES (1834)..(1850): Any amino acid
  MOD_RES (1871)..(1880): Any amino acid
  MOD_RES (1899)..(1903): Any amino acid
  MOD_RES (1919)..(2002): Any amino acid
  MOD_RES (2022)..(2022): Any amino acid
  MOD_RES (2037)..(2053): Any amino acid
  MOD_RES (2067)..(2137): Any amino acid
  MOD_RES (2150)..(2339): Any amino acid
  MOD_RES (2357)..(2410): Any amino acid
  MOD_RES (2424)..(2495): Any amino acid
  MOD_RES (2529)..(2548): Any amino acid
  MOD_RES (2560)..(2594): Any amino acid
  MOD_RES (2606)..(2606): Any amino acid
  MOD_RES (2621)..(2710): Any amino acid
  MOD_RES (2728)..(2775): Any amino acid
  MOD_RES (2789)..(2842): Any amino acid
  MOD_RES (2861)..(2937): Any amino acid
  MOD_RES (2949)..(2953): Any amino acid
  MOD_RES (2973)..(2979): Any amino acid
  MOD_RES (3004)..(3087): Any amino acid
  MOD_RES (3138)..(3168): Any amino acid
  MOD_RES (3183)..(3206): Any amino acid
  MOD_RES (3220)..(3229): Any amino acid
  MOD_RES (3252)..(3299): Any amino acid
  MOD_RES (3313)..(3323): Any amino acid
  MOD_RES (3335)..(3348): Any amino acid
  MOD_RES (3360)..(3373): Any amino acid
  MOD_RES (3392)..(3393): Any amino acid
  MOD_RES (3405)..(3406): Any amino acid
  MOD_RES (3420)..(3431): Any amino acid
  MOD_RES (3443)..(3482): Any amino acid
  MOD_RES (3498)..(3556): Any amino acid
XXXXXXXXXXXXXXXXXXXXXXXXXXXXXXXXXXXQLTKRFSLGMLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTDRGWGNGCGLFGKGGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLAALGDTAWDFGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAIHSDLSYWIESXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWCCRSCTMPPLRXXTDSGCWYGMEIRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFHTLWHTTKGAAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLRTAILAPTRVVASEMAEALXXXXXXXXXXXXXXXXXGKEIVDVMCHATLTHRLMSPXXXXXXXXXXMDEAHFTDPSSIAARGYIXXXXXMGEAAGIFMTATPPGXXXXXXXXXXXXXXXXXXXXXXXXXXXXXXXXXXXXXXXXXXXXXXXXXXXXXXXXXXXXXXXXXXXXXXXXXXXXXXXXXXXXDWDYVITTDISEMGANFRAXRVIDPRRCMKPVILXXXXXXXXXXXXXXXXXSSAAQRRGRVGRNXXXXXXXXXXXXXXXXXXXXXXXXXXXXXXXXXXXXXXXXXXXXXXXXXXXXXXXXXXXXXXXXXXXXXXXLMRRGDLPVWLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLIPEPDRQRTPQDNQLXXXXXXXXXXXXXXXXXXXXXXXXXXXXXXXXXXXXXXXXXXXXXXXXXXXXXXPATAWSLYAVTTAXXXXXXXXXXXXXXXXXXXXXXXXXXXXXXXXXXXXXXXXXXXXXXXXXXXXXXXXXXXXXXXXXXXXXXXXHYAYMVPGWQAEAMRSAQKRAAAGIMKNAVVDGXXXXXXXXXXXXXXXXXXXXFEKQLGQIMLLXXXXXXXXXXXXXXXXXXXXXXXXXXXXXXXXXXXGRFWNTTIAVSXCHIMRGGWLSCLSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGKVVDLGCGRGGWCYYMXXXXXXXXXXXXXXXXXXXXXXXXXXXXXXXXXXXXXXXXXXXXXXXXVDTLLCDIGESSSXXXXXXXXXXXXXXXXXXXXXXXXXXXXXXXXXXXXXXXXXXXXXXXXXXXXXXLVRCPLSRNSTHEMYWISXXXXXXXXXXXXXXXXXXXXXXXXXXXXXXXXXXXXXXXXXXXXXXXXXXXXXXXXXXXXXXXXXXXXXXXXXXXXXPYRTWNYHGSYXXXXXGSASSMINGVVRLLTKPWDXXXXXXXIAMTDTTAFGQQRVFKEKVDTRTQXXXXXXXXXXXXXXXXXXXXXXXXXXXXXXXXXXXXXXXXXXXXXXXXXXXXXXXXXXXXXXXXXXXXXXXXXXXXXXXXXXXXSCIYNMMGKREKKPGEFGKAKGSRAIWYMWLGARFLEFEALGFMNEDHWFXXXXXXXXXXXXXXXXXXXXXXXXXXXXXXXIYADDTAGWDTKVTXXXXXXXXXXXXXXXXXXXXXXXXIFKLTYQNKVVKVXXXXXXXXXXMDIISRKDQRGSGQVVTYALNTXXXXXXXXXXXXXXXXXXXXXXXXXXXXXXXXXXXXXXXXXXXXXXXXRMAVSGDDCVVKPXXXXXXXXXXXLNDMGKIRKDIXXXXXXXXXXXXXXVPFCSHHFHQLXXXXXXXXXXXXXXQDELVGRARVSQGAGWSLXXTACLGKAYAQMXXLLYFHRRDLRLASXXXXXXXXXXXXPTGRTTWSIHAXXXXXXXXXXXXXXXXXXXXXXXXXXXXXXXXXXXXXXXXGKREDIWCGSLIGTRXXXXXXXXXXXXXXXXXXXXXXXXXXXXXXXXXXXXXXXXXXXXXXXXXXXXXXXXXXX

SEQ ID NO: 265894 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(35): Any amino acid
  MOD_RES (47)..(411): Any amino acid
  MOD_RES (429)..(755): Any amino acid
  MOD_RES (770)..(1041): Any amino acid
  MOD_RES (1054)..(1161): Any amino acid
  MOD_RES (1174)..(1175): Any amino acid
  MOD_RES (1189)..(1634): Any amino acid
  MOD_RES (1648)..(1813): Any amino acid
  MOD_RES (1834)..(1850): Any amino acid
  MOD_RES (1871)..(1880): Any amino acid
  MOD_RES (1899)..(1903): Any amino acid
  MOD_RES (1919)..(2002): Any amino acid
  MOD_RES (2022)..(2022): Any amino acid
  MOD_RES (2037)..(2053): Any amino acid
  MOD_RES (2067)..(2137): Any amino acid
  MOD_RES (2150)..(2339): Any amino acid
  MOD_RES (2357)..(2410): Any amino acid
  MOD_RES (2424)..(2495): Any amino acid
  MOD_RES (2529)..(2548): Any amino acid
  MOD_RES (2560)..(2594): Any amino acid
  MOD_RES (2606)..(2606): Any amino acid
  MOD_RES (2621)..(2710): Any amino acid
  MOD_RES (2728)..(2775): Any amino acid
  MOD_RES (2789)..(2842): Any amino acid
  MOD_RES (2861)..(2937): Any amino acid
  MOD_RES (2949)..(2953): Any amino acid
  MOD_RES (2973)..(2979): Any amino acid
  MOD_RES (2991)..(2991): Any amino acid
  MOD_RES (3004)..(3087): Any amino acid
  MOD_RES (3138)..(3168): Any amino acid
  MOD_RES (3180)..(3206): Any amino acid
  MOD_RES (3220)..(3229): Any amino acid
  MOD_RES (3252)..(3299): Any amino acid
  MOD_RES (3313)..(3323): Any amino acid
  MOD_RES (3335)..(3348): Any amino acid
  MOD_RES (3360)..(3373): Any amino acid
  MOD_RES (3392)..(3393): Any amino acid
  MOD_RES (3405)..(3406): Any amino acid
  MOD_RES (3420)..(3431): Any amino acid
  MOD_RES (3443)..(3482): Any amino acid
  MOD_RES (3498)..(3556): Any amino acid
XXXXXXXXXXXXXXXXXXXXXXXXXXXXXXXXXXXQLAKRFSRGLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDRGWGNGCGLFGKGSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRMAILGETAWDFGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAVHSDLSYWIESXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWCCRSCSLPPLRXXTENGCWYGMEIRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFHTMWHVTRGSVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLRTLVLAPTRVVAAEMAEALXXXXXXXXXXXXXXXXXGNAIVDLMCHATFTTRLLSSXXXXXXXXXXMDEAHFTDPSSVAARGYIXXXXXLNKCALVLMTATPPGXXXXXXXXXXXXXXXXXXXXXXXXXXXXXXXXXXXXXXXXXXXXXXXXXXXXXXXXXXXXXXXXXXXXXXXXXXXXXXXXXXXXDWDFVITTDISEMGANFGAXRVIDSRKSVKPTIIXXXXXXXXXXXXXXXXXASAAQRRGRVGRQXXXXXXXXXXXXXXXXXXXXXXXXXXXXXXXXXXXXXXXXXXXXXXXXXXXXXXXXXXXXXXXXXXXXXXXLLRTADLPVWLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLIPEPEKQRSQTDNQLXXXXXXXXXXXXXXXXXXXXXXXXXXXXXXXXXXXXXXXXXXXXXXXXXXXXXXPATAWALYGGSTVXXXXXXXXXXXXXXXXXXXXXXXXXXXXXXXXXXXXXXXXXXXXXXXXXXXXXXXXXXXXXXXXXXXXXXXXHYGYMLPGWQAEALRAAQRRTASAMVRNPMVDGXXXXXXXXXXXXXXXXXXXXMQKKVGQIMLIXXXXXXXXXXXXXXXXXXXXXXXXXXXXXXXXXXXSSVWNATTAIGXCHVMRGSYLAGGSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRVIDLGCGRGGWSYYMXXXXXXXXXXXXXXXXXXXXXXXXXXXXXXXXXXXXXXXXXXXXXXXXSDTLFCDIGESSPXXXXXXXXXXXXXXXXXXXXXXXXXXXXXXXXXXXXXXXXXXXXXXXXXXXXXXLVRLPFSRNSNHEMYWVSXXXXXXXXXXXXXXXXXXXXXXXXXXXXXXXXXXXXXXXXXXXXXXXXXXXXXXXXXXXXXXXXXXXXXXXXXXXXXPYRTWAYHGSYXXXXXGSASSLVNGVVRLLSKPWDXXXXXXXLAMTDTTPFGQXRVFKEKVDTKAPXXXXXXXXXXXXXXXXXXXXXXXXXXXXXXXXXXXXXXXXXXXXXXXXXXXXXXXXXXXXXXXXXXXXXXXXXXXXXXXXXXXXTCIYNMMGKREKKLGEFGRAKGSRAIWFMWLGSRYLEFEALGFLNEDHWLXXXXXXXXXXXXXXXXXXXXXXXXXXXXXXXFYADDTAGWDTXXXXXXXXXXXXXXXXXXXXXXXXXXXIIELTYRHKVVKVXXXXXXXXXXMDIISREDQRGSGQVVTYGLNTXXXXXXXXXXXXXXXXXXXXXXXXXXXXXXXXXXXXXXXXXXXXXXXXRMLVSGDDCVVRPXXXXXXXXXXXLNAMSKVRKDIXXXXXXXXXXXXXXVPFCSNHFTELXXXXXXXXXXXXXXQDELVGRARISPGAGWNVXXTACLAKSYAQMXXLSYFHRRDLRLMAXXXXXXXXXXXXPTGRTSWSIHSXXXXXXXXXXXXXXXXXXXXXXXXXXXXXXXXXXXXXXXXGKREDLWCGSLIGLSXXXXXXXXXXXXXXXXXXXXXXXXXXXXXXXXXXXXXXXXXXXXXXXXXXXXXXXXXXX

SEQ ID NO: 265895 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(35): Any amino acid
  MOD_RES (47)..(411): Any amino acid
  MOD_RES (429)..(755): Any amino acid
  MOD_RES (770)..(1041): Any amino acid
  MOD_RES (1054)..(1161): Any amino acid
  MOD_RES (1174)..(1175): Any amino acid
  MOD_RES (1189)..(1634): Any amino acid
  MOD_RES (1648)..(1815): Any amino acid
  MOD_RES (1834)..(1850): Any amino acid
  MOD_RES (1871)..(1880): Any amino acid
  MOD_RES (1899)..(1903): Any amino acid
  MOD_RES (1919)..(2002): Any amino acid
  MOD_RES (2022)..(2022): Any amino acid
  MOD_RES (2037)..(2053): Any amino acid
  MOD_RES (2065)..(2137): Any amino acid
  MOD_RES (2150)..(2339): Any amino acid
  MOD_RES (2357)..(2410): Any amino acid
  MOD_RES (2424)..(2495): Any amino acid
  MOD_RES (2529)..(2548): Any amino acid
  MOD_RES (2560)..(2594): Any amino acid
  MOD_RES (2606)..(2606): Any amino acid
  MOD_RES (2621)..(2710): Any amino acid
  MOD_RES (2728)..(2775): Any amino acid
  MOD_RES (2789)..(2842): Any amino acid
  MOD_RES (2861)..(2937): Any amino acid
  MOD_RES (2949)..(2953): Any amino acid
  MOD_RES (2973)..(2979): Any amino acid
  MOD_RES (2991)..(2992): Any amino acid
  MOD_RES (3004)..(3087): Any amino acid
  MOD_RES (3126)..(3126): Any amino acid
  MOD_RES (3138)..(3206): Any amino acid
  MOD_RES (3220)..(3229): Any amino acid
  MOD_RES (3247)..(3300): Any amino acid
  MOD_RES (3313)..(3323): Any amino acid
  MOD_RES (3335)..(3348): Any amino acid
  MOD_RES (3360)..(3373): Any amino acid
  MOD_RES (3392)..(3393): Any amino acid
  MOD_RES (3405)..(3406): Any amino acid
  MOD_RES (3420)..(3431): Any amino acid
  MOD_RES (3443)..(3482): Any amino acid
  MOD_RES (3498)..(3556): Any amino acid
XXXXXXXXXXXXXXXXXXXXXXXXXXXXXXXXXXXGLVKRFSTGLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDRGWGNGCGLFGKGGVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLTVIGEHAWDFGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSAHGSPTFWMGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWCCRSCTMPPVSXXTGTDCWYAMEIRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFHTLWHTTRGAAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLVLAPTRVVLKEMERALXXXXXXXXXXXXXXXXXGGEVVDVMCHATYVNRRLLPXXXXXXXXXXMDEAHWTDPHSIAARGHLXXXXXENESATILMTATPPGXXXXXXXXXXXXXXXXXXXXXXXXXXXXXXXXXXXXXXXXXXXXXXXXXXXXXXXXXXXXXXXXXXXXXXXXXXXXXXXXXXXXKPDFVVTTDISEMGANLDVXRVIDCRKSVKPTILXXXXXXXXXXXXXXXXXSSAAQRRGRVGXXXXXXXXXXXXXXXXXXXXXXXXXXXXXXXXXXXXXXXXXXXXXXXXXXXXXXXXXXXXXXXXXXXXXXXXXLLTHCDFTPWLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLQPEAGKQRSSDDNKLXXXXXXXXXXXXXXXXXXXXXXXXXXXXXXXXXXXXXXXXXXXXXXXXXXXXXXPARSWGTYVLVVSXXXXXXXXXXXXXXXXXXXXXXXXXXXXXXXXXXXXXXXXXXXXXXXXXXXXXXXXXXXXXXXXXXXXXXXXHLAIVVSGLEAELTQRAHKVFFAGIMKNPTIDGXXXXXXXXXXXXXXXXXXXXMQKKVGQVLLIXXXXXXXXXXXXXXXXXXXXXXXXXXXXXXXXXXXSAVWNSTTATGXSGVVRGSLWGFLPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGEVMDLGCGRGGWSYYAXXXXXXXXXXXXXXXXXXXXXXXXXXXXXXXXXXXXXXXXXXXXXXXXADTIMCDIGESNPXXXXXXXXXXXXXXXXXXXXXXXXXXXXXXXXXXXXXXXXXXXXXXXXXXXXXXLVRTPLSRNSTHEMYYSTXXXXXXXXXXXXXXXXXXXXXXXXXXXXXXXXXXXXXXXXXXXXXXXXXXXXXXXXXXXXXXXXXXXXXXXXXXXXXPYRTWTYHGSYXXXXXGSAASLINGVVKLMSKPWDXXXXXXXMAMTDTTAFGQXXVFKEKVDTRAKXXXXXXXXXXXXXXXXXXXXXXXXXXXXXXXXXXXXXXXXXXXXXXXXXXXXXXXXXXXXXXXXXXXXXXXXXXXXXXXXXXXXHCVYNMMGKREKKLSEFGVAKGSRAIWFMWLGARYLEFXALGFLNEDHWAXXXXXXXXXXXXXXXXXXXXXXXXXXXXXXXXXXXXXXXXXXXXXXXXXXXXXXXXXXXXXXXXXXXXXVMQKAYHAKVVKVXXXXXXXXXXMDVITRRDQRGSGQVVTXXXXXXXXXXXXXXXXXXXXXXXXXXXXXXXXXXXXXXXXXXXXXXXXXXXXXXMAVSGDDCVVRPXXXXXXXXXXXLNDMAKTRKDIXXXXXXXXXXXXXXVPFCSHHFHKIXXXXXXXXXXXXXXQDELIGRGRVSPGNGWMIXXTACLAKAYAQMXXLMYFHRRDLRTLGXXXXXXXXXXXXPQGRTTWSIHGXXXXXXXXXXXXXXXXXXXXXXXXXXXXXXXXXXXXXXXXTKRQDMLCSSLVGRKXXXXXXXXXXXXXXXXXXXXXXXXXXXXXXXXXXXXXXXXXXXXXXXXXXXXXXXXXXX

SEQ ID NO: 265896 - protein, 3556 aa, Unknown
  Description of Unknown: "panFIVE" peptide (Dengue virus, West nile virus, Yellow fever virus, Tick-borne encephalitis virus, or Japanese encephalitis virus)
  MOD_RES (1)..(35): Any amino acid
  MOD_RES (47)..(417): Any amino acid
  MOD_RES (429)..(755): Any amino acid
  MOD_RES (770)..(1041): Any amino acid
  MOD_RES (1054)..(1161): Any amino acid
  MOD_RES (1174)..(1175): Any amino acid
  MOD_RES (1188)..(1634): Any amino acid
  MOD_RES (1648)..(1817): Any amino acid
  MOD_RES (1834)..(1850): Any amino acid
  MOD_RES (1871)..(1881): Any amino acid
  MOD_RES (1899)..(1903): Any amino acid
  MOD_RES (1915)..(2022): Any amino acid
  MOD_RES (2037)..(2137): Any amino acid
  MOD_RES (2150)..(2339): Any amino acid
  MOD_RES (2357)..(2410): Any amino acid
  MOD_RES (2424)..(2495): Any amino acid
  MOD_RES (2529)..(2594): Any amino acid
  MOD_RES (2606)..(2606): Any amino acid
  MOD_RES (2621)..(2710): Any amino acid
  MOD_RES (2728)..(2775): Any amino acid
  MOD_RES (2787)..(2842): Any amino acid
  MOD_RES (2861)..(2937): Any amino acid
  MOD_RES (2949)..(2953): Any amino acid
  MOD_RES (2973)..(2992): Any amino acid
  MOD_RES (3004)..(3095): Any amino acid
  MOD_RES (3126)..(3207): Any amino acid
  MOD_RES (3220)..(3229): Any amino acid
  MOD_RES (3243)..(3323): Any amino acid
  MOD_RES (3335)..(3348): Any amino acid
  MOD_RES (3360)..(3378): Any amino acid
  MOD_RES (3392)..(3393): Any amino acid
  MOD_RES (3405)..(3408): Any amino acid
  MOD_RES (3420)..(3482): Any amino acid
  MOD_RES (3498)..(3556): Any amino acid
XXXXXXXXXXXXXXXXXXXXXXXXXXXXXXXXXXXNKIKQKTKQIGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNHCGLFGKGSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLAVMGDTAWDFSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAVHTDQSLWMKSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWCCRTCTLPPVTXXGSDGCWYPMEIRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLHTMWHVTRGAAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLAPTRVVLSEMKEAFXXXXXXXXXXXXXXXXXGREVIDAMCHATLTYRMLEPXXXXXXXXXXXDEAHFLDPASIAARGWAXXXXXANESATILMTAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRVLDCRTAFKPVLVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLVRNCDLPVWLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVIPEPGQQRSIQDNQVXXXXXXXXXXXXXXXXXXXXXXXXXXXXXXXXXXXXXXXXXXXXXXXXXXXXXXPGAAWTVYVGIVTXXXXXXXXXXXXXXXXXXXXXXXXXXXXXXXXXXXXXXXXXXXXXXXXXXXXXXXXXXXXXXXXXXXXXXXXHWSLILPGIKAQQSKLAQRRVFHGVAKNPVVDGXXXXXXXXXXXXXXXXXXXXXXXXXXXXXXXXXXXXXXXXXXXXXXXXXXXXXXXXXXXXXXXXXXDTLWTMPVACGXTGVMRGNHYAFVGVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGKVMDLGCGRGGWCYYAXXXXXXXXXXXXXXXXXXXXXXXXXXXXXXXXXXXXXXXXXXXXXXXXSDTLLCDIGESXXXXXXXXXXXXXXXXXXXXXXXXXXXXXXXXXXXXXXXXXXXXXXXXXXXXXXXXVIRNPLSRNSTHEMYYVSXXXXXXXXXXXXXXXXXXXXXXXXXXXXXXXXXXXXXXXXXXXXXXXXXXXXXXXXXXXXXXXXXXXXXXXXXXXXXPYRTWQYWGSYXXXXXGSAASMVNGVVKLLSWPWNXXXXXXXXXXXXXXXXXXXXVFKEKVDTKAQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKREKKLSEFGKAKGSRAIWYMWLGSRFLEFXXXXXXXXXXXXXXXXXXXXXXXXXXXXXXXXXXXXXXXXXXXXXXXXXXXXXXXXXXXXXXXXXXXXXXXXXXXXXXXXXXMEMTYKNKVVKVXXXXXXXXXXMDVITRRDQRGSGXXXXXXXXXXXXXXXXXXXXXXXXXXXXXXXXXXXXXXXXXXXXXXXXXXXXXXXXXXXXXXXXXXXXXXXXXXXXXXXXXLNDMGKVRKDVXXXXXXXXXXXXXXVPFCSNHFQEIXXXXXXXXXXXXXXXXXXXGRARVSPGCGWSVXXTACLSKAYGQMXXXXYFHKRDMRLLSXXXXXXXXXXXXXXXXXXXXXXXXXXXXXXXXXXXXXXXXXXXXXXXXXXXXXXXXXXXXXXXPKSHDKLCGSLIGMTXXXXXXXXXXXXXXXXXXXXXXXXXXXXXXXXXXXXXXXXXXXXXXXXXXXXXXXXXXX

SEQ ID NO: 265897 - protein, 4145 aa, Flavivirus
  MOD_RES (1)..(501): Any amino acid
  MOD_RES (519)..(2005): Any amino acid
  MOD_RES (2018)..(2119): Any amino acid
  MOD_RES (2128)..(2171): Any amino acid
  MOD_RES (2182)..(2197): Any amino acid
  MOD_RES (2211)..(2238): Any amino acid
  MOD_RES (2248)..(2265): Any amino acid
  MOD_RES (2276)..(2276): Any amino acid
  MOD_RES (2285)..(2297): Any amino acid
  MOD_RES (2308)..(2350): Any amino acid
  MOD_RES (2360)..(2396): Any amino acid
  MOD_RES (2413)..(2447): Any amino acid
  MOD_RES (2460)..(3228): Any amino acid
  MOD_RES (3237)..(3250): Any amino acid
  MOD_RES (3265)..(3321): Any amino acid
  MOD_RES (3333)..(3391): Any amino acid
  MOD_RES (3404)..(3531): Any amino acid
  MOD_RES (3555)..(3641): Any amino acid
  MOD_RES (3690)..(3727): Any amino acid
  MOD_RES (3742)..(3810): Any amino acid
  MOD_RES (3825)..(3877): Any amino acid
  MOD_RES (3887)..(3929): Any amino acid
  MOD_RES (3939)..(3954): Any amino acid
  MOD_RES (3968)..(3987): Any amino acid
  MOD_RES (4000)..(4012): Any amino acid
  MOD_RES (4023)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVDRGWGNGCGLFGKGSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFHTMWHVTRGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVGLYGNGXXXXXXXXXXXXXXXXXXXXXXXXXXXXXXXXXXXXXXXXXXXXDLHPGSGKTRXXXXXXXXXXXXXXXXTLILAPTRVVAAEXXXXXXXXXXXXXXXXXXXXXXXXXXXXVDLMCHATFXXXXXXXXXXXXXXXXXXIMDEAHFTDPXSIAARGYIXXXXXXXXXXXXXIFMTATPPGSXXXXXXXXXXXXXXXXXXXXXXXXXXXXXXXXXXXXXXXXXXXGKTVWFVPSXXXXXXXXXXXXXXXXXXXXXXXXXXXXXXXXXXXXXWDFVVTTDISEMGANFXXXXXXXXXXXXXXXXXXXXXXXXXXXXXXXXXXXASAAQRRGRIGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSRGTAKLXXXXXXXXXXXXXXVIDLGCGRGGWSYYXXXXXXXXXXXXXXXXXXXXXXXXXXXXXXXXXXXXXXXXXXXXXXXXXXXXXXXXXTLLCDIGESSPXXXXXXXXXXXXXXXXXXXXXXXXXXXXXXXXXXXXXXXXXXXXXXXXXXXXXXXXXXXPLSRNSTHEMYWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAMTDTTPFGQQRVFKEKVDTRTXXXXXXXXXXXXXXXXXXXXXXXXXXXXXXXXXXXXXXXXXXXXXXXXXXXXXXXXXXXXXXXXXXXXXXXXXXXXXXXXXXXXXXXCVYNMMGKREKKLGEFGKAKGSRAIWYMWLGARFLEFEALGFLNEDHWXXXXXXXXXXXXXXXXXXXXXXXXXXXXXXXXXXXXXXMYADDTAGWDTRITXXXXXXXXXXXXXXXXXXXXXXXXXXXXXXXXXXXXXXXXXXXXXXXXXXXXXXXXXXXXXXXXXXXXXQRGSGQVGTYGLNTXXXXXXXXXXXXXXXXXXXXXXXXXXXXXXXXXXXXXXXXXXXXXXXXXXXXXRMAISGDDCXXXXXXXXXXXXXXXXXXXXXXXXXXXXXXXXXXXXXXXXXXXVPFCSHHFHXXXXXXXXXXXXXXXXQDELIGRARISQGXXXXXXXXXXXXXXXXXXXXLMYFHRRDLRLAXXXXXXXXXXXXXPTSRTTWSIHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265898 - protein, 4145 aa, Flavivirus
  MOD_RES (1)..(501): Any amino acid
  MOD_RES (519)..(2005): Any amino acid
  MOD_RES (2018)..(2119): Any amino acid
  MOD_RES (2128)..(2171): Any amino acid
  MOD_RES (2182)..(2197): Any amino acid
  MOD_RES (2211)..(2238): Any amino acid
  MOD_RES (2248)..(2265): Any amino acid
  MOD_RES (2276)..(2276): Any amino acid
  MOD_RES (2285)..(2297): Any amino acid
  MOD_RES (2308)..(2350): Any amino acid
  MOD_RES (2360)..(2396): Any amino acid
  MOD_RES (2413)..(2447): Any amino acid
  MOD_RES (2460)..(3228): Any amino acid
  MOD_RES (3237)..(3250): Any amino acid
  MOD_RES (3265)..(3321): Any amino acid
  MOD_RES (3333)..(3391): Any amino acid
  MOD_RES (3404)..(3531): Any amino acid
  MOD_RES (3555)..(3641): Any amino acid
  MOD_RES (3690)..(3727): Any amino acid
  MOD_RES (3742)..(3810): Any amino acid
  MOD_RES (3825)..(3877): Any amino acid
  MOD_RES (3887)..(3929): Any amino acid
  MOD_RES (3939)..(3954): Any amino acid
  MOD_RES (3968)..(3987): Any amino acid
  MOD_RES (4000)..(4012): Any amino acid
  MOD_RES (4023)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTDRGWGNHCGLFGKGGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFHTLWHTTKGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIVGLYGNGXXXXXXXXXXXXXXXXXXXXXXXXXXXXXXXXXXXXXXXXXXXXDLHPGAGKTKXXXXXXXXXXXXXXXXTAVLAPTRVVASEXXXXXXXXXXXXXXXXXXXXXXXXXXXXVDVMCHATLXXXXXXXXXXXXXXXXXXVMDEAHWTDPXSVAARGYIXXXXXXXXXXXXXVLMTATPPGTXXXXXXXXXXXXXXXXXXXXXXXXXXXXXXXXXXXXXXXXXXXGKTVWFVASXXXXXXXXXXXXXXXXXXXXXXXXXXXXXXXXXXXXXWDYVIATDISEMGANLXXXXXXXXXXXXXXXXXXXXXXXXXXXXXXXXXXXSSAAQRRGRVGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSRGSAKLXXXXXXXXXXXXXXVVDLGCGRGGWCYYXXXXXXXXXXXXXXXXXXXXXXXXXXXXXXXXXXXXXXXXXXXXXXXXXXXXXXXXXTLFCDIGESSSXXXXXXXXXXXXXXXXXXXXXXXXXXXXXXXXXXXXXXXXXXXXXXXXXXXXXXXXXXXPLSRNSTHEMYYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIAMTDTTAFGQQRVFKEKVDTKAXXXXXXXXXXXXXXXXXXXXXXXXXXXXXXXXXXXXXXXXXXXXXXXXXXXXXXXXXXXXXXXXXXXXXXXXXXXXXXXXXXXXXXXCIYNMMGKREKKPGEFGRAKGSRAIWYMWLGARYLEFEALGFMNEDHWXXXXXXXXXXXXXXXXXXXXXXXXXXXXXXXXXXXXXXIYADDTAGWDTKVTXXXXXXXXXXXXXXXXXXXXXXXXXXXXXXXXXXXXXXXXXXXXXXXXXXXXXXXXXXXXXXXXXXXXXQRGSGQVVTYALNTXXXXXXXXXXXXXXXXXXXXXXXXXXXXXXXXXXXXXXXXXXXXXXXXXXXXXRMAVSGDDCXXXXXXXXXXXXXXXXXXXXXXXXXXXXXXXXXXXXXXXXXXXVPFCSNHFTXXXXXXXXXXXXXXXXQDELVGRARVSQGXXXXXXXXXXXXXXXXXXXXLLYFHRRDLRLMXXXXXXXXXXXXXPTGRTTWSIHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265899 - protein, 4145 aa, Flavivirus
  MOD_RES (1)..(501): Any amino acid
  MOD_RES (510)..(510): Any amino acid
  MOD_RES (519)..(2005): Any amino acid
  MOD_RES (2018)..(2119): Any amino acid
  MOD_RES (2128)..(2171): Any amino acid
  MOD_RES (2182)..(2197): Any amino acid
  MOD_RES (2211)..(2238): Any amino acid
  MOD_RES (2248)..(2265): Any amino acid
  MOD_RES (2276)..(2276): Any amino acid
  MOD_RES (2285)..(2297): Any amino acid
  MOD_RES (2308)..(2350): Any amino acid
  MOD_RES (2360)..(2396): Any amino acid
  MOD_RES (2413)..(3228): Any amino acid
  MOD_RES (3237)..(3250): Any amino acid
  MOD_RES (3260)..(3321): Any amino acid
  MOD_RES (3333)..(3391): Any amino acid
  MOD_RES (3404)..(3531): Any amino acid
  MOD_RES (3540)..(3545): Any amino acid
  MOD_RES (3555)..(3646): Any amino acid
  MOD_RES (3681)..(3727): Any amino acid
  MOD_RES (3742)..(3813): Any amino acid
  MOD_RES (3825)..(3877): Any amino acid
  MOD_RES (3887)..(3929): Any amino acid
  MOD_RES (3939)..(3954): Any amino acid
  MOD_RES (3968)..(3987): Any amino acid
  MOD_RES (4000)..(4012): Any amino acid
  MOD_RES (4023)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDRGWGNHXGLFGKGSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLHTMWHVTRGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVIGLYGNGXXXXXXXXXXXXXXXXXXXXXXXXXXXXXXXXXXXXXXXXXXXXDMHPGAGKTRXXXXXXXXXXXXXXXXTLVLAPTRVVLKEXXXXXXXXXXXXXXXXXXXXXXXXXXXXIDVMCHATYXXXXXXXXXXXXXXXXXXIMDEAHFLDPXSIAARGHLXXXXXXXXXXXXXILMTATPPGAXXXXXXXXXXXXXXXXXXXXXXXXXXXXXXXXXXXXXXXXXXXGRTAWFVPSXXXXXXXXXXXXXXXXXXXXXXXXXXXXXXXXXXXXXWDFILATDIAEMGANLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSRGSSKIXXXXXXXXXXXXXXVMDLGCGRGXXXXXXXXXXXXXXXXXXXXXXXXXXXXXXXXXXXXXXXXXXXXXXXXXXXXXXXXXXXXXXTIMCDIGESNPXXXXXXXXXXXXXXXXXXXXXXXXXXXXXXXXXXXXXXXXXXXXXXXXXXXXXXXXXXXPFSRNSNHEMYWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAMTDTTPXXXXXXFKEKVDTRAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMGKREKKTGEFGVAKGSRAIWFMWLGSRFLEFEAXXXXXXXXXXXXXXXXXXXXXXXXXXXXXXXXXXXXXXXXXXXXXXXFYADDTAGWDTRVTXXXXXXXXXXXXXXXXXXXXXXXXXXXXXXXXXXXXXXXXXXXXXXXXXXXXXXXXXXXXXXXXXXXXXXXXSGQVVTYGLNTXXXXXXXXXXXXXXXXXXXXXXXXXXXXXXXXXXXXXXXXXXXXXXXXXXXXXRMLVSGDDCXXXXXXXXXXXXXXXXXXXXXXXXXXXXXXXXXXXXXXXXXXXVPFCSNHFQXXXXXXXXXXXXXXXXQDELVGRARISPGXXXXXXXXXXXXXXXXXXXXLSYFHRRDLRTLXXXXXXXXXXXXXPTGRTSWSIHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265900 - protein, 4145 aa, Flavivirus
  MOD_RES (1)..(501): Any amino acid
  MOD_RES (510)..(510): Any amino acid
  MOD_RES (519)..(2005): Any amino acid
  MOD_RES (2018)..(2119): Any amino acid
  MOD_RES (2128)..(2171): Any amino acid
  MOD_RES (2182)..(2197): Any amino acid
  MOD_RES (2211)..(2238): Any amino acid
  MOD_RES (2248)..(2265): Any amino acid
  MOD_RES (2275)..(2276): Any amino acid
  MOD_RES (2285)..(2299): Any amino acid
  MOD_RES (2308)..(2350): Any amino acid
  MOD_RES (2360)..(2396): Any amino acid
  MOD_RES (2407)..(3228): Any amino acid
  MOD_RES (3237)..(3321): Any amino acid
  MOD_RES (3332)..(3395): Any amino acid
  MOD_RES (3404)..(3531): Any amino acid
  MOD_RES (3540)..(3546): Any amino acid
  MOD_RES (3555)..(3654): Any amino acid
  MOD_RES (3663)..(3667): Any amino acid
  MOD_RES (3676)..(3727): Any amino acid
  MOD_RES (3736)..(3877): Any amino acid
  MOD_RES (3886)..(3930): Any amino acid
  MOD_RES (3939)..(3956): Any amino acid
  MOD_RES (3968)..(3987): Any amino acid
  MOD_RES (4000)..(4012): Any amino acid
  MOD_RES (4023)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDRGWGNGXGLFGKGGVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLHTLWHTTRGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIIGLYGNGXXXXXXXXXXXXXXXXXXXXXXXXXXXXXXXXXXXXXXXXXXXXDFHPGSGKTHXXXXXXXXXXXXXXXXTVILAPTRVVLSEXXXXXXXXXXXXXXXXXXXXXXXXXXXXIDAMCHATLXXXXXXXXXXXXXXXXXXIMDEGHWTDXXSIAARGWAXXXXXXXXXXXXXXXMTATPPGKXXXXXXXXXXXXXXXXXXXXXXXXXXXXXXXXXXXXXXXXXXXRPTAWFLPSXXXXXXXXXXXXXXXXXXXXXXXXXXXXXXXXXXXXXPDFILATDIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSRGTSKLXXXXXXXXXXXXXXXXXXXXXXXXXXXXXXXXXXXXXXXXXXXXXXXXXXXXXXXXXXXXXXXXXXXXXXXXXXXXXXXXXXXXXTIMCDIGESSXXXXXXXXXXXXXXXXXXXXXXXXXXXXXXXXXXXXXXXXXXXXXXXXXXXXXXXXXXXXXXXXNSTHEMYFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAMTDTTAXXXXXXXKDKVDTKAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSEFGKAKGXXXXXYMWLGSRFXXXXXXXXXXXXXXXXXXXXXXXXXXXXXXXXXXXXXXXXXXXXXXXXXXXXLYADDTAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLLVSGDDXXXXXXXXXXXXXXXXXXXXXXXXXXXXXXXXXXXXXXXXXXXXXPFCSHHFNXXXXXXXXXXXXXXXXXXELIGRARVSPGXXXXXXXXXXXXXXXXXXXXLMYFHKRDMRLLXXXXXXXXXXXXXPQGRTTWSVHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265901 - protein, 4145 aa, Flavivirus
  MOD_RES (1)..(510): Any amino acid
  MOD_RES (519)..(2009): Any amino acid
  MOD_RES (2018)..(2171): Any amino acid
  MOD_RES (2181)..(2197): Any amino acid
  MOD_RES (2211)..(2265): Any amino acid
  MOD_RES (2274)..(2299): Any amino acid
  MOD_RES (2308)..(2350): Any amino acid
  MOD_RES (2360)..(2396): Any amino acid
  MOD_RES (2405)..(3228): Any amino acid
  MOD_RES (3237)..(3321): Any amino acid
  MOD_RES (3332)..(3654): Any amino acid
  MOD_RES (3663)..(3667): Any amino acid
  MOD_RES (3676)..(3877): Any amino acid
  MOD_RES (3886)..(3930): Any amino acid
  MOD_RES (3939)..(3956): Any amino acid
  MOD_RES (3968)..(3988): Any amino acid
  MOD_RES (4000)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGFFGKGSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMWHVTQGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDAHPGSGKTXXXXXXXXXXXXXXXXXTVVLAPTRVVLREXXXXXXXXXXXXXXXXXXXXXXXXXXXXXXXXXXXXXXXXXXXXXXXXXXXXXXXIMDEGHWTXXXXXXXXXXXXXXXXXXXXXXXXXXMSATPPGTXXXXXXXXXXXXXXXXXXXXXXXXXXXXXXXXXXXXXXXXXXXGRTVWFVPSXXXXXXXXXXXXXXXXXXXXXXXXXXXXXXXXXXXXXPDFILATDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSRGCAKLXXXXXXXXXXXXXXXXXXXXXXXXXXXXXXXXXXXXXXXXXXXXXXXXXXXXXXXXXXXXXXXXXXXXXXXXXXXXXXXXXXXXXTVLCDIGESNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAEFGKAKGXXXXXFMWLGARYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNMVIAGDDXXXXXXXXXXXXXXXXXXXXXXXXXXXXXXXXXXXXXXXXXXXXXEFCSNHFHXXXXXXXXXXXXXXXXXXELIGRGRVSPGXXXXXXXXXXXXXXXXXXXXXNYFHRRDLRVMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265902 - protein, 4145 aa, Flavivirus
  MOD_RES (1)..(501): Any amino acid
  MOD_RES (519)..(2005): Any amino acid
  MOD_RES (2018)..(2197): Any amino acid
  MOD_RES (2209)..(2265): Any amino acid
  MOD_RES (2276)..(2297): Any amino acid
  MOD_RES (2307)..(2350): Any amino acid
  MOD_RES (2360)..(2396): Any amino acid
  MOD_RES (2413)..(2447): Any amino acid
  MOD_RES (2460)..(3250): Any amino acid
  MOD_RES (3265)..(3321): Any amino acid
  MOD_RES (3331)..(3391): Any amino acid
  MOD_RES (3404)..(3531): Any amino acid
  MOD_RES (3555)..(3641): Any amino acid
  MOD_RES (3690)..(3727): Any amino acid
  MOD_RES (3742)..(3810): Any amino acid
  MOD_RES (3825)..(3954): Any amino acid
  MOD_RES (3966)..(3987): Any amino acid
  MOD_RES (4000)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVDRGWGNGCGLFGKGSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFHTMWHVTRGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLILAPTRVVAXXXXXXXXXXXXXXXXXXXXXXXXXXXXXXXXXXXXXXXXXXXXXXXXXXXXXXXXXIMDEAHFTDPXXXXXXXXXXXXXXXXXXXXXXIFMTATPPGXXXXXXXXXXXXXXXXXXXXXXXXXXXXXXXXXXXXXXXXXXXXGKTVWFVPSXXXXXXXXXXXXXXXXXXXXXXXXXXXXXXXXXXXXXWDFVVTTDISEMGANFXXXXXXXXXXXXXXXXXXXXXXXXXXXXXXXXXXXASAAQRRGRIGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVIDLGCGRGGWSYYXXXXXXXXXXXXXXXXXXXXXXXXXXXXXXXXXXXXXXXXXXXXXXXXXXXXXXXXXTLLCDIGESXXXXXXXXXXXXXXXXXXXXXXXXXXXXXXXXXXXXXXXXXXXXXXXXXXXXXXXXXXXXXPLSRNSTHEMYWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAMTDTTPFGQQRVFKEKVDTRTXXXXXXXXXXXXXXXXXXXXXXXXXXXXXXXXXXXXXXXXXXXXXXXXXXXXXXXXXXXXXXXXXXXXXXXXXXXXXXXXXXXXXXXCVYNMMGKREKKLGEFGKAKGSRAIWYMWLGARFLEFEALGFLNEDHWXXXXXXXXXXXXXXXXXXXXXXXXXXXXXXXXXXXXXXMYADDTAGWDTRITXXXXXXXXXXXXXXXXXXXXXXXXXXXXXXXXXXXXXXXXXXXXXXXXXXXXXXXXXXXXXXXXXXXXXQRGSGQVGTYGLNTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQDELIGRARISXXXXXXXXXXXXXXXXXXXXXXLMYFHRRDLRLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265903 - protein, 4145 aa, Flavivirus
  MOD_RES (1)..(501): Any amino acid
  MOD_RES (519)..(2005): Any amino acid
  MOD_RES (2018)..(2197): Any amino acid
  MOD_RES (2209)..(2265): Any amino acid
  MOD_RES (2276)..(2297): Any amino acid
  MOD_RES (2307)..(2350): Any amino acid
  MOD_RES (2360)..(2396): Any amino acid
  MOD_RES (2413)..(2447): Any amino acid
  MOD_RES (2460)..(3250): Any amino acid
  MOD_RES (3265)..(3321): Any amino acid
  MOD_RES (3331)..(3391): Any amino acid
  MOD_RES (3404)..(3531): Any amino acid
  MOD_RES (3555)..(3641): Any amino acid
  MOD_RES (3690)..(3727): Any amino acid
  MOD_RES (3742)..(3810): Any amino acid
  MOD_RES (3825)..(3954): Any amino acid
  MOD_RES (3966)..(3987): Any amino acid
  MOD_RES (4000)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTDRGWGNGCGLFGKGGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFHTLWHTTKGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTAVLAPTRVVAXXXXXXXXXXXXXXXXXXXXXXXXXXXXXXXXXXXXXXXXXXXXXXXXXXXXXXXXXVMDEAHWTDPXXXXXXXXXXXXXXXXXXXXXXVLMTATPPGXXXXXXXXXXXXXXXXXXXXXXXXXXXXXXXXXXXXXXXXXXXXGKTVWFVASXXXXXXXXXXXXXXXXXXXXXXXXXXXXXXXXXXXXXWDYVIATDISEMGANLXXXXXXXXXXXXXXXXXXXXXXXXXXXXXXXXXXXSSAAQRRGRVGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVDLGCGRGGWCYYXXXXXXXXXXXXXXXXXXXXXXXXXXXXXXXXXXXXXXXXXXXXXXXXXXXXXXXXXTLFCDIGESXXXXXXXXXXXXXXXXXXXXXXXXXXXXXXXXXXXXXXXXXXXXXXXXXXXXXXXXXXXXXPLSRNSTHEMYYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIAMTDTTAFGQQRVFKEKVDTKAXXXXXXXXXXXXXXXXXXXXXXXXXXXXXXXXXXXXXXXXXXXXXXXXXXXXXXXXXXXXXXXXXXXXXXXXXXXXXXXXXXXXXXXCIYNMMGKREKKPGEFGRAKGSRAIWYMWLGARYLEFEALGFMNEDHWXXXXXXXXXXXXXXXXXXXXXXXXXXXXXXXXXXXXXXIYADDTAGWDTKVTXXXXXXXXXXXXXXXXXXXXXXXXXXXXXXXXXXXXXXXXXXXXXXXXXXXXXXXXXXXXXXXXXXXXXQRGSGQVVTYALNTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQDELVGRARVSXXXXXXXXXXXXXXXXXXXXXXLLYFHRRDLRLMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265904 - protein, 4145 aa, Flavivirus
  MOD_RES (1)..(501): Any amino acid
  MOD_RES (519)..(2005): Any amino acid
  MOD_RES (2018)..(2197): Any amino acid
  MOD_RES (2209)..(2265): Any amino acid
  MOD_RES (2276)..(2297): Any amino acid
  MOD_RES (2307)..(2350): Any amino acid
  MOD_RES (2360)..(2396): Any amino acid
  MOD_RES (2413)..(3250): Any amino acid
  MOD_RES (3261)..(3321): Any amino acid
  MOD_RES (3331)..(3391): Any amino acid
  MOD_RES (3404)..(3531): Any amino acid
  MOD_RES (3541)..(3544): Any amino acid
  MOD_RES (3555)..(3645): Any amino acid
  MOD_RES (3682)..(3727): Any amino acid
  MOD_RES (3742)..(3812): Any amino acid
  MOD_RES (3825)..(3954): Any amino acid
  MOD_RES (3966)..(3987): Any amino acid
  MOD_RES (4000)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDRGWGNHCGLFGKGSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFHTMWHVTRGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLVLAPTRVVLXXXXXXXXXXXXXXXXXXXXXXXXXXXXXXXXXXXXXXXXXXXXXXXXXXXXXXXXXIMDEAHFLDPXXXXXXXXXXXXXXXXXXXXXXILMTATPPGXXXXXXXXXXXXXXXXXXXXXXXXXXXXXXXXXXXXXXXXXXXXGRTAWFVPSXXXXXXXXXXXXXXXXXXXXXXXXXXXXXXXXXXXXXWDFILATDIAEMGANLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVMDLGCGRGGXXXXXXXXXXXXXXXXXXXXXXXXXXXXXXXXXXXXXXXXXXXXXXXXXXXXXXXXXXXXXTIMCDIGESXXXXXXXXXXXXXXXXXXXXXXXXXXXXXXXXXXXXXXXXXXXXXXXXXXXXXXXXXXXXXPFSRNSNHEMYWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAMTDTTPFXXXXVFKEKVDTRAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMMGKREKKTGEFGVAKGSRAIWFMWLGSRFLEFEALXXXXXXXXXXXXXXXXXXXXXXXXXXXXXXXXXXXXXXXXXXXXXXFYADDTAGWDTRVTXXXXXXXXXXXXXXXXXXXXXXXXXXXXXXXXXXXXXXXXXXXXXXXXXXXXXXXXXXXXXXXXXXXXXXXGSGQVVTYGLNTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQDELVGRARISXXXXXXXXXXXXXXXXXXXXXXLSYFHRRDLRTLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265905 - protein, 4145 aa, Flavivirus
  MOD_RES (1)..(501): Any amino acid
  MOD_RES (519)..(2005): Any amino acid
  MOD_RES (2018)..(2197): Any amino acid
  MOD_RES (2208)..(2265): Any amino acid
  MOD_RES (2276)..(2350): Any amino acid
  MOD_RES (2360)..(2396): Any amino acid
  MOD_RES (2408)..(3321): Any amino acid
  MOD_RES (3331)..(3394): Any amino acid
  MOD_RES (3404)..(3531): Any amino acid
  MOD_RES (3541)..(3545): Any amino acid
  MOD_RES (3555)..(3645): Any amino acid
  MOD_RES (3664)..(3666): Any amino acid
  MOD_RES (3677)..(3727): Any amino acid
  MOD_RES (3742)..(3955): Any amino acid
  MOD_RES (3966)..(3987): Any amino acid
  MOD_RES (4000)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDRGWGNGCGLFGKGGVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLHTLWHTTRGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVILAPTRVVXXXXXXXXXXXXXXXXXXXXXXXXXXXXXXXXXXXXXXXXXXXXXXXXXXXXXXXXXXIMDEGHWTDPXXXXXXXXXXXXXXXXXXXXXXXXXXXXXXXXXXXXXXXXXXXXXXXXXXXXXXXXXXXXXXXXXXXXXXXXXXXRPTAWFLPSXXXXXXXXXXXXXXXXXXXXXXXXXXXXXXXXXXXXXPDFILATDIAEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTILCDIGESXXXXXXXXXXXXXXXXXXXXXXXXXXXXXXXXXXXXXXXXXXXXXXXXXXXXXXXXXXXXXXXXRNSTHEMYFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAMTDTTAFXXXXXFKDKVDTKAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMMGKREKKISEFGKAKGSXXXWYMWLGSRFLXXXXXXXXXXXXXXXXXXXXXXXXXXXXXXXXXXXXXXXXXXXXXXXXXXXLYADDTAGWDTKITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDELIGRGRVSXXXXXXXXXXXXXXXXXXXXXXLMYFHKRDMRLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265906 - protein, 4145 aa, Flavivirus
  MOD_RES (1)..(509): Any amino acid
  MOD_RES (519)..(2008): Any amino acid
  MOD_RES (2018)..(2197): Any amino acid
  MOD_RES (2208)..(2265): Any amino acid
  MOD_RES (2275)..(2350): Any amino acid
  MOD_RES (2360)..(2396): Any amino acid
  MOD_RES (2406)..(3321): Any amino acid
  MOD_RES (3331)..(3531): Any amino acid
  MOD_RES (3541)..(3645): Any amino acid
  MOD_RES (3664)..(3666): Any amino acid
  MOD_RES (3677)..(3955): Any amino acid
  MOD_RES (3966)..(3987): Any amino acid
  MOD_RES (4000)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCGFFGKGSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTMWHATEGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVVLAPTRVVXXXXXXXXXXXXXXXXXXXXXXXXXXXXXXXXXXXXXXXXXXXXXXXXXXXXXXXXXXIMDEAHFMDXXXXXXXXXXXXXXXXXXXXXXXXXXXXXXXXXXXXXXXXXXXXXXXXXXXXXXXXXXXXXXXXXXXXXXXXXXXXGRTVWFVPSXXXXXXXXXXXXXXXXXXXXXXXXXXXXXXXXXXXXXPDFILATDIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVMCDIGESXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFLMTDVSTYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTMGKKEKKPAEFGKAKGSXXXWFMWLGARYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDELIGRARVSXXXXXXXXXXXXXXXXXXXXXXLNYFHRRDLRVMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265907 - protein, 4145 aa, Flavivirus
  MOD_RES (1)..(501): Any amino acid
  MOD_RES (518)..(2007): Any amino acid
  MOD_RES (2018)..(2197): Any amino acid
  MOD_RES (2208)..(2265): Any amino acid
  MOD_RES (2276)..(2396): Any amino acid
  MOD_RES (2413)..(2447): Any amino acid
  MOD_RES (2460)..(3250): Any amino acid
  MOD_RES (3265)..(3391): Any amino acid
  MOD_RES (3404)..(3531): Any amino acid
  MOD_RES (3555)..(3641): Any amino acid
  MOD_RES (3690)..(3727): Any amino acid
  MOD_RES (3742)..(3810): Any amino acid
  MOD_RES (3825)..(3954): Any amino acid
  MOD_RES (3965)..(3987): Any amino acid
  MOD_RES (4000)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVDRGWGNGCGLFGKGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHTMWHVTRGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLILAPTRVVXXXXXXXXXXXXXXXXXXXXXXXXXXXXXXXXXXXXXXXXXXXXXXXXXXXXXXXXXXIMDEAHFTDPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWDFVVTTDISEMGANFXXXXXXXXXXXXXXXXXXXXXXXXXXXXXXXXXXXASAAQRRGRIGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVIDLGCGRGGWSYYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPLSRNSTHEMYWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAMTDTTPFGQQRVFKEKVDTRTXXXXXXXXXXXXXXXXXXXXXXXXXXXXXXXXXXXXXXXXXXXXXXXXXXXXXXXXXXXXXXXXXXXXXXXXXXXXXXXXXXXXXXXCVYNMMGKREKKLGEFGKAKGSRAIWYMWLGARFLEFEALGFLNEDHWXXXXXXXXXXXXXXXXXXXXXXXXXXXXXXXXXXXXXXMYADDTAGWDTRITXXXXXXXXXXXXXXXXXXXXXXXXXXXXXXXXXXXXXXXXXXXXXXXXXXXXXXXXXXXXXXXXXXXXXQRGSGQVGTYGLNTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQDELIGRARIXXXXXXXXXXXXXXXXXXXXXXXLMYFHRRDLRLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265908 - protein, 4145 aa, Flavivirus
  MOD_RES (1)..(501): Any amino acid
  MOD_RES (518)..(2007): Any amino acid
  MOD_RES (2018)..(2197): Any amino acid
  MOD_RES (2208)..(2265): Any amino acid
  MOD_RES (2276)..(2396): Any amino acid
  MOD_RES (2413)..(2447): Any amino acid
  MOD_RES (2460)..(3250): Any amino acid
  MOD_RES (3265)..(3391): Any amino acid
  MOD_RES (3404)..(3531): Any amino acid
  MOD_RES (3555)..(3641): Any amino acid
  MOD_RES (3690)..(3727): Any amino acid
  MOD_RES (3742)..(3810): Any amino acid
  MOD_RES (3825)..(3954): Any amino acid
  MOD_RES (3965)..(3987): Any amino acid
  MOD_RES (4000)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTDRGWGNGCGLFGKGGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHTLWHTTKGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTAVLAPTRVVXXXXXXXXXXXXXXXXXXXXXXXXXXXXXXXXXXXXXXXXXXXXXXXXXXXXXXXXXXVMDEAHFTDPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWDYVIATDISEMGANLXXXXXXXXXXXXXXXXXXXXXXXXXXXXXXXXXXXSSAAQRRGRVGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVDLGCGRGGWCYYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPLSRNSTHEMYYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIAMTDTTAFGQQRVFKEKVDTKAXXXXXXXXXXXXXXXXXXXXXXXXXXXXXXXXXXXXXXXXXXXXXXXXXXXXXXXXXXXXXXXXXXXXXXXXXXXXXXXXXXXXXXXCIYNMMGKREKKPGEFGKAKGSRAIWYMWLGARFLEFEALGFMNEDHWXXXXXXXXXXXXXXXXXXXXXXXXXXXXXXXXXXXXXXIYADDTAGWDTKVTXXXXXXXXXXXXXXXXXXXXXXXXXXXXXXXXXXXXXXXXXXXXXXXXXXXXXXXXXXXXXXXXXXXXXQRGSGQVVTYALNTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQDELVGRARVXXXXXXXXXXXXXXXXXXXXXXXLLYFHRRDLRLMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265909 - protein, 4145 aa, Flavivirus
  MOD_RES (1)..(501): Any amino acid
  MOD_RES (518)..(2007): Any amino acid
  MOD_RES (2018)..(2197): Any amino acid
  MOD_RES (2208)..(2265): Any amino acid
  MOD_RES (2276)..(2396): Any amino acid
  MOD_RES (2413)..(2447): Any amino acid
  MOD_RES (2458)..(3250): Any amino acid
  MOD_RES (3262)..(3391): Any amino acid
  MOD_RES (3404)..(3531): Any amino acid
  MOD_RES (3555)..(3644): Any amino acid
  MOD_RES (3685)..(3727): Any amino acid
  MOD_RES (3742)..(3811): Any amino acid
  MOD_RES (3825)..(3954): Any amino acid
  MOD_RES (3965)..(3987): Any amino acid
  MOD_RES (4000)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDRGWGNHCGLFGKGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHTMWHVTRGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLVLAPTRVVXXXXXXXXXXXXXXXXXXXXXXXXXXXXXXXXXXXXXXXXXXXXXXXXXXXXXXXXXXIMDEAHWTDPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWDFILATDIAEMGANLXXXXXXXXXXXXXXXXXXXXXXXXXXXXXXXXXXXASAAQRRGRVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVMDLGCGRGGWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFSRNSNHEMYWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSMTDTTAFGQQRVFKEKVDTRAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNMMGKREKKTGEFGRAKGSRAIWFMWLGSRYLEFEALGFLXXXXXXXXXXXXXXXXXXXXXXXXXXXXXXXXXXXXXXXXXXXFYADDTAGWDTRVTXXXXXXXXXXXXXXXXXXXXXXXXXXXXXXXXXXXXXXXXXXXXXXXXXXXXXXXXXXXXXXXXXXXXXXRGSGQVVTYGLNTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQDELVGRARIXXXXXXXXXXXXXXXXXXXXXXXLSYFHRRDLRTLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265910 - protein, 4145 aa, Flavivirus
  MOD_RES (1)..(501): Any amino acid
  MOD_RES (512)..(2007): Any amino acid
  MOD_RES (2018)..(2197): Any amino acid
  MOD_RES (2208)..(2265): Any amino acid
  MOD_RES (2276)..(2396): Any amino acid
  MOD_RES (2409)..(2447): Any amino acid
  MOD_RES (2458)..(3392): Any amino acid
  MOD_RES (3404)..(3531): Any amino acid
  MOD_RES (3542)..(3544): Any amino acid
  MOD_RES (3555)..(3644): Any amino acid
  MOD_RES (3678)..(3727): Any amino acid
  MOD_RES (3742)..(3954): Any amino acid
  MOD_RES (3965)..(3987): Any amino acid
  MOD_RES (4000)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDRGWGNGCGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHTLWHTTRGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVILAPTRVVXXXXXXXXXXXXXXXXXXXXXXXXXXXXXXXXXXXXXXXXXXXXXXXXXXXXXXXXXXIMDEAHFLDPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPDFILATDIAEMXXXXXXXXXXXXXXXXXXXXXXXXXXXXXXXXXXXXXXXSSAAQRRGRVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSRNSTHEMYFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAMTDTTAFGXXXVFKDKVDTKAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNMMGKREKKISEFGVAKGSRAIWYMWLGSRFLEXXXXXXXXXXXXXXXXXXXXXXXXXXXXXXXXXXXXXXXXXXXXXXXXXXLYADDTAGWDTKITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQDELIGRGRVXXXXXXXXXXXXXXXXXXXXXXXLMYFHKRDMRLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265911 - protein, 4145 aa, Flavivirus
  MOD_RES (1)..(2007): Any amino acid
  MOD_RES (2018)..(2197): Any amino acid
  MOD_RES (2208)..(2265): Any amino acid
  MOD_RES (2276)..(2396): Any amino acid
  MOD_RES (2407)..(3531): Any amino acid
  MOD_RES (3542)..(3644): Any amino acid
  MOD_RES (3665)..(3665): Any amino acid
  MOD_RES (3678)..(3954): Any amino acid
  MOD_RES (3965)..(3987): Any amino acid
  MOD_RES (4000)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHTMWHVTQGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTAILAPTRVVXXXXXXXXXXXXXXXXXXXXXXXXXXXXXXXXXXXXXXXXXXXXXXXXXXXXXXXXXXIMDEAHFMDPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPDFILATDIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFLMTDVSTYSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNTMGKKEKKPAEFGKAKGSRXIWFMWLGARYLEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQDELIGRARVXXXXXXXXXXXXXXXXXXXXXXXLNYFHRRDLRVMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265912 - protein, 4145 aa, Flavivirus
  MOD_RES (1)..(501): Any amino acid
  MOD_RES (518)..(2396): Any amino acid
  MOD_RES (2413)..(2447): Any amino acid
  MOD_RES (2460)..(3250): Any amino acid
  MOD_RES (3265)..(3391): Any amino acid
  MOD_RES (3403)..(3531): Any amino acid
  MOD_RES (3555)..(3641): Any amino acid
  MOD_RES (3654)..(3655): Any amino acid
  MOD_RES (3690)..(3727): Any amino acid
  MOD_RES (3742)..(3810): Any amino acid
  MOD_RES (3825)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVDRGWGNGCGLFGKGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWDFVVTTDISEMGANFXXXXXXXXXXXXXXXXXXXXXXXXXXXXXXXXXXXASAAQRRGRIGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVIDLGCGRGGWSYYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPLSRNSTHEMYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAMTDTTPFGQQRVFKEKVDTRTXXXXXXXXXXXXXXXXXXXXXXXXXXXXXXXXXXXXXXXXXXXXXXXXXXXXXXXXXXXXXXXXXXXXXXXXXXXXXXXXXXXXXXXCVYNMMGKREKKXXEFGKAKGSRAIWYMWLGARFLEFEALGFLNEDHWXXXXXXXXXXXXXXXXXXXXXXXXXXXXXXXXXXXXXXMYADDTAGWDTRITXXXXXXXXXXXXXXXXXXXXXXXXXXXXXXXXXXXXXXXXXXXXXXXXXXXXXXXXXXXXXXXXXXXXXQRGSGQVGTYGLNTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265913 - protein, 4145 aa, Flavivirus
  MOD_RES (1)..(501): Any amino acid
  MOD_RES (518)..(2396): Any amino acid
  MOD_RES (2413)..(2447): Any amino acid
  MOD_RES (2460)..(3250): Any amino acid
  MOD_RES (3265)..(3391): Any amino acid
  MOD_RES (3403)..(3531): Any amino acid
  MOD_RES (3555)..(3641): Any amino acid
  MOD_RES (3654)..(3655): Any amino acid
  MOD_RES (3690)..(3727): Any amino acid
  MOD_RES (3742)..(3810): Any amino acid
  MOD_RES (3825)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTDRGWGNGCGLFGKGGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWDYVITTDISEMGANLXXXXXXXXXXXXXXXXXXXXXXXXXXXXXXXXXXXSSAAQRRGRVGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVDLGCGRGGWCYYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPLSRNSNHEMYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIAMTDTTAFGQQRVFKEKVDTKAXXXXXXXXXXXXXXXXXXXXXXXXXXXXXXXXXXXXXXXXXXXXXXXXXXXXXXXXXXXXXXXXXXXXXXXXXXXXXXXXXXXXXXXCIYNMMGKREKKXXEFGKAKGSRAIWYMWLGARFLEFEALGFMNEDHWXXXXXXXXXXXXXXXXXXXXXXXXXXXXXXXXXXXXXXIYADDTAGWDTKVTXXXXXXXXXXXXXXXXXXXXXXXXXXXXXXXXXXXXXXXXXXXXXXXXXXXXXXXXXXXXXXXXXXXXXQRGSGQVVTYALNTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265914 - protein, 4145 aa, Flavivirus
  MOD_RES (1)..(501): Any amino acid
  MOD_RES (518)..(2396): Any amino acid
  MOD_RES (2413)..(2447): Any amino acid
  MOD_RES (2459)..(3250): Any amino acid
  MOD_RES (3263)..(3391): Any amino acid
  MOD_RES (3403)..(3531): Any amino acid
  MOD_RES (3555)..(3655): Any amino acid
  MOD_RES (3686)..(3727): Any amino acid
  MOD_RES (3742)..(3810): Any amino acid
  MOD_RES (3825)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDRGWGNHCGLFGKGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWDFILATDIAEMGANLXXXXXXXXXXXXXXXXXXXXXXXXXXXXXXXXXXXASAAQRRGRVGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVIDLGCGRGGWCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFSRNSTHEMYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSMTDTTAFGQQRVFKEKVDTRAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEFGRAKGSRAIWFMWLGSRYLEFEALGFLNXXXXXXXXXXXXXXXXXXXXXXXXXXXXXXXXXXXXXXXXXXFYADDTAGWDTRVTXXXXXXXXXXXXXXXXXXXXXXXXXXXXXXXXXXXXXXXXXXXXXXXXXXXXXXXXXXXXXXXXXXXXXQRGSGQVVTYGLNTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265915 - protein, 4145 aa, Flavivirus
  MOD_RES (1)..(501): Any amino acid
  MOD_RES (518)..(2396): Any amino acid
  MOD_RES (2410)..(2447): Any amino acid
  MOD_RES (2459)..(3251): Any amino acid
  MOD_RES (3263)..(3391): Any amino acid
  MOD_RES (3403)..(3531): Any amino acid
  MOD_RES (3543)..(3543): Any amino acid
  MOD_RES (3555)..(3655): Any amino acid
  MOD_RES (3679)..(3727): Any amino acid
  MOD_RES (3742)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDRGWGNHCGFFGKGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPDFILATDIAEMGXXXXXXXXXXXXXXXXXXXXXXXXXXXXXXXXXXXXXXSSAAQRRGRVGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVDLGCGRGGWCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPLSRNSSHEMYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAMTDTTAFGQXRVFKDKVDTKAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEFGVAKGSRAIWYMWLGSRFLEFXXXXXXXXXXXXXXXXXXXXXXXXXXXXXXXXXXXXXXXXXXXXXXXXXLYADDTAGWDTKITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265916 - protein, 4145 aa, Flavivirus
  MOD_RES (1)..(501): Any amino acid
  MOD_RES (513)..(2396): Any amino acid
  MOD_RES (2408)..(3251): Any amino acid
  MOD_RES (3263)..(3531): Any amino acid
  MOD_RES (3543)..(3664): Any amino acid
  MOD_RES (3679)..(4145): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDRGWGNHCGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPDFILATDIAEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMDLGCGRGGWSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFLMTDVSTYSQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAIWFMWLGARYLEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265917 - protein, 9 aa, Norovirus
KMASNDASV

SEQ ID NO: 265918 - protein, 9 aa, Norovirus
RPVYTPQHL

SEQ ID NO: 265919 - protein, 9 aa, Norovirus
RQLAAENKY

SEQ ID NO: 265920 - protein, 9 aa, Norovirus
MPLAARMGT

SEQ ID NO: 265921 - protein, 9 aa, Norovirus
NGAGRRRAL

SEQ ID NO: 265922 - protein, 9 aa, Norovirus
IVLCALSSL

SEQ ID NO: 265923 - protein, 9 aa, Norovirus
MIAPLLGDY

SEQ ID NO: 265924 - protein, 9 aa, Norovirus
LAADNNYGF

SEQ ID NO: 265925 - protein, 9 aa, Norovirus
YSFYGDDYI

SEQ ID NO: 265926 - protein, 9 aa, Norovirus
CVRAFGGLM

SEQ ID NO: 265927 - protein, 9 aa, Norovirus
CARAFGGLM

SEQ ID NO: 265928 - protein, 9 aa, Norovirus
LTTLSLFWR

SEQ ID NO: 265929 - protein, 9 aa, Norovirus
IAKATEENF

SEQ ID NO: 265930 - protein, 9 aa, Norovirus
MVLGFTKER

SEQ ID NO: 265931 - protein, 9 aa, Norovirus
RLHGETFPY

SEQ ID NO: 265932 - protein, 9 aa, Norovirus
RMGTHATMR

SEQ ID NO: 265933 - protein, 9 aa, Norovirus
MLLTGSNAK

SEQ ID NO: 265934 - protein, 9 aa, Norovirus
LLAELFGVF

SEQ ID NO: 265935 - protein, 9 aa, Norovirus
VMRDQLKPF

SEQ ID NO: 265936 - protein, 9 aa, Norovirus
LAIGFTRDK

SEQ ID NO: 265937 - protein, 9 aa, Norovirus
RSARAFGPF

SEQ ID NO: 265938 - protein, 9 aa, Norovirus
KPLNILNIL

SEQ ID NO: 265939 - protein, 9 aa, Norovirus
KLKKVANIF

SEQ ID NO: 265940 - protein, 9 aa, Norovirus
AASAAGSIL

SEQ ID NO: 265941 - protein, 9 aa, Norovirus
SSMAVTLKR

SEQ ID NO: 265942 - protein, 9 aa, Norovirus
RLHGESFPY

SEQ ID NO: 265943 - protein, 9 aa, Norovirus
VMRDQLRPF

SEQ ID NO: 265944 - protein, 9 aa, Norovirus
CYAFCCWVL

SEQ ID NO: 265945 - protein, 9 aa, Norovirus
RPDKTDGPI

SEQ ID NO: 265946 - protein, 9 aa, Norovirus
GIVESLILL

SEQ ID NO: 265947 - protein, 9 aa, Norovirus
ISGKPGIGK

SEQ ID NO: 265948 - protein, 9 aa, Norovirus
MVLGFTAEK

SEQ ID NO: 265949 - protein, 9 aa, Norovirus
FSFDGDDEI

SEQ ID NO: 265950 - protein, 9 aa, Norovirus
IMRDQLKPF

SEQ ID NO: 265951 - protein, 9 aa, Norovirus
MAVTLKRAL

SEQ ID NO: 265952 - protein, 9 aa, Norovirus
LLWGSDLST

SEQ ID NO: 265953 - protein, 9 aa, Norovirus
APLLGDYEL

SEQ ID NO: 265954 - protein, 9 aa, Norovirus
TVDDSKLKK

SEQ ID NO: 265955 - protein, 9 aa, Norovirus
AASAAGSAL

SEQ ID NO: 265956 - protein, 9 aa, Norovirus
AMLYTPLRA

SEQ ID NO: 265957 - protein, 9 aa, Norovirus
AARMGTHAT

SEQ ID NO: 265958 - protein, 9 aa, Norovirus
SSLFTRPIK

SEQ ID NO: 265959 - protein, 9 aa, Norovirus
LLWGADLST

SEQ ID NO: 265960 - protein, 9 aa, Norovirus
CTLSSLFTR

SEQ ID NO: 265961 - protein, 9 aa, Norovirus
TLSLFWRPV

SEQ ID NO: 265962 - protein, 9 aa, Norovirus
RLLAYLYTP

SEQ ID NO: 265963 - protein, 9 aa, Norovirus
AVRMGTHAS

SEQ ID NO: 265964 - protein, 9 aa, Norovirus
VMLWDDYGM

SEQ ID NO: 265965 - protein, 9 aa, Norovirus
AASTAGSAL

SEQ ID NO: 265966 - protein, 9 aa, Norovirus
IFLCTLSSL

SEQ ID NO: 265967 - protein, 9 aa, Norovirus
MIQRTTGFF

SEQ ID NO: 265968 - protein, 9 aa, Norovirus
QYLISPDTL

SEQ ID NO: 265969 - protein, 9 aa, Norovirus
RLLWGSDLA

SEQ ID NO: 265970 - protein, 9 aa, Norovirus
TPLRANSPT

SEQ ID NO: 265971 - protein, 9 aa, Norovirus
TMDDTKVKK

SEQ ID NO: 265972 - protein, 9 aa, Norovirus
MLLTGANAK

SEQ ID NO: 265973 - protein, 9 aa, Norovirus
KLMHGQSGM

SEQ ID NO: 265974 - protein, 9 aa, Norovirus
QASKANLMF

SEQ ID NO: 265975 - protein, 9 aa, Norovirus
VLCALSSLF

SEQ ID NO: 265976 - protein, 9 aa, Norovirus
SLILLAALF

SEQ ID NO: 265977 - protein, 9 aa, Norovirus
RMIQRTTGF

SEQ ID NO: 265978 - protein, 9 aa, Norovirus
IVAMLYTPL

SEQ ID NO: 265979 - protein, 9 aa, Norovirus
ILATCDWTF

SEQ ID NO: 265980 - protein, 9 aa, Norovirus
LPTMDDSKL

SEQ ID NO: 265981 - protein, 9 aa, Norovirus
NGTGRRRVL

SEQ ID NO: 265982 - protein, 9 aa, Norovirus
RPDKTEGPL

SEQ ID NO: 265983 - protein, 9 aa, Norovirus
GPVCRRVDF

SEQ ID NO: 265984 - protein, 9 aa, Norovirus
YLQDRDKYY

SEQ ID NO: 265985 - protein, 9 aa, Norovirus
RWIFRPTSK

SEQ ID NO: 265986 - protein, 9 aa, Norovirus
LLSSAASSL

SEQ ID NO: 265987 - protein, 9 aa, Norovirus
LLWGADLGT

SEQ ID NO: 265988 - protein, 9 aa, Norovirus
LVNPAPLDY

SEQ ID NO: 265989 - protein, 9 aa, Norovirus
RLVHGQSGM

SEQ ID NO: 265990 - protein, 9 aa, Norovirus
RPLNIINIL

SEQ ID NO: 265991 - protein, 9 aa, Norovirus
KPPAAISFA

SEQ ID NO: 265992 - protein, 9 aa, Norovirus
LAYLYTPLR

SEQ ID NO: 265993 - protein, 9 aa, Norovirus
AGNAFTAGK

SEQ ID NO: 265994 - protein, 9 aa, Norovirus
RPDKTEGPI

SEQ ID NO: 265995 - protein, 9 aa, Norovirus
QAAHANNMY

SEQ ID NO: 265996 - protein, 9 aa, Norovirus
RPLNVINIL

SEQ ID NO: 265997 - protein, 9 aa, Norovirus
TVSCRVLTR

SEQ ID NO: 265998 - protein, 9 aa, Norovirus
LLWGSDLAT

SEQ ID NO: 265999 - protein, 9 aa, Norovirus
KLHGETFPY

SEQ ID NO: 266000 - protein, 9 aa, Norovirus
NGTGRRRAL

SEQ ID NO: 266001 - protein, 9 aa, Norovirus
VAMLYTPLR

SEQ ID NO: 266002 - protein, 9 aa, Norovirus
IARATEEDF

SEQ ID NO: 266003 - protein, 9 aa, Norovirus
GVVESLILL

SEQ ID NO: 266004 - protein, 9 aa, Norovirus
MAQAIFGAI

SEQ ID NO: 266005 - protein, 9 aa, Norovirus
RMGAIASMR

SEQ ID NO: 266006 - protein, 9 aa, Norovirus
SLYWRPVYT

SEQ ID NO: 266007 - protein, 9 aa, Norovirus
SMILLAELF

SEQ ID NO: 266008 - protein, 9 aa, Norovirus
VLAFRQLAA

SEQ ID NO: 266009 - protein, 9 aa, Norovirus
GVHYSHAYK

SEQ ID NO: 266010 - protein, 9 aa, Norovirus
GVGHWDAYK

SEQ ID NO: 266011 - protein, 9 aa, Norovirus
MKMASNDAF

SEQ ID NO: 266012 - protein, 9 aa, Norovirus
VMREQLKPF

SEQ ID NO: 266013 - protein, 9 aa, Norovirus
SSMAVTFKR

SEQ ID NO: 266014 - protein, 9 aa, Norovirus
LANPAPLDY

SEQ ID NO: 266015 - protein, 9 aa, Norovirus
MIHRTTGFF

SEQ ID NO: 266016 - protein, 9 aa, Norovirus
TMDDSKLKK

SEQ ID NO: 266017 - protein, 9 aa, Norovirus
SLILLAELF

SEQ ID NO: 266018 - protein, 9 aa, Norovirus
KMLGGQMGM

SEQ ID NO: 266019 - protein, 9 aa, Norovirus
ISGRPGVGK

SEQ ID NO: 266020 - protein, 9 aa, Norovirus
LLADLFGVF

SEQ ID NO: 266021 - protein, 9 aa, Norovirus
QGRYTIEEY

SEQ ID NO: 266022 - protein, 9 aa, Norovirus
SNMAVTFKR

SEQ ID NO: 266023 - protein, 9 aa, Norovirus
LMAELFGVF

SEQ ID NO: 266024 - protein, 9 aa, Norovirus
LSTKTKFWR

SEQ ID NO: 266025 - protein, 9 aa, Norovirus
APLLGDFEL

SEQ ID NO: 266026 - protein, 9 aa, Norovirus
KLKKVANLF

SEQ ID NO: 266027 - protein, 9 aa, Norovirus
RMIQRTTDF

SEQ ID NO: 266028 - protein, 9 aa, Norovirus
YLGGRDPRV

SEQ ID NO: 266029 - protein, 9 aa, Norovirus
QYLISPDSL

SEQ ID NO: 266030 - protein, 9 aa, Norovirus
LSLYWRPVY

SEQ ID NO: 266031 - protein, 9 aa, Norovirus
ILASCDWTF

SEQ ID NO: 266032 - protein, 9 aa, Norovirus
RAARAFGPF

SEQ ID NO: 266033 - protein, 9 aa, Norovirus
ILLAELSGV

SEQ ID NO: 266034 - protein, 9 aa, Norovirus
KMASNDAFA

SEQ ID NO: 266035 - protein, 9 aa, Norovirus
SLILMAELF

SEQ ID NO: 266036 - protein, 9 aa, Norovirus
SLFWRPVYA

SEQ ID NO: 266037 - protein, 9 aa, Norovirus
YLQDRDRYY

SEQ ID NO: 266038 - protein, 9 aa, Norovirus
AARAGNTVI

SEQ ID NO: 266039 - protein, 9 aa, Norovirus
VLRDQLKPF

SEQ ID NO: 266040 - protein, 9 aa, Norovirus
ILMAELFGV

SEQ ID NO: 266041 - protein, 9 aa, Norovirus
CARSFGGLM

SEQ ID NO: 266042 - protein, 9 aa, Norovirus
LLWGSDLGT

SEQ ID NO: 266043 - protein, 9 aa, Norovirus
TTDDSKLKK

SEQ ID NO: 266044 - protein, 9 aa, Norovirus
AFDNNCYAF

SEQ ID NO: 266045 - protein, 9 aa, Norovirus
PPRPPTPEL

SEQ ID NO: 266046 - protein, 9 aa, Norovirus
RPDKSEGPI

SEQ ID NO: 266047 - protein, 9 aa, Norovirus
FGTGWGFWV

SEQ ID NO: 266048 - protein, 9 aa, Norovirus
MLSSAASTL

SEQ ID NO: 266049 - protein, 9 aa, Norovirus
KTTSSGYPH

SEQ ID NO: 266050 - protein, 9 aa, Norovirus
GLIPTRPDK

SEQ ID NO: 266051 - protein, 9 aa, Norovirus
FLCALSSLF

SEQ ID NO: 266052 - protein, 9 aa, Norovirus
LSTKTKFWK

SEQ ID NO: 266053 - protein, 9 aa, Norovirus
KMASNDASA

SEQ ID NO: 266054 - protein, 9 aa, Norovirus
GVFWTPPDV

SEQ ID NO: 266055 - protein, 9 aa, Norovirus
IFLCALSSL

SEQ ID NO: 266056 - protein, 9 aa, Norovirus
KTTSSGHPY

SEQ ID NO: 266057 - protein, 9 aa, Norovirus
LVAMLYTPL

SEQ ID NO: 266058 - protein, 9 aa, Norovirus
TLNCDRIEK

SEQ ID NO: 266059 - protein, 9 aa, Norovirus
FSFYGDDYI

SEQ ID NO: 266060 - protein, 9 aa, Norovirus
RMGTHATMK

SEQ ID NO: 266061 - protein, 9 aa, Norovirus
MMKNAVDGL

SEQ ID NO: 266062 - protein, 9 aa, Norovirus
QASKANLMY

SEQ ID NO: 266063 - protein, 9 aa, Norovirus
LLAALFGVF

SEQ ID NO: 266064 - protein, 9 aa, Norovirus
ESRRLFAFL

SEQ ID NO: 266065 - protein, 9 aa, Norovirus
VARATEENF

SEQ ID NO: 266066 - protein, 9 aa, Norovirus
RPLNILNIL

SEQ ID NO: 266067 - protein, 9 aa, Norovirus
WGFWVSPTV

SEQ ID NO: 266068 - protein, 9 aa, Norovirus
RPVYTPQYL

SEQ ID NO: 266069 - protein, 9 aa, Norovirus
ILLAELFDV

SEQ ID NO: 266070 - protein, 9 aa, Norovirus
RPVYAPQYL

SEQ ID NO: 266071 - protein, 9 aa, Norovirus
MAVTFKRAL

SEQ ID NO: 266072 - protein, 9 aa, Norovirus
KLKKVANVF

SEQ ID NO: 266073 - protein, 9 aa, Norovirus
LVLGFTKEK

SEQ ID NO: 266074 - protein, 9 aa, Norovirus
KLHGESFPY

SEQ ID NO: 266075 - protein, 9 aa, Norovirus
KLHGEAFPY

SEQ ID NO: 266076 - protein, 9 aa, Norovirus
RMGAVASMK

SEQ ID NO: 266077 - protein, 9 aa, Norovirus
AARGGNTVI

SEQ ID NO: 266078 - protein, 9 aa, Norovirus
LLAYLYTPL

SEQ ID NO: 266079 - protein, 9 aa, Norovirus
ISGRPGIGK

SEQ ID NO: 266080 - protein, 9 aa, Norovirus
RTTGFFRPY

SEQ ID NO: 266081 - protein, 9 aa, Norovirus
AALKDELVK

SEQ ID NO: 266082 - protein, 9 aa, Norovirus
AGNALTAGK

SEQ ID NO: 266083 - protein, 9 aa, Norovirus
SLFWRPVYT

SEQ ID NO: 266084 - protein, 9 aa, Norovirus
LIAMLYTPL

SEQ ID NO: 266085 - protein, 9 aa, Norovirus
RMGTHASMK

SEQ ID NO: 266086 - protein, 9 aa, Norovirus
WAFWVSPSL

SEQ ID NO: 266087 - protein, 9 aa, Norovirus
KLKKAANIF

SEQ ID NO: 266088 - protein, 9 aa, Norovirus
ILAFRQLAA

SEQ ID NO: 266089 - protein, 9 aa, Norovirus
DLIGKLRPL

SEQ ID NO: 266090 - protein, 9 aa, Norovirus
YLGGKDPRV

SEQ ID NO: 266091 - protein, 9 aa, Norovirus
IAMLYTPLR

SEQ ID NO: 266092 - protein, 9 aa, Norovirus
CALSSLFTR

SEQ ID NO: 266093 - protein, 9 aa, Norovirus
FGSGWGFWV

SEQ ID NO: 266094 - protein, 9 aa, Norovirus
LSSKTKFWR

SEQ ID NO: 266095 - protein, 9 aa, Norovirus
AGNAFAAGK

SEQ ID NO: 266096 - protein, 9 aa, Norovirus
CARAFGGLL

SEQ ID NO: 266097 - protein, 9 aa, Norovirus
GVDHWDAYK

SEQ ID NO: 266098 - protein, 9 aa, Norovirus
SNMAVTLKR

SEQ ID NO: 266099 - protein, 9 aa, Norovirus
KLIAMLYTP

SEQ ID NO: 266100 - protein, 9 aa, Norovirus
ILLAELFGV

SEQ ID NO: 266101 - protein, 9 aa, Norovirus
MIAPLLGDF

SEQ ID NO: 266102 - protein, 9 aa, Norovirus
FLCTLSSLF

SEQ ID NO: 266103 - protein, 8 aa, Influenza virus
KQGKTKAT

SEQ ID NO: 266104 - protein, 8 aa, Influenza virus
QGKTKATK

SEQ ID NO: 266105 - protein, 8 aa, Influenza virus
SKSRGYKM

SEQ ID NO: 266106 - protein, 8 aa, Influenza virus
IFIFILLT

SEQ ID NO: 266107 - protein, 8 aa, Influenza virus
FIFILLTH

SEQ ID NO: 266108 - protein, 8 aa, Influenza virus
RFSYVFCL

SEQ ID NO: 266109 - protein, 8 aa, Influenza virus
SQITNGTT

SEQ ID NO: 266110 - protein, 8 aa, Influenza virus
QITNGTTG

SEQ ID NO: 266111 - protein, 8 aa, Influenza virus
ITNGTTGN

SEQ ID NO: 266112 - protein, 8 aa, Influenza virus
TNGTTGNP

SEQ ID NO: 266113 - protein, 8 aa, Influenza virus
NGTTGNPI

SEQ ID NO: 266114 - protein, 8 aa, Influenza virus
GTTGNPII

SEQ ID NO: 266115 - protein, 8 aa, Influenza virus
TTGNPIIC

SEQ ID NO: 266116 - protein, 8 aa, Influenza virus
NNNNNTAT

SEQ ID NO: 266117 - protein, 8 aa, Influenza virus
NNSTATLC

SEQ ID NO: 266118 - protein, 8 aa, Influenza virus
GVIPLTTT

SEQ ID NO: 266119 - protein, 8 aa, Influenza virus
VIPLTTTP

SEQ ID NO: 266120 - protein, 8 aa, Influenza virus
IPLTTTPT

SEQ ID NO: 266121 - protein, 8 aa, Influenza virus
PLTTTPTK

SEQ ID NO: 266122 - protein, 8 aa, Influenza virus
LTTTPTKS

SEQ ID NO: 266123 - protein, 8 aa, Influenza virus
TTTPTKSY

SEQ ID NO: 266124 - protein, 8 aa, Influenza virus
TTPTKSYF

SEQ ID NO: 266125 - protein, 8 aa, Influenza virus
TPTKSYFA

SEQ ID NO: 266126 - protein, 8 aa, Influenza virus
PTKSYFAN

SEQ ID NO: 266127 - protein, 8 aa, Influenza virus
TKSYFANL

SEQ ID NO: 266128 - protein, 8 aa, Influenza virus
KSYFANLK

SEQ ID NO: 266129 - protein, 8 aa, Influenza virus
SYFANLKG

SEQ ID NO: 266130 - protein, 8 aa, Influenza virus
IMHDRTKI

SEQ ID NO: 266131 - protein, 8 aa, Influenza virus
MHDRTKIR

SEQ ID NO: 266132 - protein, 8 aa, Influenza virus
EKENSYPM

SEQ ID NO: 266133 - protein, 8 aa, Influenza virus
LTVEVPYV

SEQ ID NO: 266134 - protein, 8 aa, Influenza virus
GVTTHYVS

SEQ ID NO: 266135 - protein, 8 aa, Influenza virus
DEGLPQSG

SEQ ID NO: 266136 - protein, 8 aa, Influenza virus
EGLPQSGR

SEQ ID NO: 266137 - protein, 8 aa, Influenza virus
GLPQSGRI

SEQ ID NO: 266138 - protein, 8 aa, Influenza virus
LPQSGRIV

SEQ ID NO: 266139 - protein, 8 aa, Influenza virus
PQSGRIVV

SEQ ID NO: 266140 - protein, 8 aa, Influenza virus
APSGIEYN

SEQ ID NO: 266141 - protein, 8 aa, Influenza virus
SGIEYNGK

SEQ ID NO: 266142 - protein, 8 aa, Influenza virus
GIEYNGKS

SEQ ID NO: 266143 - protein, 8 aa, Influenza virus
IEYNGKSL

SEQ ID NO: 266144 - protein, 8 aa, Influenza virus
EYNGKSLG

SEQ ID NO: 266145 - protein, 8 aa, Influenza virus
YNGKSLGI

SEQ ID NO: 266146 - protein, 8 aa, Influenza virus
NGKSLGIQ

SEQ ID NO: 266147 - protein, 8 aa, Influenza virus
EDIPIGNC

SEQ ID NO: 266148 - protein, 8 aa, Influenza virus
PSVKLPMG

SEQ ID NO: 266149 - protein, 8 aa, Influenza virus
GAIGAIDS

SEQ ID NO: 266150 - protein, 8 aa, Influenza virus
AIGAIDSS

SEQ ID NO: 266151 - protein, 8 aa, Influenza virus
IGAIDSSM

SEQ ID NO: 266152 - protein, 8 aa, Influenza virus
TSLTSLPF

SEQ ID NO: 266153 - protein, 8 aa, Influenza virus
SLTSLPFQ

SEQ ID NO: 266154 - protein, 8 aa, Influenza virus
LTSLPFQN

SEQ ID NO: 266155 - protein, 8 aa, Influenza virus
GEHAKAIG

SEQ ID NO: 266156 - protein, 8 aa, Influenza virus
IPIGERGL

SEQ ID NO: 266157 - protein, 8 aa, Influenza virus
REREGGRR

SEQ ID NO: 266158 - protein, 8 aa, Influenza virus
EREGGRRR

SEQ ID NO: 266159 - protein, 8 aa, Influenza virus
RRKKRGLF

SEQ ID NO: 266160 - protein, 8 aa, Influenza virus
KKKRGLFG

SEQ ID NO: 266161 - protein, 8 aa, Influenza virus
KKRGLFGA

SEQ ID NO: 266162 - protein, 8 aa, Influenza virus
TRRQKRGL

SEQ ID NO: 266163 - protein, 8 aa, Influenza virus
RRKKRGLF

SEQ ID NO: 266164 - protein, 8 aa, Influenza virus
RQKRGLFG

SEQ ID NO: 266165 - protein, 8 aa, Influenza virus
KKRGLFGA

SEQ ID NO: 266166 - protein, 8 aa, Influenza virus
THKQLTHH

SEQ ID NO: 266167 - protein, 8 aa, Influenza virus
HKQLTHHM

SEQ ID NO: 266168 - protein, 8 aa, Influenza virus
KQLTHHMR

SEQ ID NO: 266169 - protein, 8 aa, Influenza virus
QLTHHMRK

SEQ ID NO: 266170 - protein, 8 aa, Influenza virus
LTHHMRKK

SEQ ID NO: 266171 - protein, 8 aa, Influenza virus
THHMRKKR

SEQ ID NO: 266172 - protein, 8 aa, Influenza virus
HHMRKKRG

SEQ ID NO: 266173 - protein, 8 aa, Influenza virus
HMRKKRGL

SEQ ID NO: 266174 - protein, 8 aa, Influenza virus
MRKKRGLF

SEQ ID NO: 266175 - protein, 8 aa, Influenza virus
RKKRGLFG

SEQ ID NO: 266176 - protein, 8 aa, Influenza virus
RMTRGLFG

SEQ ID NO: 266177 - protein, 8 aa, Influenza virus
MTRGLFGA

SEQ ID NO: 266178 - protein, 8 aa, Influenza virus
PRGLFGAI

SEQ ID NO: 266179 - protein, 8 aa, Influenza virus
TKPRPRRG

SEQ ID NO: 266180 - protein, 8 aa, Influenza virus
KPRPRRGL

SEQ ID NO: 266181 - protein, 8 aa, Influenza virus
PRPRRGLF

SEQ ID NO: 266182 - protein, 8 aa, Influenza virus
RPRRGLFG

SEQ ID NO: 266183 - protein, 8 aa, Influenza virus
PRRGLFGA

SEQ ID NO: 266184 - protein, 8 aa, Influenza virus
RRGLFGAI

SEQ ID NO: 266185 - protein, 8 aa, Influenza virus
RGLFGAIA

SEQ ID NO: 266186 - protein, 8 aa, Influenza virus
GLFGAIAG

SEQ ID NO: 266187 - protein, 8 aa, Influenza virus
LFGAIAGF

SEQ ID NO: 266188 - protein, 8 aa, Influenza virus
FGAIAGFI

SEQ ID NO: 266189 - protein, 8 aa, Influenza virus
GAIAGFIE

SEQ ID NO: 266190 - protein, 8 aa, Influenza virus
AIAGFIEG

SEQ ID NO: 266191 - protein, 8 aa, Influenza virus
IAGFIEGG

SEQ ID NO: 266192 - protein, 8 aa, Influenza virus
AGFIEGGW

SEQ ID NO: 266193 - protein, 8 aa, Influenza virus
GRLVRFRH

SEQ ID NO: 266194 - protein, 8 aa, Influenza virus
RLVRFRHQ

SEQ ID NO: 266195 - protein, 8 aa, Influenza virus
LPTFDSLN

SEQ ID NO: 266196 - protein, 8 aa, Influenza virus
PTFDSLNI

SEQ ID NO: 266197 - protein, 8 aa, Influenza virus
TFDSLNIT

SEQ ID NO: 266198 - protein, 8 aa, Influenza virus
FDSLNITA

SEQ ID NO: 266199 - protein, 8 aa, Influenza virus
DSLNITAA

SEQ ID NO: 266200 - protein, 8 aa, Influenza virus
SLNITAAS

SEQ ID NO: 266201 - protein, 8 aa, Influenza virus
LNITAASL

SEQ ID NO: 266202 - protein, 8 aa, Influenza virus
NITAASLN

SEQ ID NO: 266203 - protein, 8 aa, Influenza virus
ITAASLND

SEQ ID NO: 266204 - protein, 8 aa, Influenza virus
VTTRQASP

SEQ ID NO: 266205 - protein, 8 aa, Influenza virus
TTRQASPS

SEQ ID NO: 266206 - protein, 8 aa, Influenza virus
TRQASPSC

SEQ ID NO: 266207 - protein, 8 aa, Influenza virus
RQASPSCL

SEQ ID NO: 266208 - protein, 8 aa, Influenza virus
QASPSCLV

SEQ ID NO: 266209 - protein, 8 aa, Influenza virus
ASPSCLVV

SEQ ID NO: 266210 - protein, 8 aa, Influenza virus
EFPSTGNH

SEQ ID NO: 266211 - protein, 8 aa, Influenza virus
FPSTGNHG

SEQ ID NO: 266212 - protein, 8 aa, Influenza virus
PSTGNHGS

SEQ ID NO: 266213 - protein, 8 aa, Influenza virus
STGNHGSL

SEQ ID NO: 266214 - protein, 8 aa, Influenza virus
TGNHGSLV

SEQ ID NO: 266215 - protein, 8 aa, Influenza virus
GNHGSLVL

SEQ ID NO: 266216 - protein, 8 aa, Influenza virus
NHGSLVLS

SEQ ID NO: 266217 - protein, 8 aa, Influenza virus
LCSVEYAS

SEQ ID NO: 266218 - protein, 8 aa, Influenza virus
CSVEYASK

SEQ ID NO: 266219 - protein, 8 aa, Influenza virus
SVEYASKT

SEQ ID NO: 266220 - protein, 8 aa, Influenza virus
VEYASKTR

SEQ ID NO: 266221 - protein, 8 aa, Influenza virus
EYASKTRI

SEQ ID NO: 266222 - protein, 8 aa, Influenza virus
YASKTRIS

SEQ ID NO: 266223 - protein, 8 aa, Influenza virus
KFVSSDCS

SEQ ID NO: 266224 - protein, 8 aa, Influenza virus
FRDMRKNT

SEQ ID NO: 266225 - protein, 8 aa, Influenza virus
RDMRKNTL

SEQ ID NO: 266226 - protein, 8 aa, Influenza virus
IGLREQKQ

SEQ ID NO: 266227 - protein, 8 aa, Influenza virus
GLREQKQE

SEQ ID NO: 266228 - protein, 8 aa, Influenza virus
LREQKQEF

SEQ ID NO: 266229 - protein, 8 aa, Influenza virus
REQKQEFK

SEQ ID NO: 266230 - protein, 8 aa, Influenza virus
EQKQEFKM

SEQ ID NO: 266231 - protein, 8 aa, Influenza virus
QKQEFKMN

SEQ ID NO: 266232 - protein, 8 aa, Influenza virus
KQEFKMNP

SEQ ID NO: 266233 - protein, 8 aa, Influenza virus
QEFKMNPN

SEQ ID NO: 266234 - protein, 8 aa, Influenza virus
EFKMNPNK

SEQ ID NO: 266235 - protein, 8 aa, Influenza virus
FKMNPNKK

SEQ ID NO: 266236 - protein, 8 aa, Influenza virus
KMNPNKKI

SEQ ID NO: 266237 - protein, 8 aa, Influenza virus
IIIAIGSV

SEQ ID NO: 266238 - protein, 8 aa, Influenza virus
NRDITIGS

SEQ ID NO: 266239 - protein, 8 aa, Influenza virus
RDITIGSI

SEQ ID NO: 266240 - protein, 8 aa, Influenza virus
DITIGSIC

SEQ ID NO: 266241 - protein, 8 aa, Influenza virus
VPLVPCEP

SEQ ID NO: 266242 - protein, 8 aa, Influenza virus
PLVPCEPI

SEQ ID NO: 266243 - protein, 8 aa, Influenza virus
LVPCEPII

SEQ ID NO: 266244 - protein, 8 aa, Influenza virus
ILRTQESE

SEQ ID NO: 266245 - protein, 8 aa, Influenza virus
LRTQESEC

SEQ ID NO: 266246 - protein, 8 aa, Influenza virus
RTQESECV

SEQ ID NO: 266247 - protein, 8 aa, Influenza virus
TQESECVC

SEQ ID NO: 266248 - protein, 8 aa, Influenza virus
IRKGLILE

SEQ ID NO: 266249 - protein, 8 aa, Influenza virus
VMGQASYK

SEQ ID NO: 266250 - protein, 8 aa, Influenza virus
YKYKIFKN

SEQ ID NO: 266251 - protein, 8 aa, Influenza virus
KYKIFKNG

SEQ ID NO: 266252 - protein, 8 aa, Influenza virus
GKKGKWLN

SEQ ID NO: 266253 - protein, 8 aa, Influenza virus
IQHLEECS

SEQ ID NO: 266254 - protein, 8 aa, Influenza virus
HYEECSCY

SEQ ID NO: 266255 - protein, 8 aa, Influenza virus
YEECSCYP

SEQ ID NO: 266256 - protein, 8 aa, Influenza virus
SYPNVRCV

SEQ ID NO: 266257 - protein, 8 aa, Influenza virus
KLDINMAD

SEQ ID NO: 266258 - protein, 8 aa, Influenza virus
NNYGVKGF

SEQ ID NO: 266259 - protein, 8 aa, Influenza virus
NYGVKGFG

SEQ ID NO: 266260 - protein, 8 aa, Influenza virus
IFLWCKIV

SEQ ID NO: 266261 - protein, 8 aa, Influenza virus
FLWCKIVT

SEQ ID NO: 266262 - protein, 8 aa, Influenza virus
LWCKIVTT

SEQ ID NO: 266263 - protein, 8 aa, Influenza virus
WCKIVTTV

SEQ ID NO: 266264 - protein, 8 aa, Influenza virus
CKIVTTVG

SEQ ID NO: 266265 - protein, 8 aa, Influenza virus
KIVTTVGW

SEQ ID NO: 266266 - protein, 8 aa, Influenza virus
IVTTVGWS

SEQ ID NO: 266267 - protein, 8 aa, Influenza virus
VTTVGWSW

SEQ ID NO: 266268 - protein, 8 aa, Influenza virus
TTVGWSWP

SEQ ID NO: 266269 - protein, 8 aa, Influenza virus
RTSISCLY

SEQ ID NO: 266270 - protein, 8 aa, Influenza virus
HAYISFRN

SEQ ID NO: 266271 - protein, 8 aa, Influenza virus
AYISFRNL

SEQ ID NO: 266272 - protein, 8 aa, Influenza virus
IGLREQKQ

SEQ ID NO: 266273 - protein, 8 aa, Influenza virus
GLREQKQE

SEQ ID NO: 266274 - protein, 8 aa, Influenza virus
LREQKQEF

SEQ ID NO: 266275 - protein, 8 aa, Influenza virus
REQKQEFK

SEQ ID NO: 266276 - protein, 8 aa, Influenza virus
EQKQEFKM

SEQ ID NO: 266277 - protein, 8 aa, Influenza virus
QKQEFKMN

SEQ ID NO: 266278 - protein, 8 aa, Influenza virus
KQEFKMNP

SEQ ID NO: 266279 - protein, 8 aa, Influenza virus
QEFKMNPN

SEQ ID NO: 266280 - protein, 8 aa, Influenza virus
EFKMNPNK

SEQ ID NO: 266281 - protein, 8 aa, Influenza virus
FKMNPNKK

SEQ ID NO: 266282 - protein, 8 aa, Influenza virus
KMNPNKKI

SEQ ID NO: 266283 - protein, 8 aa, Influenza virus
NRDITIGS

SEQ ID NO: 266284 - protein, 8 aa, Influenza virus
RDITIGSI

SEQ ID NO: 266285 - protein, 8 aa, Influenza virus
DITIGSIC

SEQ ID NO: 266286 - protein, 8 aa, Influenza virus
ASQYGPSH

SEQ ID NO: 266287 - protein, 8 aa, Influenza virus
GWAIYSKD

SEQ ID NO: 266288 - protein, 8 aa, Influenza virus
WAIYSKDN

SEQ ID NO: 266289 - protein, 8 aa, Influenza virus
SKDNSIRI

SEQ ID NO: 266290 - protein, 8 aa, Influenza virus
KDNSIRIG

SEQ ID NO: 266291 - protein, 8 aa, Influenza virus
DNSIRIGS

SEQ ID NO: 266292 - protein, 8 aa, Influenza virus
NSIRIGSK

SEQ ID NO: 266293 - protein, 8 aa, Influenza virus
SIRIGSKG

SEQ ID NO: 266294 - protein, 8 aa, Influenza virus
IRIGSKGD

SEQ ID NO: 266295 - protein, 8 aa, Influenza virus
RIGSKGDV

SEQ ID NO: 266296 - protein, 8 aa, Influenza virus
IGSKGDVF

SEQ ID NO: 266297 - protein, 8 aa, Influenza virus
GSKGDVFV

SEQ ID NO: 266298 - protein, 8 aa, Influenza virus
GDVFVIRE

SEQ ID NO: 266299 - protein, 8 aa, Influenza virus
DVFVIREP

SEQ ID NO: 266300 - protein, 8 aa, Influenza virus
VFVIREPF

SEQ ID NO: 266301 - protein, 8 aa, Influenza virus
FVIREPFI

SEQ ID NO: 266302 - protein, 8 aa, Influenza virus
VIREPFIS

SEQ ID NO: 266303 - protein, 8 aa, Influenza virus
IREPFISC

SEQ ID NO: 266304 - protein, 8 aa, Influenza virus
REPFISCS

SEQ ID NO: 266305 - protein, 8 aa, Influenza virus
EPFISCSH

SEQ ID NO: 266306 - protein, 8 aa, Influenza virus
LECRTFFL

SEQ ID NO: 266307 - protein, 8 aa, Influenza virus
ECRTFFLT

SEQ ID NO: 266308 - protein, 8 aa, Influenza virus
CRTFFLTQ

SEQ ID NO: 266309 - protein, 8 aa, Influenza virus
RTFFLTQG

SEQ ID NO: 266310 - protein, 8 aa, Influenza virus
TFFLTQGA

SEQ ID NO: 266311 - protein, 8 aa, Influenza virus
FFLTQGAL

SEQ ID NO: 266312 - protein, 8 aa, Influenza virus
FLTQGALL

SEQ ID NO: 266313 - protein, 8 aa, Influenza virus
LTQGALLN

SEQ ID NO: 266314 - protein, 8 aa, Influenza virus
TQGALLND

SEQ ID NO: 266315 - protein, 8 aa, Influenza virus
QGALLNDK

SEQ ID NO: 266316 - protein, 8 aa, Influenza virus
GALLNDKH

SEQ ID NO: 266317 - protein, 8 aa, Influenza virus
ALLNDKHS

SEQ ID NO: 266318 - protein, 8 aa, Influenza virus
LLNDKHSN

SEQ ID NO: 266319 - protein, 8 aa, Influenza virus
LNDKHSNG

SEQ ID NO: 266320 - protein, 8 aa, Influenza virus
NDKHSNGT

SEQ ID NO: 266321 - protein, 8 aa, Influenza virus
DKHSNGTI

SEQ ID NO: 266322 - protein, 8 aa, Influenza virus
DRSPYRTL

SEQ ID NO: 266323 - protein, 8 aa, Influenza virus
RSPYRTLM

SEQ ID NO: 266324 - protein, 8 aa, Influenza virus
SPYRTLMS

SEQ ID NO: 266325 - protein, 8 aa, Influenza virus
PYRTLMSC

SEQ ID NO: 266326 - protein, 8 aa, Influenza virus
YRTLMSCP

SEQ ID NO: 266327 - protein, 8 aa, Influenza virus
RTLMSCPI

SEQ ID NO: 266328 - protein, 8 aa, Influenza virus
TLMSCPIG

SEQ ID NO: 266329 - protein, 8 aa, Influenza virus
LMSCPIGE

SEQ ID NO: 266330 - protein, 8 aa, Influenza virus
SCPIGEVP

SEQ ID NO: 266331 - protein, 8 aa, Influenza virus
PIGEVPSP

SEQ ID NO: 266332 - protein, 8 aa, Influenza virus
IGEVPSPY

SEQ ID NO: 266333 - protein, 8 aa, Influenza virus
GEAPSPYN

SEQ ID NO: 266334 - protein, 8 aa, Influenza virus
EAPSPYNS

SEQ ID NO: 266335 - protein, 8 aa, Influenza virus
VPSPYNSR

SEQ ID NO: 266336 - protein, 8 aa, Influenza virus
PSPYNSRF

SEQ ID NO: 266337 - protein, 8 aa, Influenza virus
SPYNSRFE

SEQ ID NO: 266338 - protein, 8 aa, Influenza virus
PYNSRFES

SEQ ID NO: 266339 - protein, 8 aa, Influenza virus
YNSRFESV

SEQ ID NO: 266340 - protein, 8 aa, Influenza virus
NSRFESVA

SEQ ID NO: 266341 - protein, 8 aa, Influenza virus
SRFESVAW

SEQ ID NO: 266342 - protein, 8 aa, Influenza virus
RFESVAWS

SEQ ID NO: 266343 - protein, 8 aa, Influenza virus
FESVAWSA

SEQ ID NO: 266344 - protein, 8 aa, Influenza virus
ESVAWSAS

SEQ ID NO: 266345 - protein, 8 aa, Influenza virus
SVAWSASA

SEQ ID NO: 266346 - protein, 8 aa, Influenza virus
VAWSASAC

SEQ ID NO: 266347 - protein, 8 aa, Influenza virus
AWSASACH

SEQ ID NO: 266348 - protein, 8 aa, Influenza virus
WSASACHD

SEQ ID NO: 266349 - protein, 8 aa, Influenza virus
SASACHDG

SEQ ID NO: 266350 - protein, 8 aa, Influenza virus
ASACHDGI

SEQ ID NO: 266351 - protein, 8 aa, Influenza virus
NWLTIGIS

SEQ ID NO: 266352 - protein, 8 aa, Influenza virus
WLTIGISG

SEQ ID NO: 266353 - protein, 8 aa, Influenza virus
LTIGISGP

SEQ ID NO: 266354 - protein, 8 aa, Influenza virus
TIGISGPD

SEQ ID NO: 266355 - protein, 8 aa, Influenza virus
IGISGPDN

SEQ ID NO: 266356 - protein, 8 aa, Influenza virus
GISGPDNG

SEQ ID NO: 266357 - protein, 8 aa, Influenza virus
ISGPDNGA

SEQ ID NO: 266358 - protein, 8 aa, Influenza virus
SGPDNGAV

SEQ ID NO: 266359 - protein, 8 aa, Influenza virus
GPDNGAVA

SEQ ID NO: 266360 - protein, 8 aa, Influenza virus
PDNGAVAV

SEQ ID NO: 266361 - protein, 8 aa, Influenza virus
DNGAVAVL

SEQ ID NO: 266362 - protein, 8 aa, Influenza virus
NGAVAVLK

SEQ ID NO: 266363 - protein, 8 aa, Influenza virus
GAVAVLKY

SEQ ID NO: 266364 - protein, 8 aa, Influenza virus
AVAVLKYN

SEQ ID NO: 266365 - protein, 8 aa, Influenza virus
VAVLKYNG

SEQ ID NO: 266366 - protein, 8 aa, Influenza virus
AVLKYNGI

SEQ ID NO: 266367 - protein, 8 aa, Influenza virus
VLKYNGII

SEQ ID NO: 266368 - protein, 8 aa, Influenza virus
LKYNGIIT

SEQ ID NO: 266369 - protein, 8 aa, Influenza virus
ITDTIKSW

SEQ ID NO: 266370 - protein, 8 aa, Influenza virus
ILRTQESE

SEQ ID NO: 266371 - protein, 8 aa, Influenza virus
LRTQESEC

SEQ ID NO: 266372 - protein, 8 aa, Influenza virus
RTQESECA

SEQ ID NO: 266373 - protein, 8 aa, Influenza virus
TQESECAC

SEQ ID NO: 266374 - protein, 8 aa, Influenza virus
CVNGSCFT

SEQ ID NO: 266375 - protein, 8 aa, Influenza virus
NGSCFTVM

SEQ ID NO: 266376 - protein, 8 aa, Influenza virus
GSCFTVMT

SEQ ID NO: 266377 - protein, 8 aa, Influenza virus
SCFTVMTD

SEQ ID NO: 266378 - protein, 8 aa, Influenza virus
CFTVMTDG

SEQ ID NO: 266379 - protein, 8 aa, Influenza virus
FTVMTDGP

SEQ ID NO: 266380 - protein, 8 aa, Influenza virus
TVMTDGPS

SEQ ID NO: 266381 - protein, 8 aa, Influenza virus
VMGQASYK

SEQ ID NO: 266382 - protein, 8 aa, Influenza virus
YKYKIFKN

SEQ ID NO: 266383 - protein, 8 aa, Influenza virus
KYKIFKNG

SEQ ID NO: 266384 - protein, 8 aa, Influenza virus
GKKGKWLN

SEQ ID NO: 266385 - protein, 8 aa, Influenza virus
APNYHYEE

SEQ ID NO: 266386 - protein, 8 aa, Influenza virus
PNYHYEEC

SEQ ID NO: 266387 - protein, 8 aa, Influenza virus
NYHYEECS

SEQ ID NO: 266388 - protein, 8 aa, Influenza virus
YHYEECSC

SEQ ID NO: 266389 - protein, 8 aa, Influenza virus
HYEECSCY

SEQ ID NO: 266390 - protein, 8 aa, Influenza virus
YEECSCYP

SEQ ID NO: 266391 - protein, 8 aa, Influenza virus
EECSCYPD

SEQ ID NO: 266392 - protein, 8 aa, Influenza virus
ECSCYPDS

SEQ ID NO: 266393 - protein, 8 aa, Influenza virus
TCVCRDNW

SEQ ID NO: 266394 - protein, 8 aa, Influenza virus
CVCRDNWH

SEQ ID NO: 266395 - protein, 8 aa, Influenza virus
VCRDNWHG

SEQ ID NO: 266396 - protein, 8 aa, Influenza virus
CRDNWHGS

SEQ ID NO: 266397 - protein, 8 aa, Influenza virus
RDNWHGSN

SEQ ID NO: 266398 - protein, 8 aa, Influenza virus
DNWHGSNR

SEQ ID NO: 266399 - protein, 8 aa, Influenza virus
NWHGSNRP

SEQ ID NO: 266400 - protein, 8 aa, Influenza virus
WHGSNRPW

SEQ ID NO: 266401 - protein, 8 aa, Influenza virus
HGSNRPWV

SEQ ID NO: 266402 - protein, 8 aa, Influenza virus
GSNRPWVS

SEQ ID NO: 266403 - protein, 8 aa, Influenza virus
SNRPWVSF

SEQ ID NO: 266404 - protein, 8 aa, Influenza virus
NRPWVSFN

SEQ ID NO: 266405 - protein, 8 aa, Influenza virus
RPWVSFNQ

SEQ ID NO: 266406 - protein, 8 aa, Influenza virus
YQIGYICS

SEQ ID NO: 266407 - protein, 8 aa, Influenza virus
QIGYICSG

SEQ ID NO: 266408 - protein, 8 aa, Influenza virus
IGYICSGV

SEQ ID NO: 266409 - protein, 8 aa, Influenza virus
GYICSGVF

SEQ ID NO: 266410 - protein, 8 aa, Influenza virus
YICSGVFG

SEQ ID NO: 266411 - protein, 8 aa, Influenza virus
ICSGVFGD

SEQ ID NO: 266412 - protein, 8 aa, Influenza virus
CSGVFGDN

SEQ ID NO: 266413 - protein, 8 aa, Influenza virus
SGVFGDNP

SEQ ID NO: 266414 - protein, 8 aa, Influenza virus
GVFGDNPR

SEQ ID NO: 266415 - protein, 8 aa, Influenza virus
IFGDNPRP

SEQ ID NO: 266416 - protein, 8 aa, Influenza virus
GVKGFSFK

SEQ ID NO: 266417 - protein, 8 aa, Influenza virus
VKGFSFKY

SEQ ID NO: 266418 - protein, 8 aa, Influenza virus
KGFSFKYG

SEQ ID NO: 266419 - protein, 8 aa, Influenza virus
KYGNGVWI

SEQ ID NO: 266420 - protein, 8 aa, Influenza virus
YGNGVWIG

SEQ ID NO: 266421 - protein, 8 aa, Influenza virus
GNGVWIGR

SEQ ID NO: 266422 - protein, 8 aa, Influenza virus
NGVWIGRT

SEQ ID NO: 266423 - protein, 8 aa, Influenza virus
GVWIGRTK

SEQ ID NO: 266424 - protein, 8 aa, Influenza virus
VWIGRTKS

SEQ ID NO: 266425 - protein, 8 aa, Influenza virus
GFEMIWDP

SEQ ID NO: 266426 - protein, 8 aa, Influenza virus
FEMIWDPN

SEQ ID NO: 266427 - protein, 8 aa, Influenza virus
EMIWDPNG

SEQ ID NO: 266428 - protein, 8 aa, Influenza virus
MIWDPNGW

SEQ ID NO: 266429 - protein, 8 aa, Influenza virus
IWDPNGWT

SEQ ID NO: 266430 - protein, 8 aa, Influenza virus
TDWSGYSG

SEQ ID NO: 266431 - protein, 8 aa, Influenza virus
DWSGYSGS

SEQ ID NO: 266432 - protein, 8 aa, Influenza virus
WSGYSGSF

SEQ ID NO: 266433 - protein, 8 aa, Influenza virus
SGYSGSFV

SEQ ID NO: 266434 - protein, 8 aa, Influenza virus
GYSGSFVQ

SEQ ID NO: 266435 - protein, 8 aa, Influenza virus
YSGSFVQH

SEQ ID NO: 266436 - protein, 8 aa, Influenza virus
SGSFVQHP

SEQ ID NO: 266437 - protein, 8 aa, Influenza virus
GSFVQHPE

SEQ ID NO: 266438 - protein, 8 aa, Influenza virus
SFVQHPEL

SEQ ID NO: 266439 - protein, 8 aa, Influenza virus
FVQHPELT

SEQ ID NO: 266440 - protein, 8 aa, Influenza virus
VQHPELTG

SEQ ID NO: 266441 - protein, 8 aa, Influenza virus
QHPELTGL

SEQ ID NO: 266442 - protein, 8 aa, Influenza virus
HPELTGLD

SEQ ID NO: 266443 - protein, 8 aa, Influenza virus
PELTGLDC

SEQ ID NO: 266444 - protein, 8 aa, Influenza virus
DCIRPCFW

SEQ ID NO: 266445 - protein, 8 aa, Influenza virus
CIRPCFWV

SEQ ID NO: 266446 - protein, 8 aa, Influenza virus
IRPCFWVE

SEQ ID NO: 266447 - protein, 8 aa, Influenza virus
RPCFWVEL

SEQ ID NO: 266448 - protein, 8 aa, Influenza virus
PCFWVELI

SEQ ID NO: 266449 - protein, 8 aa, Influenza virus
CFWVELIR

SEQ ID NO: 266450 - protein, 8 aa, Influenza virus
FWVELIRG

SEQ ID NO: 266451 - protein, 8 aa, Influenza virus
WVELIRGR

SEQ ID NO: 266452 - protein, 8 aa, Influenza virus
VELIRGRP

SEQ ID NO: 266453 - protein, 8 aa, Influenza virus
TTIWTSGS

SEQ ID NO: 266454 - protein, 8 aa, Influenza virus
TIWTSGSS

SEQ ID NO: 266455 - protein, 8 aa, Influenza virus
IWTSGSSI

SEQ ID NO: 266456 - protein, 8 aa, Influenza virus
WTSGSSIS

SEQ ID NO: 266457 - protein, 8 aa, Influenza virus
TSGSSISF

SEQ ID NO: 266458 - protein, 8 aa, Influenza virus
SGSSISFC

SEQ ID NO: 266459 - protein, 8 aa, Influenza virus
GSSISFCG

SEQ ID NO: 266460 - protein, 8 aa, Influenza virus
SSISFCGV

SEQ ID NO: 266461 - protein, 8 aa, Influenza virus
SISFCGVN

SEQ ID NO: 266462 - protein, 8 aa, Influenza virus
IFLWCKIV

SEQ ID NO: 266463 - protein, 8 aa, Influenza virus
FLWCKIVT

SEQ ID NO: 266464 - protein, 8 aa, Influenza virus
LWCKIVTT

SEQ ID NO: 266465 - protein, 8 aa, Influenza virus
WCKIVTTV

SEQ ID NO: 266466 - protein, 8 aa, Influenza virus
CKIVTTVG

SEQ ID NO: 266467 - protein, 8 aa, Influenza virus
KIVTTVGW

SEQ ID NO: 266468 - protein, 8 aa, Influenza virus
IVTTVGWS

SEQ ID NO: 266469 - protein, 8 aa, Influenza virus
VTTVGWSW

SEQ ID NO: 266470 - protein, 8 aa, Influenza virus
TTVGWSWP

SEQ ID NO: 266471 - protein, 8 aa, Influenza virus
GWSWPDGA

SEQ ID NO: 266472 - protein, 8 aa, Influenza virus
WSWPDGAE

SEQ ID NO: 266473 - protein, 8 aa, Influenza virus
SWPDGAEL

SEQ ID NO: 266474 - protein, 8 aa, Influenza virus
WPDGAELP

SEQ ID NO: 266475 - protein, 8 aa, Influenza virus
PDGAELPF

SEQ ID NO: 266476 - protein, 8 aa, Influenza virus
AKAGVKMN

SEQ ID NO: 266477 - protein, 8 aa, Influenza virus
KAGVKMNP

SEQ ID NO: 266478 - protein, 8 aa, Influenza virus
AGVKMNPN

SEQ ID NO: 266479 - protein, 8 aa, Influenza virus
GVKMNPNQ

SEQ ID NO: 266480 - protein, 8 aa, Influenza virus
VKMNPNQK

SEQ ID NO: 266481 - protein, 8 aa, Influenza virus
KMNPNQKI

SEQ ID NO: 266482 - protein, 8 aa, Influenza virus
IIIAIGSV

SEQ ID NO: 266483 - protein, 8 aa, Influenza virus
KNNQVILC

SEQ ID NO: 266484 - protein, 8 aa, Influenza virus
VPLVPCEP

SEQ ID NO: 266485 - protein, 8 aa, Influenza virus
PLVPCEPI

SEQ ID NO: 266486 - protein, 8 aa, Influenza virus
LVPCEPII

SEQ ID NO: 266487 - protein, 8 aa, Influenza virus
KTVVHLNS

SEQ ID NO: 266488 - protein, 8 aa, Influenza virus
EKEKEICS

SEQ ID NO: 266489 - protein, 8 aa, Influenza virus
KEKEICSV

SEQ ID NO: 266490 - protein, 8 aa, Influenza virus
GFAPFSKD

SEQ ID NO: 266491 - protein, 8 aa, Influenza virus
FAPFSKDN

SEQ ID NO: 266492 - protein, 8 aa, Influenza virus
APFSKDNS

SEQ ID NO: 266493 - protein, 8 aa, Influenza virus
PFSKDNSI

SEQ ID NO: 266494 - protein, 8 aa, Influenza virus
FSKDNSIR

SEQ ID NO: 266495 - protein, 8 aa, Influenza virus
SKDNSIRL

SEQ ID NO: 266496 - protein, 8 aa, Influenza virus
KDNSIRLS

SEQ ID NO: 266497 - protein, 8 aa, Influenza virus
DNSIRLSA

SEQ ID NO: 266498 - protein, 8 aa, Influenza virus
NSIRLSAG

SEQ ID NO: 266499 - protein, 8 aa, Influenza virus
SIRLSAGG

SEQ ID NO: 266500 - protein, 8 aa, Influenza virus
IWVTREPY

SEQ ID NO: 266501 - protein, 8 aa, Influenza virus
WVTREPYV

SEQ ID NO: 266502 - protein, 8 aa, Influenza virus
VTREPYVS

SEQ ID NO: 266503 - protein, 8 aa, Influenza virus
TREPYVSC

SEQ ID NO: 266504 - protein, 8 aa, Influenza virus
REPYVSCD

SEQ ID NO: 266505 - protein, 8 aa, Influenza virus
KCYQFALG

SEQ ID NO: 266506 - protein, 8 aa, Influenza virus
CYQFALGQ

SEQ ID NO: 266507 - protein, 8 aa, Influenza virus
YQFALGQG

SEQ ID NO: 266508 - protein, 8 aa, Influenza virus
QFALGQGT

SEQ ID NO: 266509 - protein, 8 aa, Influenza virus
FALGQGTT

SEQ ID NO: 266510 - protein, 8 aa, Influenza virus
ALGQGTTL

SEQ ID NO: 266511 - protein, 8 aa, Influenza virus
PYRTLLMN

SEQ ID NO: 266512 - protein, 8 aa, Influenza virus
YRTLLMNE

SEQ ID NO: 266513 - protein, 8 aa, Influenza virus
RTLLMNEL

SEQ ID NO: 266514 - protein, 8 aa, Influenza virus
TLLMNELG

SEQ ID NO: 266515 - protein, 8 aa, Influenza virus
LLMNELGV

SEQ ID NO: 266516 - protein, 8 aa, Influenza virus
LMNELGVP

SEQ ID NO: 266517 - protein, 8 aa, Influenza virus
MNELGVPF

SEQ ID NO: 266518 - protein, 8 aa, Influenza virus
NELGVPFH

SEQ ID NO: 266519 - protein, 8 aa, Influenza virus
ELGVPFHL

SEQ ID NO: 266520 - protein, 8 aa, Influenza virus
LGVPFHLG

SEQ ID NO: 266521 - protein, 8 aa, Influenza virus
GVPFHLGT

SEQ ID NO: 266522 - protein, 8 aa, Influenza virus
VPFHLGTK

SEQ ID NO: 266523 - protein, 8 aa, Influenza virus
PFHLGTKQ

SEQ ID NO: 266524 - protein, 8 aa, Influenza virus
FHLGTKQV

SEQ ID NO: 266525 - protein, 8 aa, Influenza virus
HLGTKQVC

SEQ ID NO: 266526 - protein, 8 aa, Influenza virus
TKQVCIAW

SEQ ID NO: 266527 - protein, 8 aa, Influenza virus
KQVCIAWS

SEQ ID NO: 266528 - protein, 8 aa, Influenza virus
QVCIAWSS

SEQ ID NO: 266529 - protein, 8 aa, Influenza virus
VCIAWSSS

SEQ ID NO: 266530 - protein, 8 aa, Influenza virus
CIAWSSSS

SEQ ID NO: 266531 - protein, 8 aa, Influenza virus
IAWSSSSC

SEQ ID NO: 266532 - protein, 8 aa, Influenza virus
AWSSSSCH

SEQ ID NO: 266533 - protein, 8 aa, Influenza virus
WSSSSCHD

SEQ ID NO: 266534 - protein, 8 aa, Influenza virus
SSSSCHDG

SEQ ID NO: 266535 - protein, 8 aa, Influenza virus
SSSCHDGK

SEQ ID NO: 266536 - protein, 8 aa, Influenza virus
SSCHDGKA

SEQ ID NO: 266537 - protein, 8 aa, Influenza virus
SCHDGKAW

SEQ ID NO: 266538 - protein, 8 aa, Influenza virus
CHDGKAWL

SEQ ID NO: 266539 - protein, 8 aa, Influenza virus
HDGKAWLH

SEQ ID NO: 266540 - protein, 8 aa, Influenza virus
DGKAWLHV

SEQ ID NO: 266541 - protein, 8 aa, Influenza virus
GKAWLHVC

SEQ ID NO: 266542 - protein, 8 aa, Influenza virus
AWLHVCVT

SEQ ID NO: 266543 - protein, 8 aa, Influenza virus
WLHVCVTG

SEQ ID NO: 266544 - protein, 8 aa, Influenza virus
NATASFIY

SEQ ID NO: 266545 - protein, 8 aa, Influenza virus
NILRTQES

SEQ ID NO: 266546 - protein, 8 aa, Influenza virus
ILRTQESE

SEQ ID NO: 266547 - protein, 8 aa, Influenza virus
LRTQESEC

SEQ ID NO: 266548 - protein, 8 aa, Influenza virus
RTQESECV

SEQ ID NO: 266549 - protein, 8 aa, Influenza virus
TQESECVC

SEQ ID NO: 266550 - protein, 8 aa, Influenza virus
QESECVCI

SEQ ID NO: 266551 - protein, 8 aa, Influenza virus
ESECVCIN

SEQ ID NO: 266552 - protein, 8 aa, Influenza virus
SECVCING

SEQ ID NO: 266553 - protein, 8 aa, Influenza virus
CTVVMTDG

SEQ ID NO: 266554 - protein, 8 aa, Influenza virus
TVVMTDGS

SEQ ID NO: 266555 - protein, 8 aa, Influenza virus
VVMTDGSA

SEQ ID NO: 266556 - protein, 8 aa, Influenza virus
VMTDGSAS

SEQ ID NO: 266557 - protein, 8 aa, Influenza virus
MTDGSASG

SEQ ID NO: 266558 - protein, 8 aa, Influenza virus
IRKGLILE

SEQ ID NO: 266559 - protein, 8 aa, Influenza virus
RKGLILEY

SEQ ID NO: 266560 - protein, 8 aa, Influenza virus
GSAQHVEE

SEQ ID NO: 266561 - protein, 8 aa, Influenza virus
SAQHVEEC

SEQ ID NO: 266562 - protein, 8 aa, Influenza virus
AQHVEECS

SEQ ID NO: 266563 - protein, 8 aa, Influenza virus
QHVEECSC

SEQ ID NO: 266564 - protein, 8 aa, Influenza virus
HVEECSCY

SEQ ID NO: 266565 - protein, 8 aa, Influenza virus
VEECSCYP

SEQ ID NO: 266566 - protein, 8 aa, Influenza virus
EECSCYPR

SEQ ID NO: 266567 - protein, 8 aa, Influenza virus
ECSCYPRY

SEQ ID NO: 266568 - protein, 8 aa, Influenza virus
SYLNVRCV

SEQ ID NO: 266569 - protein, 8 aa, Influenza virus
VRCVCRDN

SEQ ID NO: 266570 - protein, 8 aa, Influenza virus
RCVCRDNW

SEQ ID NO: 266571 - protein, 8 aa, Influenza virus
CVCRDNWK

SEQ ID NO: 266572 - protein, 8 aa, Influenza virus
VCRDNWKG

SEQ ID NO: 266573 - protein, 8 aa, Influenza virus
CRDNWKGS

SEQ ID NO: 266574 - protein, 8 aa, Influenza virus
RDNWKGSN

SEQ ID NO: 266575 - protein, 8 aa, Influenza virus
DNWKGSNR

SEQ ID NO: 266576 - protein, 8 aa, Influenza virus
NWKGSNRP

SEQ ID NO: 266577 - protein, 8 aa, Influenza virus
WKGSNRPI

SEQ ID NO: 266578 - protein, 8 aa, Influenza virus
KLDINMAD

SEQ ID NO: 266579 - protein, 8 aa, Influenza virus
YVCSGLVG

SEQ ID NO: 266580 - protein, 8 aa, Influenza virus
VCSGLVGD

SEQ ID NO: 266581 - protein, 8 aa, Influenza virus
CSGLVGDT

SEQ ID NO: 266582 - protein, 8 aa, Influenza virus
SGLVGDTP

SEQ ID NO: 266583 - protein, 8 aa, Influenza virus
GLVGDTPR

SEQ ID NO: 266584 - protein, 8 aa, Influenza virus
LVGDTPRK

SEQ ID NO: 266585 - protein, 8 aa, Influenza virus
HGVKGWAF

SEQ ID NO: 266586 - protein, 8 aa, Influenza virus
GVKGWAFD

SEQ ID NO: 266587 - protein, 8 aa, Influenza virus
VKGWAFDD

SEQ ID NO: 266588 - protein, 8 aa, Influenza virus
DVWMGRTI

SEQ ID NO: 266589 - protein, 8 aa, Influenza virus
RSGYETFK

SEQ ID NO: 266590 - protein, 8 aa, Influenza virus
SGYETFKV

SEQ ID NO: 266591 - protein, 8 aa, Influenza virus
GYETFKVI

SEQ ID NO: 266592 - protein, 8 aa, Influenza virus
SGYSGIFS

SEQ ID NO: 266593 - protein, 8 aa, Influenza virus
GYSGIFSV

SEQ ID NO: 266594 - protein, 8 aa, Influenza virus
YSGIFSVE

SEQ ID NO: 266595 - protein, 8 aa, Influenza virus
CINRCFYV

SEQ ID NO: 266596 - protein, 8 aa, Influenza virus
INRCFYVE

SEQ ID NO: 266597 - protein, 8 aa, Influenza virus
NRCFYVEL

SEQ ID NO: 266598 - protein, 8 aa, Influenza virus
RCFYVELI

SEQ ID NO: 266599 - protein, 8 aa, Influenza virus
CFYVELIR

SEQ ID NO: 266600 - protein, 8 aa, Influenza virus
FYVELIRG

SEQ ID NO: 266601 - protein, 8 aa, Influenza virus
YVELIRGR

SEQ ID NO: 266602 - protein, 8 aa, Influenza virus
VWWTSNSI

SEQ ID NO: 266603 - protein, 8 aa, Influenza virus
WWTSNSIV

SEQ ID NO: 266604 - protein, 8 aa, Influenza virus
WTSNSIVV

SEQ ID NO: 266605 - protein, 8 aa, Influenza virus
TSNSIVVF

SEQ ID NO: 266606 - protein, 8 aa, Influenza virus
SNSIVVFC

SEQ ID NO: 266607 - protein, 8 aa, Influenza virus
NSIVVFCG

SEQ ID NO: 266608 - protein, 8 aa, Influenza virus
SIVVFCGT

SEQ ID NO: 266609 - protein, 8 aa, Influenza virus
IVVFCGTS

SEQ ID NO: 266610 - protein, 8 aa, Influenza virus
VVFCGTSG

SEQ ID NO: 266611 - protein, 8 aa, Influenza virus
VFCGTSGT

SEQ ID NO: 266612 - protein, 8 aa, Influenza virus
FCGTSGTY

SEQ ID NO: 266613 - protein, 8 aa, Influenza virus
CGTSGTYG

SEQ ID NO: 266614 - protein, 8 aa, Influenza virus
GTSGTYGT

SEQ ID NO: 266615 - protein, 8 aa, Influenza virus
TSGTYGTG

SEQ ID NO: 266616 - protein, 8 aa, Influenza virus
SGTYGTGS

SEQ ID NO: 266617 - protein, 8 aa, Influenza virus
GTYGTGSW

SEQ ID NO: 266618 - protein, 8 aa, Influenza virus
TYGTGSWP

SEQ ID NO: 266619 - protein, 8 aa, Influenza virus
YGTGSWPD

SEQ ID NO: 266620 - protein, 8 aa, Influenza virus
GTGSWPDG

SEQ ID NO: 266621 - protein, 8 aa, Influenza virus
TGSWPDGA

SEQ ID NO: 266622 - protein, 8 aa, Influenza virus
GSWPDGAD

SEQ ID NO: 266623 - protein, 8 aa, Influenza virus
SWPDGADI

SEQ ID NO: 266624 - protein, 8 aa, Influenza virus
RTSISCLY

SEQ ID NO: 266625 - protein, 8 aa, Influenza virus
DINLHAYI

SEQ ID NO: 266626 - protein, 8 aa, Influenza virus
INLHAYIS

SEQ ID NO: 266627 - protein, 8 aa, Influenza virus
NLHAYISF

SEQ ID NO: 266628 - protein, 8 aa, Influenza virus
LHAYISFR

SEQ ID NO: 266629 - protein, 8 aa, Influenza virus
HAYISFRN

SEQ ID NO: 266630 - protein, 8 aa, Influenza virus
AYISFRNL

SEQ ID NO: 266631 - protein, 8 aa, Influenza virus
ALLIGVGN

SEQ ID NO: 266632 - protein, 8 aa, Influenza virus
LLIGVGNL

SEQ ID NO: 266633 - protein, 8 aa, Influenza virus
GVGNLVFN

SEQ ID NO: 266634 - protein, 8 aa, Influenza virus
GNLVFNTV

SEQ ID NO: 266635 - protein, 8 aa, Influenza virus
NLVFNTVI

SEQ ID NO: 266636 - protein, 8 aa, Influenza virus
LVFNTVIH

SEQ ID NO: 266637 - protein, 8 aa, Influenza virus
FNTVIHEK

SEQ ID NO: 266638 - protein, 8 aa, Influenza virus
LPLCPFRG

SEQ ID NO: 266639 - protein, 8 aa, Influenza virus
PLCPFRGF

SEQ ID NO: 266640 - protein, 8 aa, Influenza virus
LCPFRGFF

SEQ ID NO: 266641 - protein, 8 aa, Influenza virus
CPFRGFFP

SEQ ID NO: 266642 - protein, 8 aa, Influenza virus
PFRGFFPF

SEQ ID NO: 266643 - protein, 8 aa, Influenza virus
FRGFFPFH

SEQ ID NO: 266644 - protein, 8 aa, Influenza virus
RGFFPFHK

SEQ ID NO: 266645 - protein, 8 aa, Influenza virus
GFFPFHKD

SEQ ID NO: 266646 - protein, 8 aa, Influenza virus
FFPFHKDN

SEQ ID NO: 266647 - protein, 8 aa, Influenza virus
FPFHKDNA

SEQ ID NO: 266648 - protein, 8 aa, Influenza virus
PFHKDNAI

SEQ ID NO: 266649 - protein, 8 aa, Influenza virus
FHKDNAIR

SEQ ID NO: 266650 - protein, 8 aa, Influenza virus
HKDNAIRL

SEQ ID NO: 266651 - protein, 8 aa, Influenza virus
KDNAIRLG

SEQ ID NO: 266652 - protein, 8 aa, Influenza virus
DNAIRLGE

SEQ ID NO: 266653 - protein, 8 aa, Influenza virus
NAIRLGEN

SEQ ID NO: 266654 - protein, 8 aa, Influenza virus
VIVTREPY

SEQ ID NO: 266655 - protein, 8 aa, Influenza virus
IVTREPYV

SEQ ID NO: 266656 - protein, 8 aa, Influenza virus
VTREPYVS

SEQ ID NO: 266657 - protein, 8 aa, Influenza virus
TREPYVSC

SEQ ID NO: 266658 - protein, 8 aa, Influenza virus
REPYVSCD

SEQ ID NO: 266659 - protein, 8 aa, Influenza virus
EPYVSCDN

SEQ ID NO: 266660 - protein, 8 aa, Influenza virus
NCWSFALA

SEQ ID NO: 266661 - protein, 8 aa, Influenza virus
CWSFALAQ

SEQ ID NO: 266662 - protein, 8 aa, Influenza virus
WSFALAQG

SEQ ID NO: 266663 - protein, 8 aa, Influenza virus
SFALAQGA

SEQ ID NO: 266664 - protein, 8 aa, Influenza virus
FALAQGAL

SEQ ID NO: 266665 - protein, 8 aa, Influenza virus
ALAQGALL

SEQ ID NO: 266666 - protein, 8 aa, Influenza virus
LAQGALLG

SEQ ID NO: 266667 - protein, 8 aa, Influenza virus
AQGALLGT

SEQ ID NO: 266668 - protein, 8 aa, Influenza virus
LLGTKHSN

SEQ ID NO: 266669 - protein, 8 aa, Influenza virus
LGTKHSNG

SEQ ID NO: 266670 - protein, 8 aa, Influenza virus
GTKHSNGT

SEQ ID NO: 266671 - protein, 8 aa, Influenza virus
HSNGTIKD

SEQ ID NO: 266672 - protein, 8 aa, Influenza virus
SNGTIKDR

SEQ ID NO: 266673 - protein, 8 aa, Influenza virus
NGTIKDRT

SEQ ID NO: 266674 - protein, 8 aa, Influenza virus
KDRTPYRS

SEQ ID NO: 266675 - protein, 8 aa, Influenza virus
DRTPYRSL

SEQ ID NO: 266676 - protein, 8 aa, Influenza virus
RTPYRSLI

SEQ ID NO: 266677 - protein, 8 aa, Influenza virus
TPYRSLIR

SEQ ID NO: 266678 - protein, 8 aa, Influenza virus
PYRSLIRF

SEQ ID NO: 266679 - protein, 8 aa, Influenza virus
YRSLIRFP

SEQ ID NO: 266680 - protein, 8 aa, Influenza virus
RSLIRFPI

SEQ ID NO: 266681 - protein, 8 aa, Influenza virus
SLIRFPIG

SEQ ID NO: 266682 - protein, 8 aa, Influenza virus
GTAPVLGN

SEQ ID NO: 266683 - protein, 8 aa, Influenza virus
TAPVLGNY

SEQ ID NO: 266684 - protein, 8 aa, Influenza virus
APVLGNYK

SEQ ID NO: 266685 - protein, 8 aa, Influenza virus
PVLGNYKE

SEQ ID NO: 266686 - protein, 8 aa, Influenza virus
EICIAWSS

SEQ ID NO: 266687 - protein, 8 aa, Influenza virus
CIAWSSSS

SEQ ID NO: 266688 - protein, 8 aa, Influenza virus
IAWSSSSC

SEQ ID NO: 266689 - protein, 8 aa, Influenza virus
AWSSSSCF

SEQ ID NO: 266690 - protein, 8 aa, Influenza virus
WSSSSCFD

SEQ ID NO: 266691 - protein, 8 aa, Influenza virus
SSSSCFDG

SEQ ID NO: 266692 - protein, 8 aa, Influenza virus
SSSCFDGK

SEQ ID NO: 266693 - protein, 8 aa, Influenza virus
SSCFDGKE

SEQ ID NO: 266694 - protein, 8 aa, Influenza virus
SCFDGKEW

SEQ ID NO: 266695 - protein, 8 aa, Influenza virus
CFDGKEWM

SEQ ID NO: 266696 - protein, 8 aa, Influenza virus
FDGKEWMH

SEQ ID NO: 266697 - protein, 8 aa, Influenza virus
DGKEWMHV

SEQ ID NO: 266698 - protein, 8 aa, Influenza virus
GKEWMHVC

SEQ ID NO: 266699 - protein, 8 aa, Influenza virus
KDILRTQE

SEQ ID NO: 266700 - protein, 8 aa, Influenza virus
DILRTQES

SEQ ID NO: 266701 - protein, 8 aa, Influenza virus
ILRTQESE

SEQ ID NO: 266702 - protein, 8 aa, Influenza virus
LRTQESEC

SEQ ID NO: 266703 - protein, 8 aa, Influenza virus
RTQESECQ

SEQ ID NO: 266704 - protein, 8 aa, Influenza virus
TQESECQC

SEQ ID NO: 266705 - protein, 8 aa, Influenza virus
QESECQCI

SEQ ID NO: 266706 - protein, 8 aa, Influenza virus
VTDGPAAN

SEQ ID NO: 266707 - protein, 8 aa, Influenza virus
TDGPAANS

SEQ ID NO: 266708 - protein, 8 aa, Influenza virus
DGPAANSA

SEQ ID NO: 266709 - protein, 8 aa, Influenza virus
ADHRVYWI

SEQ ID NO: 266710 - protein, 8 aa, Influenza virus
DHRVYWIR

SEQ ID NO: 266711 - protein, 8 aa, Influenza virus
KIQHLEEC

SEQ ID NO: 266712 - protein, 8 aa, Influenza virus
IQHLEECS

SEQ ID NO: 266713 - protein, 8 aa, Influenza virus
QHLEECSC

SEQ ID NO: 266714 - protein, 8 aa, Influenza virus
HLEECSCY

SEQ ID NO: 266715 - protein, 8 aa, Influenza virus
LEECSCYV

SEQ ID NO: 266716 - protein, 8 aa, Influenza virus
EECSCYVD

SEQ ID NO: 266717 - protein, 8 aa, Influenza virus
DVYCICRD

SEQ ID NO: 266718 - protein, 8 aa, Influenza virus
VYCICRDN

SEQ ID NO: 266719 - protein, 8 aa, Influenza virus
YCICRDNW

SEQ ID NO: 266720 - protein, 8 aa, Influenza virus
CICRDNWK

SEQ ID NO: 266721 - protein, 8 aa, Influenza virus
ICRDNWKG

SEQ ID NO: 266722 - protein, 8 aa, Influenza virus
CRDNWKGS

SEQ ID NO: 266723 - protein, 8 aa, Influenza virus
RDNWKGSN

SEQ ID NO: 266724 - protein, 8 aa, Influenza virus
DNWKGSNR

SEQ ID NO: 266725 - protein, 8 aa, Influenza virus
NWKGSNRP

SEQ ID NO: 266726 - protein, 8 aa, Influenza virus
WKGSNRPW

SEQ ID NO: 266727 - protein, 8 aa, Influenza virus
KGSNRPWM

SEQ ID NO: 266728 - protein, 8 aa, Influenza virus
GSNRPWMR

SEQ ID NO: 266729 - protein, 8 aa, Influenza virus
SNRPWMRI

SEQ ID NO: 266730 - protein, 8 aa, Influenza virus
NRPWMRIN

SEQ ID NO: 266731 - protein, 8 aa, Influenza virus
RPWMRINN

SEQ ID NO: 266732 - protein, 8 aa, Influenza virus
PWMRINNE

SEQ ID NO: 266733 - protein, 8 aa, Influenza virus
WMRINNET

SEQ ID NO: 266734 - protein, 8 aa, Influenza virus
MRINNETI

SEQ ID NO: 266735 - protein, 8 aa, Influenza virus
RINNETIL

SEQ ID NO: 266736 - protein, 8 aa, Influenza virus
INNETILE

SEQ ID NO: 266737 - protein, 8 aa, Influenza virus
NNETILET

SEQ ID NO: 266738 - protein, 8 aa, Influenza virus
NETILETG

SEQ ID NO: 266739 - protein, 8 aa, Influenza virus
ETILETGY

SEQ ID NO: 266740 - protein, 8 aa, Influenza virus
TILETGYV

SEQ ID NO: 266741 - protein, 8 aa, Influenza virus
ILETGYVC

SEQ ID NO: 266742 - protein, 8 aa, Influenza virus
LETGYVCS

SEQ ID NO: 266743 - protein, 8 aa, Influenza virus
ETGYVCSK

SEQ ID NO: 266744 - protein, 8 aa, Influenza virus
TGYVCSKF

SEQ ID NO: 266745 - protein, 8 aa, Influenza virus
GYVCSKFH

SEQ ID NO: 266746 - protein, 8 aa, Influenza virus
YVCSKFHS

SEQ ID NO: 266747 - protein, 8 aa, Influenza virus
VCSKFHSD

SEQ ID NO: 266748 - protein, 8 aa, Influenza virus
CSKFHSDT

SEQ ID NO: 266749 - protein, 8 aa, Influenza virus
SKFHSDTP

SEQ ID NO: 266750 - protein, 8 aa, Influenza virus
KFHSDTPR

SEQ ID NO: 266751 - protein, 8 aa, Influenza virus
FHSDTPRP

SEQ ID NO: 266752 - protein, 8 aa, Influenza virus
HSDTPRPA

SEQ ID NO: 266753 - protein, 8 aa, Influenza virus
SDTPRPAD

SEQ ID NO: 266754 - protein, 8 aa, Influenza virus
DTPRPADP

SEQ ID NO: 266755 - protein, 8 aa, Influenza virus
TPRPADPS

SEQ ID NO: 266756 - protein, 8 aa, Influenza virus
GPGVKGFG

SEQ ID NO: 266757 - protein, 8 aa, Influenza virus
PGVKGFGF

SEQ ID NO: 266758 - protein, 8 aa, Influenza virus
GVKGFGFK

SEQ ID NO: 266759 - protein, 8 aa, Influenza virus
GNDVWLGR

SEQ ID NO: 266760 - protein, 8 aa, Influenza virus
NDVWLGRT

SEQ ID NO: 266761 - protein, 8 aa, Influenza virus
DVWLGRTV

SEQ ID NO: 266762 - protein, 8 aa, Influenza virus
VWLGRTVS

SEQ ID NO: 266763 - protein, 8 aa, Influenza virus
GRSGFEII

SEQ ID NO: 266764 - protein, 8 aa, Influenza virus
RSGFEIIK

SEQ ID NO: 266765 - protein, 8 aa, Influenza virus
SGFEIIKV

SEQ ID NO: 266766 - protein, 8 aa, Influenza virus
IKVTEGWI

SEQ ID NO: 266767 - protein, 8 aa, Influenza virus
TQTLVSNN

SEQ ID NO: 266768 - protein, 8 aa, Influenza virus
QTLVSNND

SEQ ID NO: 266769 - protein, 8 aa, Influenza virus
TLVSNNDW

SEQ ID NO: 266770 - protein, 8 aa, Influenza virus
LVSNNDWS

SEQ ID NO: 266771 - protein, 8 aa, Influenza virus
VSNNDWSG

SEQ ID NO: 266772 - protein, 8 aa, Influenza virus
SNNDWSGY

SEQ ID NO: 266773 - protein, 8 aa, Influenza virus
NNDWSGYS

SEQ ID NO: 266774 - protein, 8 aa, Influenza virus
NDWSGYSG

SEQ ID NO: 266775 - protein, 8 aa, Influenza virus
DWSGYSGS

SEQ ID NO: 266776 - protein, 8 aa, Influenza virus
WSGYSGSF

SEQ ID NO: 266777 - protein, 8 aa, Influenza virus
SGYSGSFI

SEQ ID NO: 266778 - protein, 8 aa, Influenza virus
GYSGSFIV

SEQ ID NO: 266779 - protein, 8 aa, Influenza virus
GCFQPCFY

SEQ ID NO: 266780 - protein, 8 aa, Influenza virus
CFQPCFYV

SEQ ID NO: 266781 - protein, 8 aa, Influenza virus
FQPCFYVE

SEQ ID NO: 266782 - protein, 8 aa, Influenza virus
QPCFYVEL

SEQ ID NO: 266783 - protein, 8 aa, Influenza virus
PCFYVELI

SEQ ID NO: 266784 - protein, 8 aa, Influenza virus
CFYVELIR

SEQ ID NO: 266785 - protein, 8 aa, Influenza virus
FYVELIRG

SEQ ID NO: 266786 - protein, 8 aa, Influenza virus
YVELIRGR

SEQ ID NO: 266787 - protein, 8 aa, Influenza virus
ELIRGRPN

SEQ ID NO: 266788 - protein, 8 aa, Influenza virus
VSWTSNSI

SEQ ID NO: 266789 - protein, 8 aa, Influenza virus
SWTSNSIV

SEQ ID NO: 266790 - protein, 8 aa, Influenza virus
WTSNSIVT

SEQ ID NO: 266791 - protein, 8 aa, Influenza virus
TSNSIVTF

SEQ ID NO: 266792 - protein, 8 aa, Influenza virus
SNSIVTFC

SEQ ID NO: 266793 - protein, 8 aa, Influenza virus
NSIVTFCG

SEQ ID NO: 266794 - protein, 8 aa, Influenza virus
SIVTFCGL

SEQ ID NO: 266795 - protein, 8 aa, Influenza virus
IVTFCGLD

SEQ ID NO: 266796 - protein, 8 aa, Influenza virus
VTFCGLDN

SEQ ID NO: 266797 - protein, 8 aa, Influenza virus
TFCGLDNE

SEQ ID NO: 266798 - protein, 8 aa, Influenza virus
FCGLDNEP

SEQ ID NO: 266799 - protein, 8 aa, Influenza virus
CGLDNEPG

SEQ ID NO: 266800 - protein, 8 aa, Influenza virus
GLDNEPGS

SEQ ID NO: 266801 - protein, 8 aa, Influenza virus
LDNEPGSG

SEQ ID NO: 266802 - protein, 8 aa, Influenza virus
NEPGSGNW

SEQ ID NO: 266803 - protein, 8 aa, Influenza virus
EPGSGNWP

SEQ ID NO: 266804 - protein, 8 aa, Influenza virus
PGSGNWPD

SEQ ID NO: 266805 - protein, 8 aa, Influenza virus
GSGNWPDG

SEQ ID NO: 266806 - protein, 8 aa, Influenza virus
SGNWPDGS

SEQ ID NO: 266807 - protein, 8 aa, Influenza virus
WPDGSNIG

SEQ ID NO: 266808 - protein, 8 aa, Influenza virus
PDGSNIGF

SEQ ID NO: 266809 - protein, 8 aa, Influenza virus
DGSNIGFM

SEQ ID NO: 266810 - protein, 8 aa, Influenza virus
GSNIGFMP

SEQ ID NO: 266811 - protein, 8 aa, Influenza virus
SNIGFMPK

SEQ ID NO: 266812 - protein, 8 aa, Influenza virus
MNPNQKII

SEQ ID NO: 266813 - protein, 8 aa, Influenza virus
NPNQKIIT

SEQ ID NO: 266814 - protein, 8 aa, Influenza virus
PNQKIITI

SEQ ID NO: 266815 - protein, 8 aa, Influenza virus
NQKIITIG

SEQ ID NO: 266816 - protein, 8 aa, Influenza virus
QKIITIGS

SEQ ID NO: 266817 - protein, 8 aa, Influenza virus
IITIGSIS

SEQ ID NO: 266818 - protein, 8 aa, Influenza virus
LTTVGLLL

SEQ ID NO: 266819 - protein, 8 aa, Influenza virus
TTVGLLLQ

SEQ ID NO: 266820 - protein, 8 aa, Influenza virus
TVGLLLQI

SEQ ID NO: 266821 - protein, 8 aa, Influenza virus
VGLLLQIT

SEQ ID NO: 266822 - protein, 8 aa, Influenza virus
GLLLQITS

SEQ ID NO: 266823 - protein, 8 aa, Influenza virus
LLLQITSL

SEQ ID NO: 266824 - protein, 8 aa, Influenza virus
LLQITSLC

SEQ ID NO: 266825 - protein, 8 aa, Influenza virus
LQITSLCS

SEQ ID NO: 266826 - protein, 8 aa, Influenza virus
QITSLCSI

SEQ ID NO: 266827 - protein, 8 aa, Influenza virus
ITSLCSIW

SEQ ID NO: 266828 - protein, 8 aa, Influenza virus
TSLCSIWF

SEQ ID NO: 266829 - protein, 8 aa, Influenza virus
SLCSIWFS

SEQ ID NO: 266830 - protein, 8 aa, Influenza virus
LCSIWFSH

SEQ ID NO: 266831 - protein, 8 aa, Influenza virus
CSIWFSHY

SEQ ID NO: 266832 - protein, 8 aa, Influenza virus
SIWFSHYN

SEQ ID NO: 266833 - protein, 8 aa, Influenza virus
IWFSHYNQ

SEQ ID NO: 266834 - protein, 8 aa, Influenza virus
WFSHYNQV

SEQ ID NO: 266835 - protein, 8 aa, Influenza virus
FSHYNQVT

SEQ ID NO: 266836 - protein, 8 aa, Influenza virus
SHYNQVTQ

SEQ ID NO: 266837 - protein, 8 aa, Influenza virus
HYNQVTQT

SEQ ID NO: 266838 - protein, 8 aa, Influenza virus
CSNNTTNY

SEQ ID NO: 266839 - protein, 8 aa, Influenza virus
SNNTTNYY

SEQ ID NO: 266840 - protein, 8 aa, Influenza virus
NNTTNYYN

SEQ ID NO: 266841 - protein, 8 aa, Influenza virus
NTTNYYNE

SEQ ID NO: 266842 - protein, 8 aa, Influenza virus
TTNYYNET

SEQ ID NO: 266843 - protein, 8 aa, Influenza virus
TNYYNETF

SEQ ID NO: 266844 - protein, 8 aa, Influenza virus
NYYNETFV

SEQ ID NO: 266845 - protein, 8 aa, Influenza virus
YYNETFVN

SEQ ID NO: 266846 - protein, 8 aa, Influenza virus
YNETFVNV

SEQ ID NO: 266847 - protein, 8 aa, Influenza virus
NETFVNVT

SEQ ID NO: 266848 - protein, 8 aa, Influenza virus
ETFVNVTN

SEQ ID NO: 266849 - protein, 8 aa, Influenza virus
TFVNVTNV

SEQ ID NO: 266850 - protein, 8 aa, Influenza virus
FVNVTNVQ

SEQ ID NO: 266851 - protein, 8 aa, Influenza virus
VNVTNVQN

SEQ ID NO: 266852 - protein, 8 aa, Influenza virus
NVTNVQNN

SEQ ID NO: 266853 - protein, 8 aa, Influenza virus
VTNVQNNY

SEQ ID NO: 266854 - protein, 8 aa, Influenza virus
TNVQNNYT

SEQ ID NO: 266855 - protein, 8 aa, Influenza virus
NVQNNYTT

SEQ ID NO: 266856 - protein, 8 aa, Influenza virus
VQNNYTTV

SEQ ID NO: 266857 - protein, 8 aa, Influenza virus
LCPIRGWA

SEQ ID NO: 266858 - protein, 8 aa, Influenza virus
CPIRGWAP

SEQ ID NO: 266859 - protein, 8 aa, Influenza virus
PIRGWAPL

SEQ ID NO: 266860 - protein, 8 aa, Influenza virus
IRGWAPLS

SEQ ID NO: 266861 - protein, 8 aa, Influenza virus
RGWAPLSK

SEQ ID NO: 266862 - protein, 8 aa, Influenza virus
GWAPLSKD

SEQ ID NO: 266863 - protein, 8 aa, Influenza virus
WAPLSKDN

SEQ ID NO: 266864 - protein, 8 aa, Influenza virus
APLSKDNG

SEQ ID NO: 266865 - protein, 8 aa, Influenza virus
PLSKDNGI

SEQ ID NO: 266866 - protein, 8 aa, Influenza virus
LSKDNGIR

SEQ ID NO: 266867 - protein, 8 aa, Influenza virus
SKDNGIRI

SEQ ID NO: 266868 - protein, 8 aa, Influenza virus
KDNGIRIG

SEQ ID NO: 266869 - protein, 8 aa, Influenza virus
DNGIRIGS

SEQ ID NO: 266870 - protein, 8 aa, Influenza virus
NGIRIGSR

SEQ ID NO: 266871 - protein, 8 aa, Influenza virus
GIRIGSRG

SEQ ID NO: 266872 - protein, 8 aa, Influenza virus
IRIGSRGE

SEQ ID NO: 266873 - protein, 8 aa, Influenza virus
RIGSRGEV

SEQ ID NO: 266874 - protein, 8 aa, Influenza virus
IGSRGEVF

SEQ ID NO: 266875 - protein, 8 aa, Influenza virus
GSRGEVFV

SEQ ID NO: 266876 - protein, 8 aa, Influenza virus
SRGEVFVI

SEQ ID NO: 266877 - protein, 8 aa, Influenza virus
RGEVFVIR

SEQ ID NO: 266878 - protein, 8 aa, Influenza virus
GEVFVIRE

SEQ ID NO: 266879 - protein, 8 aa, Influenza virus
EVFVIREP

SEQ ID NO: 266880 - protein, 8 aa, Influenza virus
VFVIREPF

SEQ ID NO: 266881 - protein, 8 aa, Influenza virus
FVIREPFI

SEQ ID NO: 266882 - protein, 8 aa, Influenza virus
VIREPFIS

SEQ ID NO: 266883 - protein, 8 aa, Influenza virus
IREPFISC

SEQ ID NO: 266884 - protein, 8 aa, Influenza virus
REPFISCS

SEQ ID NO: 266885 - protein, 8 aa, Influenza virus
EPFISCSI

SEQ ID NO: 266886 - protein, 8 aa, Influenza virus
ISCSISEC

SEQ ID NO: 266887 - protein, 8 aa, Influenza virus
SCSISECR

SEQ ID NO: 266888 - protein, 8 aa, Influenza virus
CSISECRT

SEQ ID NO: 266889 - protein, 8 aa, Influenza virus
SISECRTF

SEQ ID NO: 266890 - protein, 8 aa, Influenza virus
ISECRTFF

SEQ ID NO: 266891 - protein, 8 aa, Influenza virus
SECRTFFL

SEQ ID NO: 266892 - protein, 8 aa, Influenza virus
ECRTFFLT

SEQ ID NO: 266893 - protein, 8 aa, Influenza virus
CRTFFLTQ

SEQ ID NO: 266894 - protein, 8 aa, Influenza virus
RTFFLTQG

SEQ ID NO: 266895 - protein, 8 aa, Influenza virus
TFFLTQGA

SEQ ID NO: 266896 - protein, 8 aa, Influenza virus
FFLTQGAL

SEQ ID NO: 266897 - protein, 8 aa, Influenza virus
FLTQGALL

SEQ ID NO: 266898 - protein, 8 aa, Influenza virus
LTQGALLN

SEQ ID NO: 266899 - protein, 8 aa, Influenza virus
TQGALLND

SEQ ID NO: 266900 - protein, 8 aa, Influenza virus
QGALLNDK

SEQ ID NO: 266901 - protein, 8 aa, Influenza virus
GALLNDKH

SEQ ID NO: 266902 - protein, 8 aa, Influenza virus
ALLNDKHS

SEQ ID NO: 266903 - protein, 8 aa, Influenza virus
LLNDKHSN

SEQ ID NO: 266904 - protein, 8 aa, Influenza virus
LNDKHSNG

SEQ ID NO: 266905 - protein, 8 aa, Influenza virus
NDKHSNGT

SEQ ID NO: 266906 - protein, 8 aa, Influenza virus
DKHSNGTV

SEQ ID NO: 266907 - protein, 8 aa, Influenza virus
KHSNGTVK

SEQ ID NO: 266908 - protein, 8 aa, Influenza virus
HSNGTVKD

SEQ ID NO: 266909 - protein, 8 aa, Influenza virus
SNGTVKDR

SEQ ID NO: 266910 - protein, 8 aa, Influenza virus
NGTVKDRS

SEQ ID NO: 266911 - protein, 8 aa, Influenza virus
GTVKDRSP

SEQ ID NO: 266912 - protein, 8 aa, Influenza virus
TVKDRSPF

SEQ ID NO: 266913 - protein, 8 aa, Influenza virus
VKDRSPFR

SEQ ID NO: 266914 - protein, 8 aa, Influenza virus
KDRSPFRT

SEQ ID NO: 266915 - protein, 8 aa, Influenza virus
DRSPFRTL

SEQ ID NO: 266916 - protein, 8 aa, Influenza virus
RSPFRTLM

SEQ ID NO: 266917 - protein, 8 aa, Influenza virus
SPFRTLMS

SEQ ID NO: 266918 - protein, 8 aa, Influenza virus
PFRTLMSC

SEQ ID NO: 266919 - protein, 8 aa, Influenza virus
FRTLMSCP

SEQ ID NO: 266920 - protein, 8 aa, Influenza virus
RTLMSCPI

SEQ ID NO: 266921 - protein, 8 aa, Influenza virus
TLMSCPIG

SEQ ID NO: 266922 - protein, 8 aa, Influenza virus
LMSCPIGV

SEQ ID NO: 266923 - protein, 8 aa, Influenza virus
MSCPIGVA

SEQ ID NO: 266924 - protein, 8 aa, Influenza virus
SCPIGVAP

SEQ ID NO: 266925 - protein, 8 aa, Influenza virus
CPIGVAPS

SEQ ID NO: 266926 - protein, 8 aa, Influenza virus
PIGVAPSP

SEQ ID NO: 266927 - protein, 8 aa, Influenza virus
IGVAPSPS

SEQ ID NO: 266928 - protein, 8 aa, Influenza virus
GVAPSPSN

SEQ ID NO: 266929 - protein, 8 aa, Influenza virus
VAPSPSNS

SEQ ID NO: 266930 - protein, 8 aa, Influenza virus
APSPSNSR

SEQ ID NO: 266931 - protein, 8 aa, Influenza virus
PSPSNSRF

SEQ ID NO: 266932 - protein, 8 aa, Influenza virus
SPSNSRFE

SEQ ID NO: 266933 - protein, 8 aa, Influenza virus
PSNSRFES

SEQ ID NO: 266934 - protein, 8 aa, Influenza virus
SNSRFESV

SEQ ID NO: 266935 - protein, 8 aa, Influenza virus
NSRFESVA

SEQ ID NO: 266936 - protein, 8 aa, Influenza virus
SRFESVAW

SEQ ID NO: 266937 - protein, 8 aa, Influenza virus
RFESVAWS

SEQ ID NO: 266938 - protein, 8 aa, Influenza virus
FESVAWSA

SEQ ID NO: 266939 - protein, 8 aa, Influenza virus
ESVAWSAT

SEQ ID NO: 266940 - protein, 8 aa, Influenza virus
SVAWSATA

SEQ ID NO: 266941 - protein, 8 aa, Influenza virus
VAWSATAC

SEQ ID NO: 266942 - protein, 8 aa, Influenza virus
AWSATACS

SEQ ID NO: 266943 - protein, 8 aa, Influenza virus
WSATACSD

SEQ ID NO: 266944 - protein, 8 aa, Influenza virus
SATACSDG

SEQ ID NO: 266945 - protein, 8 aa, Influenza virus
ATACSDGP

SEQ ID NO: 266946 - protein, 8 aa, Influenza virus
TACSDGPG

SEQ ID NO: 266947 - protein, 8 aa, Influenza virus
ACSDGPGW

SEQ ID NO: 266948 - protein, 8 aa, Influenza virus
CSDGPGWL

SEQ ID NO: 266949 - protein, 8 aa, Influenza virus
SDGPGWLT

SEQ ID NO: 266950 - protein, 8 aa, Influenza virus
DGPGWLTL

SEQ ID NO: 266951 - protein, 8 aa, Influenza virus
GPGWLTLG

SEQ ID NO: 266952 - protein, 8 aa, Influenza virus
PGWLTLGI

SEQ ID NO: 266953 - protein, 8 aa, Influenza virus
GWLTLGIT

SEQ ID NO: 266954 - protein, 8 aa, Influenza virus
WLTLGITG

SEQ ID NO: 266955 - protein, 8 aa, Influenza virus
LTLGITGP

SEQ ID NO: 266956 - protein, 8 aa, Influenza virus
TLGITGPD

SEQ ID NO: 266957 - protein, 8 aa, Influenza virus
LGITGPDA

SEQ ID NO: 266958 - protein, 8 aa, Influenza virus
GITGPDAT

SEQ ID NO: 266959 - protein, 8 aa, Influenza virus
ITGPDATA

SEQ ID NO: 266960 - protein, 8 aa, Influenza virus
TGPDATAV

SEQ ID NO: 266961 - protein, 8 aa, Influenza virus
GPDATAVA

SEQ ID NO: 266962 - protein, 8 aa, Influenza virus
PDATAVAV

SEQ ID NO: 266963 - protein, 8 aa, Influenza virus
DATAVAVL

SEQ ID NO: 266964 - protein, 8 aa, Influenza virus
ATAVAVLK

SEQ ID NO: 266965 - protein, 8 aa, Influenza virus
TAVAVLKY

SEQ ID NO: 266966 - protein, 8 aa, Influenza virus
AVAVLKYN

SEQ ID NO: 266967 - protein, 8 aa, Influenza virus
VAVLKYNG

SEQ ID NO: 266968 - protein, 8 aa, Influenza virus
AVLKYNGI

SEQ ID NO: 266969 - protein, 8 aa, Influenza virus
VLKYNGII

SEQ ID NO: 266970 - protein, 8 aa, Influenza virus
LKYNGIIT

SEQ ID NO: 266971 - protein, 8 aa, Influenza virus
KYNGIITD

SEQ ID NO: 266972 - protein, 8 aa, Influenza virus
YNGIITDT

SEQ ID NO: 266973 - protein, 8 aa, Influenza virus
NGIITDTL

SEQ ID NO: 266974 - protein, 8 aa, Influenza virus
GIITDTLK

SEQ ID NO: 266975 - protein, 8 aa, Influenza virus
IITDTLKS

SEQ ID NO: 266976 - protein, 8 aa, Influenza virus
ITDTLKSW

SEQ ID NO: 266977 - protein, 8 aa, Influenza virus
TDTLKSWK

SEQ ID NO: 266978 - protein, 8 aa, Influenza virus
DTLKSWKG

SEQ ID NO: 266979 - protein, 8 aa, Influenza virus
TLKSWKGN

SEQ ID NO: 266980 - protein, 8 aa, Influenza virus
LKSWKGNI

SEQ ID NO: 266981 - protein, 8 aa, Influenza virus
KSWKGNIM

SEQ ID NO: 266982 - protein, 8 aa, Influenza virus
SWKGNIMR

SEQ ID NO: 266983 - protein, 8 aa, Influenza virus
WKGNIMRT

SEQ ID NO: 266984 - protein, 8 aa, Influenza virus
KGNIMRTQ

SEQ ID NO: 266985 - protein, 8 aa, Influenza virus
GNIMRTQE

SEQ ID NO: 266986 - protein, 8 aa, Influenza virus
NIMRTQES

SEQ ID NO: 266987 - protein, 8 aa, Influenza virus
IMRTQESE

SEQ ID NO: 266988 - protein, 8 aa, Influenza virus
MRTQESEC

SEQ ID NO: 266989 - protein, 8 aa, Influenza virus
RTQESECV

SEQ ID NO: 266990 - protein, 8 aa, Influenza virus
TQESECVC

SEQ ID NO: 266991 - protein, 8 aa, Influenza virus
QESECVCQ

SEQ ID NO: 266992 - protein, 8 aa, Influenza virus
ESECVCQD

SEQ ID NO: 266993 - protein, 8 aa, Influenza virus
SECVCQDE

SEQ ID NO: 266994 - protein, 8 aa, Influenza virus
ECVCQDEF

SEQ ID NO: 266995 - protein, 8 aa, Influenza virus
CVCQDEFC

SEQ ID NO: 266996 - protein, 8 aa, Influenza virus
VCQDEFCY

SEQ ID NO: 266997 - protein, 8 aa, Influenza virus
CQDEFCYT

SEQ ID NO: 266998 - protein, 8 aa, Influenza virus
QDEFCYTL

SEQ ID NO: 266999 - protein, 8 aa, Influenza virus
DEFCYTLI

SEQ ID NO: 267000 - protein, 8 aa, Influenza virus
EFCYTLIT

SEQ ID NO: 267001 - protein, 8 aa, Influenza virus
FCYTLITD

SEQ ID NO: 267002 - protein, 8 aa, Influenza virus
CYTLITDG

SEQ ID NO: 267003 - protein, 8 aa, Influenza virus
YTLITDGP

SEQ ID NO: 267004 - protein, 8 aa, Influenza virus
TLITDGPS

SEQ ID NO: 267005 - protein, 8 aa, Influenza virus
LITDGPSD

SEQ ID NO: 267006 - protein, 8 aa, Influenza virus
ITDGPSDA

SEQ ID NO: 267007 - protein, 8 aa, Influenza virus
TDGPSDAQ

SEQ ID NO: 267008 - protein, 8 aa, Influenza virus
DGPSDAQA

SEQ ID NO: 267009 - protein, 8 aa, Influenza virus
GPSDAQAF

SEQ ID NO: 267010 - protein, 8 aa, Influenza virus
PSDAQAFY

SEQ ID NO: 267011 - protein, 8 aa, Influenza virus
SDAQAFYK

SEQ ID NO: 267012 - protein, 8 aa, Influenza virus
DAQAFYKI

SEQ ID NO: 267013 - protein, 8 aa, Influenza virus
AQAFYKIL

SEQ ID NO: 267014 - protein, 8 aa, Influenza virus
QAFYKILK

SEQ ID NO: 267015 - protein, 8 aa, Influenza virus
AFYKILKI

SEQ ID NO: 267016 - protein, 8 aa, Influenza virus
FYKILKIR

SEQ ID NO: 267017 - protein, 8 aa, Influenza virus
YKILKIRK

SEQ ID NO: 267018 - protein, 8 aa, Influenza virus
KILKIRKG

SEQ ID NO: 267019 - protein, 8 aa, Influenza virus
ILKIRKGK

SEQ ID NO: 267020 - protein, 8 aa, Influenza virus
LKIRKGKI

SEQ ID NO: 267021 - protein, 8 aa, Influenza virus
KIRKGKIV

SEQ ID NO: 267022 - protein, 8 aa, Influenza virus
DVDATGFH

SEQ ID NO: 267023 - protein, 8 aa, Influenza virus
ATGFHFEE

SEQ ID NO: 267024 - protein, 8 aa, Influenza virus
TGFHFEEC

SEQ ID NO: 267025 - protein, 8 aa, Influenza virus
GFHFEECS

SEQ ID NO: 267026 - protein, 8 aa, Influenza virus
FHFEECSC

SEQ ID NO: 267027 - protein, 8 aa, Influenza virus
HFEECSCY

SEQ ID NO: 267028 - protein, 8 aa, Influenza virus
FEECSCYP

SEQ ID NO: 267029 - protein, 8 aa, Influenza virus
EECSCYPS

SEQ ID NO: 267030 - protein, 8 aa, Influenza virus
ECSCYPSG

SEQ ID NO: 267031 - protein, 8 aa, Influenza virus
CSCYPSGT

SEQ ID NO: 267032 - protein, 8 aa, Influenza virus
SCYPSGTD

SEQ ID NO: 267033 - protein, 8 aa, Influenza virus
DIECVCRD

SEQ ID NO: 267034 - protein, 8 aa, Influenza virus
IECVCRDN

SEQ ID NO: 267035 - protein, 8 aa, Influenza virus
ECVCRDNW

SEQ ID NO: 267036 - protein, 8 aa, Influenza virus
CVCRDNWR

SEQ ID NO: 267037 - protein, 8 aa, Influenza virus
VCRDNWRG

SEQ ID NO: 267038 - protein, 8 aa, Influenza virus
CRDNWRGS

SEQ ID NO: 267039 - protein, 8 aa, Influenza virus
RDNWRGSN

SEQ ID NO: 267040 - protein, 8 aa, Influenza virus
DNWRGSNR

SEQ ID NO: 267041 - protein, 8 aa, Influenza virus
NWRGSNRP

SEQ ID NO: 267042 - protein, 8 aa, Influenza virus
WRGSNRPW

SEQ ID NO: 267043 - protein, 8 aa, Influenza virus
RGSNRPWI

SEQ ID NO: 267044 - protein, 8 aa, Influenza virus
GSNRPWIR

SEQ ID NO: 267045 - protein, 8 aa, Influenza virus
SNRPWIRF

SEQ ID NO: 267046 - protein, 8 aa, Influenza virus
NRPWIRFN

SEQ ID NO: 267047 - protein, 8 aa, Influenza virus
RPWIRFNS

SEQ ID NO: 267048 - protein, 8 aa, Influenza virus
PWIRFNSD

SEQ ID NO: 267049 - protein, 8 aa, Influenza virus
WIRFNSDL

SEQ ID NO: 267050 - protein, 8 aa, Influenza virus
IRFNSDLD

SEQ ID NO: 267051 - protein, 8 aa, Influenza virus
RFNSDLDY

SEQ ID NO: 267052 - protein, 8 aa, Influenza virus
FNSDLDYQ

SEQ ID NO: 267053 - protein, 8 aa, Influenza virus
NSDLDYQI

SEQ ID NO: 267054 - protein, 8 aa, Influenza virus
SDLDYQIG

SEQ ID NO: 267055 - protein, 8 aa, Influenza virus
DLDYQIGY

SEQ ID NO: 267056 - protein, 8 aa, Influenza virus
LDYQIGYV

SEQ ID NO: 267057 - protein, 8 aa, Influenza virus
DYQIGYVC

SEQ ID NO: 267058 - protein, 8 aa, Influenza virus
YQIGYVCS

SEQ ID NO: 267059 - protein, 8 aa, Influenza virus
QIGYVCSG

SEQ ID NO: 267060 - protein, 8 aa, Influenza virus
IGYVCSGI

SEQ ID NO: 267061 - protein, 8 aa, Influenza virus
GYVCSGIF

SEQ ID NO: 267062 - protein, 8 aa, Influenza virus
YVCSGIFG

SEQ ID NO: 267063 - protein, 8 aa, Influenza virus
VCSGIFGD

SEQ ID NO: 267064 - protein, 8 aa, Influenza virus
CSGIFGDN

SEQ ID NO: 267065 - protein, 8 aa, Influenza virus
SGIFGDNP

SEQ ID NO: 267066 - protein, 8 aa, Influenza virus
GIFGDNPR

SEQ ID NO: 267067 - protein, 8 aa, Influenza virus
IFGDNPRP

SEQ ID NO: 267068 - protein, 8 aa, Influenza virus
FGDNPRPV

SEQ ID NO: 267069 - protein, 8 aa, Influenza virus
GDNPRPVD

SEQ ID NO: 267070 - protein, 8 aa, Influenza virus
DNPRPVDG

SEQ ID NO: 267071 - protein, 8 aa, Influenza virus
PRPVDGTG

SEQ ID NO: 267072 - protein, 8 aa, Influenza virus
RPVDGTGS

SEQ ID NO: 267073 - protein, 8 aa, Influenza virus
PVDGTGSC

SEQ ID NO: 267074 - protein, 8 aa, Influenza virus
SPVNNGKG

SEQ ID NO: 267075 - protein, 8 aa, Influenza virus
PVNNGKGR

SEQ ID NO: 267076 - protein, 8 aa, Influenza virus
VNNGKGRY

SEQ ID NO: 267077 - protein, 8 aa, Influenza virus
NNGKGRYG

SEQ ID NO: 267078 - protein, 8 aa, Influenza virus
NGKGRYGV

SEQ ID NO: 267079 - protein, 8 aa, Influenza virus
GKGRYGVK

SEQ ID NO: 267080 - protein, 8 aa, Influenza virus
KGRYGVKG

SEQ ID NO: 267081 - protein, 8 aa, Influenza virus
GRYGVKGF

SEQ ID NO: 267082 - protein, 8 aa, Influenza virus
RYGVKGFS

SEQ ID NO: 267083 - protein, 8 aa, Influenza virus
YGVKGFSF

SEQ ID NO: 267084 - protein, 8 aa, Influenza virus
GVKGFSFR

SEQ ID NO: 267085 - protein, 8 aa, Influenza virus
VKGFSFRY

SEQ ID NO: 267086 - protein, 8 aa, Influenza virus
KGFSFRYG

SEQ ID NO: 267087 - protein, 8 aa, Influenza virus
GFSFRYGD

SEQ ID NO: 267088 - protein, 8 aa, Influenza virus
FSFRYGDG

SEQ ID NO: 267089 - protein, 8 aa, Influenza virus
SFRYGDGV

SEQ ID NO: 267090 - protein, 8 aa, Influenza virus
FRYGDGVW

SEQ ID NO: 267091 - protein, 8 aa, Influenza virus
RYGDGVWI

SEQ ID NO: 267092 - protein, 8 aa, Influenza virus
YGDGVWIG

SEQ ID NO: 267093 - protein, 8 aa, Influenza virus
GDGVWIGR

SEQ ID NO: 267094 - protein, 8 aa, Influenza virus
DGVWIGRT

SEQ ID NO: 267095 - protein, 8 aa, Influenza virus
GVWIGRTK

SEQ ID NO: 267096 - protein, 8 aa, Influenza virus
VWIGRTKS

SEQ ID NO: 267097 - protein, 8 aa, Influenza virus
WIGRTKSL

SEQ ID NO: 267098 - protein, 8 aa, Influenza virus
IGRTKSLE

SEQ ID NO: 267099 - protein, 8 aa, Influenza virus
GRTKSLES

SEQ ID NO: 267100 - protein, 8 aa, Influenza virus
RTKSLESR

SEQ ID NO: 267101 - protein, 8 aa, Influenza virus
TKSLESRS

SEQ ID NO: 267102 - protein, 8 aa, Influenza virus
KSLESRSG

SEQ ID NO: 267103 - protein, 8 aa, Influenza virus
SLESRSGF

SEQ ID NO: 267104 - protein, 8 aa, Influenza virus
LESRSGFE

SEQ ID NO: 267105 - protein, 8 aa, Influenza virus
ESRSGFEM

SEQ ID NO: 267106 - protein, 8 aa, Influenza virus
SRSGFEMV

SEQ ID NO: 267107 - protein, 8 aa, Influenza virus
RSGFEMVW

SEQ ID NO: 267108 - protein, 8 aa, Influenza virus
SGFEMVWD

SEQ ID NO: 267109 - protein, 8 aa, Influenza virus
GFEMVWDA

SEQ ID NO: 267110 - protein, 8 aa, Influenza virus
FEMVWDAN

SEQ ID NO: 267111 - protein, 8 aa, Influenza virus
EMVWDANG

SEQ ID NO: 267112 - protein, 8 aa, Influenza virus
MVWDANGW

SEQ ID NO: 267113 - protein, 8 aa, Influenza virus
VWDANGWV

SEQ ID NO: 267114 - protein, 8 aa, Influenza virus
WDANGWVS

SEQ ID NO: 267115 - protein, 8 aa, Influenza virus
DANGWVST

SEQ ID NO: 267116 - protein, 8 aa, Influenza virus
ANGWVSTD

SEQ ID NO: 267117 - protein, 8 aa, Influenza virus
NGWVSTDK

SEQ ID NO: 267118 - protein, 8 aa, Influenza virus
GWVSTDKD

SEQ ID NO: 267119 - protein, 8 aa, Influenza virus
WVSTDKDS

SEQ ID NO: 267120 - protein, 8 aa, Influenza virus
VSTDKDSN

SEQ ID NO: 267121 - protein, 8 aa, Influenza virus
STDKDSNG

SEQ ID NO: 267122 - protein, 8 aa, Influenza virus
TDKDSNGV

SEQ ID NO: 267123 - protein, 8 aa, Influenza virus
DKDSNGVQ

SEQ ID NO: 267124 - protein, 8 aa, Influenza virus
KDSNGVQD

SEQ ID NO: 267125 - protein, 8 aa, Influenza virus
DSNGVQDI

SEQ ID NO: 267126 - protein, 8 aa, Influenza virus
SNGVQDII

SEQ ID NO: 267127 - protein, 8 aa, Influenza virus
NGVQDIID

SEQ ID NO: 267128 - protein, 8 aa, Influenza virus
GVQDIIDN

SEQ ID NO: 267129 - protein, 8 aa, Influenza virus
VQDIIDND

SEQ ID NO: 267130 - protein, 8 aa, Influenza virus
QDIIDNDN

SEQ ID NO: 267131 - protein, 8 aa, Influenza virus
DIIDNDNW

SEQ ID NO: 267132 - protein, 8 aa, Influenza virus
IIDNDNWS

SEQ ID NO: 267133 - protein, 8 aa, Influenza virus
IDNDNWSG

SEQ ID NO: 267134 - protein, 8 aa, Influenza virus
DNDNWSGY

SEQ ID NO: 267135 - protein, 8 aa, Influenza virus
NDNWSGYS

SEQ ID NO: 267136 - protein, 8 aa, Influenza virus
DNWSGYSG

SEQ ID NO: 267137 - protein, 8 aa, Influenza virus
NWSGYSGS

SEQ ID NO: 267138 - protein, 8 aa, Influenza virus
WSGYSGSF

SEQ ID NO: 267139 - protein, 8 aa, Influenza virus
SGYSGSFS

SEQ ID NO: 267140 - protein, 8 aa, Influenza virus
GYSGSFSI

SEQ ID NO: 267141 - protein, 8 aa, Influenza virus
YSGSFSIR

SEQ ID NO: 267142 - protein, 8 aa, Influenza virus
SGSFSIRG

SEQ ID NO: 267143 - protein, 8 aa, Influenza virus
GSFSIRGE

SEQ ID NO: 267144 - protein, 8 aa, Influenza virus
SFSIRGET

SEQ ID NO: 267145 - protein, 8 aa, Influenza virus
FSIRGETT

SEQ ID NO: 267146 - protein, 8 aa, Influenza virus
SIRGETTG

SEQ ID NO: 267147 - protein, 8 aa, Influenza virus
IRGETTGR

SEQ ID NO: 267148 - protein, 8 aa, Influenza virus
RGETTGRN

SEQ ID NO: 267149 - protein, 8 aa, Influenza virus
GETTGRNC

SEQ ID NO: 267150 - protein, 8 aa, Influenza virus
ETTGRNCT

SEQ ID NO: 267151 - protein, 8 aa, Influenza virus
TTGRNCTV

SEQ ID NO: 267152 - protein, 8 aa, Influenza virus
TGRNCTVP

SEQ ID NO: 267153 - protein, 8 aa, Influenza virus
GRNCTVPC

SEQ ID NO: 267154 - protein, 8 aa, Influenza virus
RNCTVPCF

SEQ ID NO: 267155 - protein, 8 aa, Influenza virus
NCTVPCFW

SEQ ID NO: 267156 - protein, 8 aa, Influenza virus
CTVPCFWV

SEQ ID NO: 267157 - protein, 8 aa, Influenza virus
TVPCFWVE

SEQ ID NO: 267158 - protein, 8 aa, Influenza virus
VPCFWVEM

SEQ ID NO: 267159 - protein, 8 aa, Influenza virus
PCFWVEMI

SEQ ID NO: 267160 - protein, 8 aa, Influenza virus
CFWVEMIR

SEQ ID NO: 267161 - protein, 8 aa, Influenza virus
FWVEMIRG

SEQ ID NO: 267162 - protein, 8 aa, Influenza virus
WVEMIRGQ

SEQ ID NO: 267163 - protein, 8 aa, Influenza virus
VEMIRGQP

SEQ ID NO: 267164 - protein, 8 aa, Influenza virus
EMIRGQPK

SEQ ID NO: 267165 - protein, 8 aa, Influenza virus
MIRGQPKE

SEQ ID NO: 267166 - protein, 8 aa, Influenza virus
IRGQPKEK

SEQ ID NO: 267167 - protein, 8 aa, Influenza virus
RGQPKEKT

SEQ ID NO: 267168 - protein, 8 aa, Influenza virus
GQPKEKTI

SEQ ID NO: 267169 - protein, 8 aa, Influenza virus
QPKEKTIW

SEQ ID NO: 267170 - protein, 8 aa, Influenza virus
PKEKTIWT

SEQ ID NO: 267171 - protein, 8 aa, Influenza virus
KEKTIWTS

SEQ ID NO: 267172 - protein, 8 aa, Influenza virus
EKTIWTSG

SEQ ID NO: 267173 - protein, 8 aa, Influenza virus
KTIWTSGS

SEQ ID NO: 267174 - protein, 8 aa, Influenza virus
TIWTSGSS

SEQ ID NO: 267175 - protein, 8 aa, Influenza virus
IWTSGSSI

SEQ ID NO: 267176 - protein, 8 aa, Influenza virus
WTSGSSIA

SEQ ID NO: 267177 - protein, 8 aa, Influenza virus
TSGSSIAF

SEQ ID NO: 267178 - protein, 8 aa, Influenza virus
SGSSIAFC

SEQ ID NO: 267179 - protein, 8 aa, Influenza virus
GSSIAFCG

SEQ ID NO: 267180 - protein, 8 aa, Influenza virus
SSIAFCGV

SEQ ID NO: 267181 - protein, 8 aa, Influenza virus
SIAFCGVN

SEQ ID NO: 267182 - protein, 8 aa, Influenza virus
IAFCGVNS

SEQ ID NO: 267183 - protein, 8 aa, Influenza virus
AFCGVNSD

SEQ ID NO: 267184 - protein, 8 aa, Influenza virus
FCGVNSDT

SEQ ID NO: 267185 - protein, 8 aa, Influenza virus
CGVNSDTT

SEQ ID NO: 267186 - protein, 8 aa, Influenza virus
GVNSDTTG

SEQ ID NO: 267187 - protein, 8 aa, Influenza virus
VNSDTTGW

SEQ ID NO: 267188 - protein, 8 aa, Influenza virus
SDTTGWSW

SEQ ID NO: 267189 - protein, 8 aa, Influenza virus
DTTGWSWP

SEQ ID NO: 267190 - protein, 8 aa, Influenza virus
TTGWSWPD

SEQ ID NO: 267191 - protein, 8 aa, Influenza virus
TGWSWPDG

SEQ ID NO: 267192 - protein, 8 aa, Influenza virus
GWSWPDGA

SEQ ID NO: 267193 - protein, 8 aa, Influenza virus
WSWPDGAL

SEQ ID NO: 267194 - protein, 8 aa, Influenza virus
SWPDGALL

SEQ ID NO: 267195 - protein, 8 aa, Influenza virus
WPDGALLP

SEQ ID NO: 267196 - protein, 8 aa, Influenza virus
PDGALLPF

SEQ ID NO: 267197 - protein, 8 aa, Influenza virus
DGALLPFD

SEQ ID NO: 267198 - protein, 8 aa, Influenza virus
GALLPFDI

SEQ ID NO: 267199 - protein, 8 aa, Influenza virus
ALLPFDID

SEQ ID NO: 267200 - protein, 8 aa, Influenza virus
LLPFDIDK

SEQ ID NO: 267201 - protein, 8 aa, Influenza virus
MNPNQKII

SEQ ID NO: 267202 - protein, 8 aa, Influenza virus
NPNQKIIT

SEQ ID NO: 267203 - protein, 8 aa, Influenza virus
PNQKIITI

SEQ ID NO: 267204 - protein, 8 aa, Influenza virus
NQKIITIG

SEQ ID NO: 267205 - protein, 8 aa, Influenza virus
QKIITIGS

SEQ ID NO: 267206 - protein, 8 aa, Influenza virus
KIITIGSV

SEQ ID NO: 267207 - protein, 8 aa, Influenza virus
IITIGSVS

SEQ ID NO: 267208 - protein, 8 aa, Influenza virus
ITIGSVSL

SEQ ID NO: 267209 - protein, 8 aa, Influenza virus
TIGSVSLA

SEQ ID NO: 267210 - protein, 8 aa, Influenza virus
IGSVSLAL

SEQ ID NO: 267211 - protein, 8 aa, Influenza virus
GSVSLALV

SEQ ID NO: 267212 - protein, 8 aa, Influenza virus
NILLHIAS

SEQ ID NO: 267213 - protein, 8 aa, Influenza virus
ILLHIASI

SEQ ID NO: 267214 - protein, 8 aa, Influenza virus
TTEVYNET

SEQ ID NO: 267215 - protein, 8 aa, Influenza virus
TEVYNETV

SEQ ID NO: 267216 - protein, 8 aa, Influenza virus
EVYNETVR

SEQ ID NO: 267217 - protein, 8 aa, Influenza virus
IYNETVRL

SEQ ID NO: 267218 - protein, 8 aa, Influenza virus
YNETVRLE

SEQ ID NO: 267219 - protein, 8 aa, Influenza virus
NETVRLET

SEQ ID NO: 267220 - protein, 8 aa, Influenza virus
ETVRLETI

SEQ ID NO: 267221 - protein, 8 aa, Influenza virus
ITIPINNT

SEQ ID NO: 267222 - protein, 8 aa, Influenza virus
TIPINNTV

SEQ ID NO: 267223 - protein, 8 aa, Influenza virus
IPINNTVY

SEQ ID NO: 267224 - protein, 8 aa, Influenza virus
EFLNNTEP

SEQ ID NO: 267225 - protein, 8 aa, Influenza virus
FLNNTEPL

SEQ ID NO: 267226 - protein, 8 aa, Influenza virus
LNNTEPLC

SEQ ID NO: 267227 - protein, 8 aa, Influenza virus
NNTEPLCN

SEQ ID NO: 267228 - protein, 8 aa, Influenza virus
NTEPLCNV

SEQ ID NO: 267229 - protein, 8 aa, Influenza virus
TEPLCNVS

SEQ ID NO: 267230 - protein, 8 aa, Influenza virus
EPLCNVSG

SEQ ID NO: 267231 - protein, 8 aa, Influenza virus
PLCNVSGF

SEQ ID NO: 267232 - protein, 8 aa, Influenza virus
LCNVSGFA

SEQ ID NO: 267233 - protein, 8 aa, Influenza virus
CNVSGFAI

SEQ ID NO: 267234 - protein, 8 aa, Influenza virus
SGFAIVSK

SEQ ID NO: 267235 - protein, 8 aa, Influenza virus
GFAIVSKD

SEQ ID NO: 267236 - protein, 8 aa, Influenza virus
FAIVSKDN

SEQ ID NO: 267237 - protein, 8 aa, Influenza virus
AIVSKDNG

SEQ ID NO: 267238 - protein, 8 aa, Influenza virus
IVSKDNGI

SEQ ID NO: 267239 - protein, 8 aa, Influenza virus
VSKDNGIR

SEQ ID NO: 267240 - protein, 8 aa, Influenza virus
SKDNGIRI

SEQ ID NO: 267241 - protein, 8 aa, Influenza virus
KDNGIRIG

SEQ ID NO: 267242 - protein, 8 aa, Influenza virus
DNGIRIGS

SEQ ID NO: 267243 - protein, 8 aa, Influenza virus
NGIRIGSR

SEQ ID NO: 267244 - protein, 8 aa, Influenza virus
GIRIGSRG

SEQ ID NO: 267245 - protein, 8 aa, Influenza virus
IRIGSRGH

SEQ ID NO: 267246 - protein, 8 aa, Influenza virus
RIGSRGHV

SEQ ID NO: 267247 - protein, 8 aa, Influenza virus
IGSRGHVF

SEQ ID NO: 267248 - protein, 8 aa, Influenza virus
GSRGHVFV

SEQ ID NO: 267249 - protein, 8 aa, Influenza virus
SRGHVFVI

SEQ ID NO: 267250 - protein, 8 aa, Influenza virus
RGHVFVIR

SEQ ID NO: 267251 - protein, 8 aa, Influenza virus
GHVFVIRE

SEQ ID NO: 267252 - protein, 8 aa, Influenza virus
HVFVIREP

SEQ ID NO: 267253 - protein, 8 aa, Influenza virus
VFVIREPF

SEQ ID NO: 267254 - protein, 8 aa, Influenza virus
FVIREPFV

SEQ ID NO: 267255 - protein, 8 aa, Influenza virus
VIREPFVA

SEQ ID NO: 267256 - protein, 8 aa, Influenza virus
IREPFVAC

SEQ ID NO: 267257 - protein, 8 aa, Influenza virus
REPFVACG

SEQ ID NO: 267258 - protein, 8 aa, Influenza virus
EPFVACGP

SEQ ID NO: 267259 - protein, 8 aa, Influenza virus
PFVACGPT

SEQ ID NO: 267260 - protein, 8 aa, Influenza virus
FVACGPTE

SEQ ID NO: 267261 - protein, 8 aa, Influenza virus
VACGPTEC

SEQ ID NO: 267262 - protein, 8 aa, Influenza virus
ACGPTECR

SEQ ID NO: 267263 - protein, 8 aa, Influenza virus
CGPTECRT

SEQ ID NO: 267264 - protein, 8 aa, Influenza virus
GPTECRTF

SEQ ID NO: 267265 - protein, 8 aa, Influenza virus
PTECRTFF

SEQ ID NO: 267266 - protein, 8 aa, Influenza virus
TECRTFFL

SEQ ID NO: 267267 - protein, 8 aa, Influenza virus
ECRTFFLT

SEQ ID NO: 267268 - protein, 8 aa, Influenza virus
CRTFFLTQ

SEQ ID NO: 267269 - protein, 8 aa, Influenza virus
RTFFLTQG

SEQ ID NO: 267270 - protein, 8 aa, Influenza virus
TFFLTQGA

SEQ ID NO: 267271 - protein, 8 aa, Influenza virus
FFLTQGAL

SEQ ID NO: 267272 - protein, 8 aa, Influenza virus
FLTQGALL

SEQ ID NO: 267273 - protein, 8 aa, Influenza virus
LTQGALLN

SEQ ID NO: 267274 - protein, 8 aa, Influenza virus
TQGALLND

SEQ ID NO: 267275 - protein, 8 aa, Influenza virus
QGALLNDK

SEQ ID NO: 267276 - protein, 8 aa, Influenza virus
GALLNDKH

SEQ ID NO: 267277 - protein, 8 aa, Influenza virus
ALLNDKHS

SEQ ID NO: 267278 - protein, 8 aa, Influenza virus
LLNDKHSN

SEQ ID NO: 267279 - protein, 8 aa, Influenza virus
LNDKHSNN

SEQ ID NO: 267280 - protein, 8 aa, Influenza virus
NDKHSNNT

SEQ ID NO: 267281 - protein, 8 aa, Influenza virus
DKHSNNTV

SEQ ID NO: 267282 - protein, 8 aa, Influenza virus
KHSNNTVK

SEQ ID NO: 267283 - protein, 8 aa, Influenza virus
HSNNTVKD

SEQ ID NO: 267284 - protein, 8 aa, Influenza virus
SNNTVKDR

SEQ ID NO: 267285 - protein, 8 aa, Influenza virus
NNTVKDRS

SEQ ID NO: 267286 - protein, 8 aa, Influenza virus
NTVKDRSP

SEQ ID NO: 267287 - protein, 8 aa, Influenza virus
TVKDRSPY

SEQ ID NO: 267288 - protein, 8 aa, Influenza virus
VKDRSPYR

SEQ ID NO: 267289 - protein, 8 aa, Influenza virus
KDRSPYRA

SEQ ID NO: 267290 - protein, 8 aa, Influenza virus
DRSPYRAL

SEQ ID NO: 267291 - protein, 8 aa, Influenza virus
RSPYRALM

SEQ ID NO: 267292 - protein, 8 aa, Influenza virus
SPYRALMS

SEQ ID NO: 267293 - protein, 8 aa, Influenza virus
PYRALMSV

SEQ ID NO: 267294 - protein, 8 aa, Influenza virus
YRALMSVP

SEQ ID NO: 267295 - protein, 8 aa, Influenza virus
RALMSVPL

SEQ ID NO: 267296 - protein, 8 aa, Influenza virus
ALMSVPLG

SEQ ID NO: 267297 - protein, 8 aa, Influenza virus
LMSVPLGS

SEQ ID NO: 267298 - protein, 8 aa, Influenza virus
MSVPLGSS

SEQ ID NO: 267299 - protein, 8 aa, Influenza virus
SVPLGSSP

SEQ ID NO: 267300 - protein, 8 aa, Influenza virus
VPLGSSPN

SEQ ID NO: 267301 - protein, 8 aa, Influenza virus
PLGSSPNA

SEQ ID NO: 267302 - protein, 8 aa, Influenza virus
LGSSPNAY

SEQ ID NO: 267303 - protein, 8 aa, Influenza virus
GSSPNAYQ

SEQ ID NO: 267304 - protein, 8 aa, Influenza virus
SSPNAYQA

SEQ ID NO: 267305 - protein, 8 aa, Influenza virus
SPNAYQAK

SEQ ID NO: 267306 - protein, 8 aa, Influenza virus
PNAYQAKF

SEQ ID NO: 267307 - protein, 8 aa, Influenza virus
NAYQAKFE

SEQ ID NO: 267308 - protein, 8 aa, Influenza virus
AYQAKFES

SEQ ID NO: 267309 - protein, 8 aa, Influenza virus
YQAKFESV

SEQ ID NO: 267310 - protein, 8 aa, Influenza virus
FESVAWSA

SEQ ID NO: 267311 - protein, 8 aa, Influenza virus
ESVAWSAT

SEQ ID NO: 267312 - protein, 8 aa, Influenza virus
SVAWSATA

SEQ ID NO: 267313 - protein, 8 aa, Influenza virus
VAWSATAC

SEQ ID NO: 267314 - protein, 8 aa, Influenza virus
AWSATACH

SEQ ID NO: 267315 - protein, 8 aa, Influenza virus
WSATACHD

SEQ ID NO: 267316 - protein, 8 aa, Influenza virus
SATACHDG

SEQ ID NO: 267317 - protein, 8 aa, Influenza virus
ATACHDGK

SEQ ID NO: 267318 - protein, 8 aa, Influenza virus
TACHDGKE

SEQ ID NO: 267319 - protein, 8 aa, Influenza virus
ACHDGKEW

SEQ ID NO: 267320 - protein, 8 aa, Influenza virus
CHDGKEWL

SEQ ID NO: 267321 - protein, 8 aa, Influenza virus
WLAVGISG

SEQ ID NO: 267322 - protein, 8 aa, Influenza virus
GISGADDD

SEQ ID NO: 267323 - protein, 8 aa, Influenza virus
ISGADDDA

SEQ ID NO: 267324 - protein, 8 aa, Influenza virus
SGADDDAY

SEQ ID NO: 267325 - protein, 8 aa, Influenza virus
GADDDAYA

SEQ ID NO: 267326 - protein, 8 aa, Influenza virus
ADDDAYAV

SEQ ID NO: 267327 - protein, 8 aa, Influenza virus
DDDAYAVI

SEQ ID NO: 267328 - protein, 8 aa, Influenza virus
DDAYAVIH

SEQ ID NO: 267329 - protein, 8 aa, Influenza virus
DAYAVIHY

SEQ ID NO: 267330 - protein, 8 aa, Influenza virus
AYAVIHYG

SEQ ID NO: 267331 - protein, 8 aa, Influenza virus
YAVIHYGG

SEQ ID NO: 267332 - protein, 8 aa, Influenza virus
AVIHYGGM

SEQ ID NO: 267333 - protein, 8 aa, Influenza virus
VIHYGGMP

SEQ ID NO: 267334 - protein, 8 aa, Influenza virus
IHYGGMPT

SEQ ID NO: 267335 - protein, 8 aa, Influenza virus
HYGGMPTD

SEQ ID NO: 267336 - protein, 8 aa, Influenza virus
YGGMPTDV

SEQ ID NO: 267337 - protein, 8 aa, Influenza virus
GGMPTDVV

SEQ ID NO: 267338 - protein, 8 aa, Influenza virus
GMPTDVVR

SEQ ID NO: 267339 - protein, 8 aa, Influenza virus
MPTDVVRS

SEQ ID NO: 267340 - protein, 8 aa, Influenza virus
PTDVVRSW

SEQ ID NO: 267341 - protein, 8 aa, Influenza virus
TDVVRSWR

SEQ ID NO: 267342 - protein, 8 aa, Influenza virus
DVVRSWRK

SEQ ID NO: 267343 - protein, 8 aa, Influenza virus
VVRSWRKQ

SEQ ID NO: 267344 - protein, 8 aa, Influenza virus
VRSWRKQI

SEQ ID NO: 267345 - protein, 8 aa, Influenza virus
RSWRKQIL

SEQ ID NO: 267346 - protein, 8 aa, Influenza virus
SWRKQILR

SEQ ID NO: 267347 - protein, 8 aa, Influenza virus
WRKQILRT

SEQ ID NO: 267348 - protein, 8 aa, Influenza virus
RKQILRTQ

SEQ ID NO: 267349 - protein, 8 aa, Influenza virus
KQILRTQE

SEQ ID NO: 267350 - protein, 8 aa, Influenza virus
QILRTQES

SEQ ID NO: 267351 - protein, 8 aa, Influenza virus
ILRTQESS

SEQ ID NO: 267352 - protein, 8 aa, Influenza virus
LRTQESSC

SEQ ID NO: 267353 - protein, 8 aa, Influenza virus
RTQESSCV

SEQ ID NO: 267354 - protein, 8 aa, Influenza virus
TQESSCVC

SEQ ID NO: 267355 - protein, 8 aa, Influenza virus
QESSCVCM

SEQ ID NO: 267356 - protein, 8 aa, Influenza virus
ESSCVCMK

SEQ ID NO: 267357 - protein, 8 aa, Influenza virus
SSCVCMKG

SEQ ID NO: 267358 - protein, 8 aa, Influenza virus
CYWVMTDG

SEQ ID NO: 267359 - protein, 8 aa, Influenza virus
YWVMTDGP

SEQ ID NO: 267360 - protein, 8 aa, Influenza virus
WVMTDGPA

SEQ ID NO: 267361 - protein, 8 aa, Influenza virus
VMTDGPAN

SEQ ID NO: 267362 - protein, 8 aa, Influenza virus
MTDGPANN

SEQ ID NO: 267363 - protein, 8 aa, Influenza virus
TDGPANNQ

SEQ ID NO: 267364 - protein, 8 aa, Influenza virus
DGPANNQA

SEQ ID NO: 267365 - protein, 8 aa, Influenza virus
GPANNQAS

SEQ ID NO: 267366 - protein, 8 aa, Influenza virus
PANNQASY

SEQ ID NO: 267367 - protein, 8 aa, Influenza virus
ANNQASYK

SEQ ID NO: 267368 - protein, 8 aa, Influenza virus
NNQASYKI

SEQ ID NO: 267369 - protein, 8 aa, Influenza virus
NQASYKIF

SEQ ID NO: 267370 - protein, 8 aa, Influenza virus
QASYKIFK

SEQ ID NO: 267371 - protein, 8 aa, Influenza virus
ASYKIFKS

SEQ ID NO: 267372 - protein, 8 aa, Influenza virus
SYKIFKSH

SEQ ID NO: 267373 - protein, 8 aa, Influenza virus
EVSFQGGH

SEQ ID NO: 267374 - protein, 8 aa, Influenza virus
VSFQGGHI

SEQ ID NO: 267375 - protein, 8 aa, Influenza virus
SFQGGHIE

SEQ ID NO: 267376 - protein, 8 aa, Influenza virus
FQGGHIEE

SEQ ID NO: 267377 - protein, 8 aa, Influenza virus
QGGHIEEC

SEQ ID NO: 267378 - protein, 8 aa, Influenza virus
GGHIEECS

SEQ ID NO: 267379 - protein, 8 aa, Influenza virus
GHIEECSC

SEQ ID NO: 267380 - protein, 8 aa, Influenza virus
HIEECSCY

SEQ ID NO: 267381 - protein, 8 aa, Influenza virus
IEECSCYP

SEQ ID NO: 267382 - protein, 8 aa, Influenza virus
EECSCYPN

SEQ ID NO: 267383 - protein, 8 aa, Influenza virus
ECSCYPNL

SEQ ID NO: 267384 - protein, 8 aa, Influenza virus
CSCYPNLG

SEQ ID NO: 267385 - protein, 8 aa, Influenza virus
SCYPNLGK

SEQ ID NO: 267386 - protein, 8 aa, Influenza virus
CYPNLGKV

SEQ ID NO: 267387 - protein, 8 aa, Influenza virus
YPNLGKVE

SEQ ID NO: 267388 - protein, 8 aa, Influenza virus
PNLGKVEC

SEQ ID NO: 267389 - protein, 8 aa, Influenza virus
NLGKVECV

SEQ ID NO: 267390 - protein, 8 aa, Influenza virus
LGKVECVC

SEQ ID NO: 267391 - protein, 8 aa, Influenza virus
GKVECVCR

SEQ ID NO: 267392 - protein, 8 aa, Influenza virus
KVECVCRD

SEQ ID NO: 267393 - protein, 8 aa, Influenza virus
VECVCRDN

SEQ ID NO: 267394 - protein, 8 aa, Influenza virus
ECVCRDNW

SEQ ID NO: 267395 - protein, 8 aa, Influenza virus
CVCRDNWN

SEQ ID NO: 267396 - protein, 8 aa, Influenza virus
VCRDNWNG

SEQ ID NO: 267397 - protein, 8 aa, Influenza virus
CRDNWNGM

SEQ ID NO: 267398 - protein, 8 aa, Influenza virus
RDNWNGMN

SEQ ID NO: 267399 - protein, 8 aa, Influenza virus
DNWNGMNR

SEQ ID NO: 267400 - protein, 8 aa, Influenza virus
NWNGMNRP

SEQ ID NO: 267401 - protein, 8 aa, Influenza virus
WNGMNRPI

SEQ ID NO: 267402 - protein, 8 aa, Influenza virus
NGMNRPIL

SEQ ID NO: 267403 - protein, 8 aa, Influenza virus
YEVGYLCA

SEQ ID NO: 267404 - protein, 8 aa, Influenza virus
EVGYLCAG

SEQ ID NO: 267405 - protein, 8 aa, Influenza virus
VGYLCAGI

SEQ ID NO: 267406 - protein, 8 aa, Influenza virus
GYLCAGIP

SEQ ID NO: 267407 - protein, 8 aa, Influenza virus
YLCAGIPT

SEQ ID NO: 267408 - protein, 8 aa, Influenza virus
LCAGIPTD

SEQ ID NO: 267409 - protein, 8 aa, Influenza virus
CAGIPTDT

SEQ ID NO: 267410 - protein, 8 aa, Influenza virus
AGIPTDTP

SEQ ID NO: 267411 - protein, 8 aa, Influenza virus
GIPTDTPR

SEQ ID NO: 267412 - protein, 8 aa, Influenza virus
IPTDTPRV

SEQ ID NO: 267413 - protein, 8 aa, Influenza virus
PTDTPRVQ

SEQ ID NO: 267414 - protein, 8 aa, Influenza virus
TDTPRVQD

SEQ ID NO: 267415 - protein, 8 aa, Influenza virus
DTPRVQDS

SEQ ID NO: 267416 - protein, 8 aa, Influenza virus
NAVGGSGT

SEQ ID NO: 267417 - protein, 8 aa, Influenza virus
AVGGSGTN

SEQ ID NO: 267418 - protein, 8 aa, Influenza virus
VGGSGTNN

SEQ ID NO: 267419 - protein, 8 aa, Influenza virus
GGSGTNNY

SEQ ID NO: 267420 - protein, 8 aa, Influenza virus
GSGTNNYG

SEQ ID NO: 267421 - protein, 8 aa, Influenza virus
SGTNNYGV

SEQ ID NO: 267422 - protein, 8 aa, Influenza virus
GTNNYGVK

SEQ ID NO: 267423 - protein, 8 aa, Influenza virus
TNNYGVKG

SEQ ID NO: 267424 - protein, 8 aa, Influenza virus
NNYGVKGF

SEQ ID NO: 267425 - protein, 8 aa, Influenza virus
NYGVKGFG

SEQ ID NO: 267426 - protein, 8 aa, Influenza virus
YGVKGFGF

SEQ ID NO: 267427 - protein, 8 aa, Influenza virus
GVKGFGFR

SEQ ID NO: 267428 - protein, 8 aa, Influenza virus
VKGFGFRQ

SEQ ID NO: 267429 - protein, 8 aa, Influenza virus
KGFGFRQG

SEQ ID NO: 267430 - protein, 8 aa, Influenza virus
GFGFRQGN

SEQ ID NO: 267431 - protein, 8 aa, Influenza virus
FGFRQGNS

SEQ ID NO: 267432 - protein, 8 aa, Influenza virus
GFRQGNSV

SEQ ID NO: 267433 - protein, 8 aa, Influenza virus
FRQGNSVW

SEQ ID NO: 267434 - protein, 8 aa, Influenza virus
RQGNSVWA

SEQ ID NO: 267435 - protein, 8 aa, Influenza virus
QGNSVWAG

SEQ ID NO: 267436 - protein, 8 aa, Influenza virus
GNSVWAGR

SEQ ID NO: 267437 - protein, 8 aa, Influenza virus
NSVWAGRT

SEQ ID NO: 267438 - protein, 8 aa, Influenza virus
SVWAGRTV

SEQ ID NO: 267439 - protein, 8 aa, Influenza virus
VWAGRTVS

SEQ ID NO: 267440 - protein, 8 aa, Influenza virus
SISSRSGF

SEQ ID NO: 267441 - protein, 8 aa, Influenza virus
ISSRSGFE

SEQ ID NO: 267442 - protein, 8 aa, Influenza virus
SSRSGFEI

SEQ ID NO: 267443 - protein, 8 aa, Influenza virus
SRSGFEIL

SEQ ID NO: 267444 - protein, 8 aa, Influenza virus
RSGFEILL

SEQ ID NO: 267445 - protein, 8 aa, Influenza virus
SGFEILLI

SEQ ID NO: 267446 - protein, 8 aa, Influenza virus
GFEILLIE

SEQ ID NO: 267447 - protein, 8 aa, Influenza virus
FEILLIED

SEQ ID NO: 267448 - protein, 8 aa, Influenza virus
EILLIEDG

SEQ ID NO: 267449 - protein, 8 aa, Influenza virus
ILLIEDGW

SEQ ID NO: 267450 - protein, 8 aa, Influenza virus
EVLNNKNW

SEQ ID NO: 267451 - protein, 8 aa, Influenza virus
VLNNKNWS

SEQ ID NO: 267452 - protein, 8 aa, Influenza virus
LNNKNWSG

SEQ ID NO: 267453 - protein, 8 aa, Influenza virus
NNKNWSGY

SEQ ID NO: 267454 - protein, 8 aa, Influenza virus
NKNWSGYS

SEQ ID NO: 267455 - protein, 8 aa, Influenza virus
KNWSGYSG

SEQ ID NO: 267456 - protein, 8 aa, Influenza virus
NWSGYSGA

SEQ ID NO: 267457 - protein, 8 aa, Influenza virus
WSGYSGAF

SEQ ID NO: 267458 - protein, 8 aa, Influenza virus
SGYSGAFT

SEQ ID NO: 267459 - protein, 8 aa, Influenza virus
GYSGAFTI

SEQ ID NO: 267460 - protein, 8 aa, Influenza virus
YSGAFTIP

SEQ ID NO: 267461 - protein, 8 aa, Influenza virus
SGAFTIPI

SEQ ID NO: 267462 - protein, 8 aa, Influenza virus
FTIPITMT

SEQ ID NO: 267463 - protein, 8 aa, Influenza virus
CLVPCFWL

SEQ ID NO: 267464 - protein, 8 aa, Influenza virus
LVPCFWLE

SEQ ID NO: 267465 - protein, 8 aa, Influenza virus
VPCFWLEM

SEQ ID NO: 267466 - protein, 8 aa, Influenza virus
PCFWLEMI

SEQ ID NO: 267467 - protein, 8 aa, Influenza virus
CFWLEMIR

SEQ ID NO: 267468 - protein, 8 aa, Influenza virus
FWLEMIRG

SEQ ID NO: 267469 - protein, 8 aa, Influenza virus
WLEMIRGK

SEQ ID NO: 267470 - protein, 8 aa, Influenza virus
LEMIRGKP

SEQ ID NO: 267471 - protein, 8 aa, Influenza virus
EMIRGKPE

SEQ ID NO: 267472 - protein, 8 aa, Influenza virus
MIRGKPEE

SEQ ID NO: 267473 - protein, 8 aa, Influenza virus
IRGKPEER

SEQ ID NO: 267474 - protein, 8 aa, Influenza virus
PEERTSIW

SEQ ID NO: 267475 - protein, 8 aa, Influenza virus
EERTSIWT

SEQ ID NO: 267476 - protein, 8 aa, Influenza virus
ERTSIWTS

SEQ ID NO: 267477 - protein, 8 aa, Influenza virus
RTSIWTSS

SEQ ID NO: 267478 - protein, 8 aa, Influenza virus
TSIWTSSS

SEQ ID NO: 267479 - protein, 8 aa, Influenza virus
SIWTSSSS

SEQ ID NO: 267480 - protein, 8 aa, Influenza virus
IWTSSSST

SEQ ID NO: 267481 - protein, 8 aa, Influenza virus
WTSSSSTV

SEQ ID NO: 267482 - protein, 8 aa, Influenza virus
TSSSSTVF

SEQ ID NO: 267483 - protein, 8 aa, Influenza virus
SSSSTVFC

SEQ ID NO: 267484 - protein, 8 aa, Influenza virus
SSSTVFCG

SEQ ID NO: 267485 - protein, 8 aa, Influenza virus
SSTVFCGV

SEQ ID NO: 267486 - protein, 8 aa, Influenza virus
STVFCGVS

SEQ ID NO: 267487 - protein, 8 aa, Influenza virus
TVFCGVSS

SEQ ID NO: 267488 - protein, 8 aa, Influenza virus
VFCGVSSE

SEQ ID NO: 267489 - protein, 8 aa, Influenza virus
FCGVSSEV

SEQ ID NO: 267490 - protein, 8 aa, Influenza virus
CGVSSEVP

SEQ ID NO: 267491 - protein, 8 aa, Influenza virus
GVSSEVPG

SEQ ID NO: 267492 - protein, 8 aa, Influenza virus
VSSEVPGW

SEQ ID NO: 267493 - protein, 8 aa, Influenza virus
SSEVPGWS

SEQ ID NO: 267494 - protein, 8 aa, Influenza virus
SEVPGWSW

SEQ ID NO: 267495 - protein, 8 aa, Influenza virus
EVPGWSWD

SEQ ID NO: 267496 - protein, 8 aa, Influenza virus
VPGWSWDD

SEQ ID NO: 267497 - protein, 8 aa, Influenza virus
PGWSWDDG

SEQ ID NO: 267498 - protein, 8 aa, Influenza virus
GWSWDDGA

SEQ ID NO: 267499 - protein, 8 aa, Influenza virus
WSWDDGAI

SEQ ID NO: 267500 - protein, 8 aa, Influenza virus
SWDDGAIL

SEQ ID NO: 267501 - protein, 8 aa, Influenza virus
WDDGAILP

SEQ ID NO: 267502 - protein, 8 aa, Influenza virus
DDGAILPF

SEQ ID NO: 267503 - protein, 8 aa, Influenza virus
DGAILPFD

SEQ ID NO: 267504 - protein, 8 aa, Influenza virus
GAILPFDI

SEQ ID NO: 267505 - protein, 8 aa, Influenza virus
AILPFDID

SEQ ID NO: 267506 - protein, 8 aa, Influenza virus
ILPFDIDK

SEQ ID NO: 267507 - protein, 8 aa, Influenza virus
LPFDIDKM

SEQ ID NO: 267508 - protein, 8 aa, Influenza virus
MNPNQKII

SEQ ID NO: 267509 - protein, 8 aa, Influenza virus
NPNQKIIC

SEQ ID NO: 267510 - protein, 8 aa, Influenza virus
PNQKIICI

SEQ ID NO: 267511 - protein, 8 aa, Influenza virus
NQKIICIS

SEQ ID NO: 267512 - protein, 8 aa, Influenza virus
QKIICISA

SEQ ID NO: 267513 - protein, 8 aa, Influenza virus
IICISATG

SEQ ID NO: 267514 - protein, 8 aa, Influenza virus
CISATGMT

SEQ ID NO: 267515 - protein, 8 aa, Influenza virus
ISATGMTL

SEQ ID NO: 267516 - protein, 8 aa, Influenza virus
SATGMTLS

SEQ ID NO: 267517 - protein, 8 aa, Influenza virus
ATGMTLSV

SEQ ID NO: 267518 - protein, 8 aa, Influenza virus
TGMTLSVV

SEQ ID NO: 267519 - protein, 8 aa, Influenza virus
GMTLSVVS

SEQ ID NO: 267520 - protein, 8 aa, Influenza virus
MTLSVVSL

SEQ ID NO: 267521 - protein, 8 aa, Influenza virus
TLSVVSLL

SEQ ID NO: 267522 - protein, 8 aa, Influenza virus
LSVVSLLI

SEQ ID NO: 267523 - protein, 8 aa, Influenza virus
SVVSLLIG

SEQ ID NO: 267524 - protein, 8 aa, Influenza virus
GLANLGLN

SEQ ID NO: 267525 - protein, 8 aa, Influenza virus
LANLGLNI

SEQ ID NO: 267526 - protein, 8 aa, Influenza virus
ANLGLNIG

SEQ ID NO: 267527 - protein, 8 aa, Influenza virus
NLGLNIGL

SEQ ID NO: 267528 - protein, 8 aa, Influenza virus
LGLNIGLH

SEQ ID NO: 267529 - protein, 8 aa, Influenza virus
TTTTIINN

SEQ ID NO: 267530 - protein, 8 aa, Influenza virus
LSKPLCEV

SEQ ID NO: 267531 - protein, 8 aa, Influenza virus
KPLCEVNS

SEQ ID NO: 267532 - protein, 8 aa, Influenza virus
PLCEVNSW

SEQ ID NO: 267533 - protein, 8 aa, Influenza virus
LCEVNSWH

SEQ ID NO: 267534 - protein, 8 aa, Influenza virus
CEVNSWHI

SEQ ID NO: 267535 - protein, 8 aa, Influenza virus
EVNSWHIL

SEQ ID NO: 267536 - protein, 8 aa, Influenza virus
VNSWHILS

SEQ ID NO: 267537 - protein, 8 aa, Influenza virus
NSWHILSK

SEQ ID NO: 267538 - protein, 8 aa, Influenza virus
SWHILSKD

SEQ ID NO: 267539 - protein, 8 aa, Influenza virus
WHILSKDN

SEQ ID NO: 267540 - protein, 8 aa, Influenza virus
HILSKDNA

SEQ ID NO: 267541 - protein, 8 aa, Influenza virus
ILSKDNAI

SEQ ID NO: 267542 - protein, 8 aa, Influenza virus
LSKDNAIR

SEQ ID NO: 267543 - protein, 8 aa, Influenza virus
SKDNAIRI

SEQ ID NO: 267544 - protein, 8 aa, Influenza virus
KDNAIRIG

SEQ ID NO: 267545 - protein, 8 aa, Influenza virus
DNAIRIGE

SEQ ID NO: 267546 - protein, 8 aa, Influenza virus
NAIRIGED

SEQ ID NO: 267547 - protein, 8 aa, Influenza virus
AIRIGEDA

SEQ ID NO: 267548 - protein, 8 aa, Influenza virus
IRIGEDAH

SEQ ID NO: 267549 - protein, 8 aa, Influenza virus
RIGEDAHI

SEQ ID NO: 267550 - protein, 8 aa, Influenza virus
IGEDAHIL

SEQ ID NO: 267551 - protein, 8 aa, Influenza virus
DAHILVTR

SEQ ID NO: 267552 - protein, 8 aa, Influenza virus
AHILVTRE

SEQ ID NO: 267553 - protein, 8 aa, Influenza virus
HILVTREP

SEQ ID NO: 267554 - protein, 8 aa, Influenza virus
ILVTREPY

SEQ ID NO: 267555 - protein, 8 aa, Influenza virus
LVTREPYL

SEQ ID NO: 267556 - protein, 8 aa, Influenza virus
VTREPYLS

SEQ ID NO: 267557 - protein, 8 aa, Influenza virus
TREPYLSC

SEQ ID NO: 267558 - protein, 8 aa, Influenza virus
REPYLSCG

SEQ ID NO: 267559 - protein, 8 aa, Influenza virus
EPYLSCGP

SEQ ID NO: 267560 - protein, 8 aa, Influenza virus
ECRMFALS

SEQ ID NO: 267561 - protein, 8 aa, Influenza virus
CRMFALSQ

SEQ ID NO: 267562 - protein, 8 aa, Influenza virus
RMFALSQG

SEQ ID NO: 267563 - protein, 8 aa, Influenza virus
MFALSQGT

SEQ ID NO: 267564 - protein, 8 aa, Influenza virus
FALSQGTT

SEQ ID NO: 267565 - protein, 8 aa, Influenza virus
ALSQGTTL

SEQ ID NO: 267566 - protein, 8 aa, Influenza virus
LSQGTTLR

SEQ ID NO: 267567 - protein, 8 aa, Influenza virus
SQGTTLRG

SEQ ID NO: 267568 - protein, 8 aa, Influenza virus
QGTTLRGR

SEQ ID NO: 267569 - protein, 8 aa, Influenza virus
GTTLRGRH

SEQ ID NO: 267570 - protein, 8 aa, Influenza virus
TTLRGRHA

SEQ ID NO: 267571 - protein, 8 aa, Influenza virus
TLRGRHAN

SEQ ID NO: 267572 - protein, 8 aa, Influenza virus
LRGRHANG

SEQ ID NO: 267573 - protein, 8 aa, Influenza virus
RGRHANGT

SEQ ID NO: 267574 - protein, 8 aa, Influenza virus
GRHANGTI

SEQ ID NO: 267575 - protein, 8 aa, Influenza virus
RHANGTIH

SEQ ID NO: 267576 - protein, 8 aa, Influenza virus
HANGTIHD

SEQ ID NO: 267577 - protein, 8 aa, Influenza virus
ANGTIHDR

SEQ ID NO: 267578 - protein, 8 aa, Influenza virus
NGTIHDRS

SEQ ID NO: 267579 - protein, 8 aa, Influenza virus
GTIHDRSP

SEQ ID NO: 267580 - protein, 8 aa, Influenza virus
TIHDRSPF

SEQ ID NO: 267581 - protein, 8 aa, Influenza virus
IHDRSPFR

SEQ ID NO: 267582 - protein, 8 aa, Influenza virus
HDRSPFRA

SEQ ID NO: 267583 - protein, 8 aa, Influenza virus
DRSPFRAL

SEQ ID NO: 267584 - protein, 8 aa, Influenza virus
RSPFRALI

SEQ ID NO: 267585 - protein, 8 aa, Influenza virus
SPFRALIS

SEQ ID NO: 267586 - protein, 8 aa, Influenza virus
PFRALISW

SEQ ID NO: 267587 - protein, 8 aa, Influenza virus
FRALISWE

SEQ ID NO: 267588 - protein, 8 aa, Influenza virus
RALISWEM

SEQ ID NO: 267589 - protein, 8 aa, Influenza virus
ALISWEMG

SEQ ID NO: 267590 - protein, 8 aa, Influenza virus
LISWEMGQ

SEQ ID NO: 267591 - protein, 8 aa, Influenza virus
ISWEMGQA

SEQ ID NO: 267592 - protein, 8 aa, Influenza virus
SWEMGQAP

SEQ ID NO: 267593 - protein, 8 aa, Influenza virus
WEMGQAPS

SEQ ID NO: 267594 - protein, 8 aa, Influenza virus
EMGQAPSP

SEQ ID NO: 267595 - protein, 8 aa, Influenza virus
MGQAPSPY

SEQ ID NO: 267596 - protein, 8 aa, Influenza virus
GQAPSPYN

SEQ ID NO: 267597 - protein, 8 aa, Influenza virus
VECVGWSS

SEQ ID NO: 267598 - protein, 8 aa, Influenza virus
ECVGWSST

SEQ ID NO: 267599 - protein, 8 aa, Influenza virus
CVGWSSTS

SEQ ID NO: 267600 - protein, 8 aa, Influenza virus
VGWSSTSC

SEQ ID NO: 267601 - protein, 8 aa, Influenza virus
GWSSTSCH

SEQ ID NO: 267602 - protein, 8 aa, Influenza virus
WSSTSCHD

SEQ ID NO: 267603 - protein, 8 aa, Influenza virus
SSTSCHDG

SEQ ID NO: 267604 - protein, 8 aa, Influenza virus
STSCHDGI

SEQ ID NO: 267605 - protein, 8 aa, Influenza virus
TSCHDGIS

SEQ ID NO: 267606 - protein, 8 aa, Influenza virus
SCHDGISR

SEQ ID NO: 267607 - protein, 8 aa, Influenza virus
CHDGISRM

SEQ ID NO: 267608 - protein, 8 aa, Influenza virus
HDGISRMS

SEQ ID NO: 267609 - protein, 8 aa, Influenza virus
SRMSICMS

SEQ ID NO: 267610 - protein, 8 aa, Influenza virus
RMSICMSG

SEQ ID NO: 267611 - protein, 8 aa, Influenza virus
MSICMSGP

SEQ ID NO: 267612 - protein, 8 aa, Influenza virus
SICMSGPN

SEQ ID NO: 267613 - protein, 8 aa, Influenza virus
ICMSGPNN

SEQ ID NO: 267614 - protein, 8 aa, Influenza virus
CMSGPNNN

SEQ ID NO: 267615 - protein, 8 aa, Influenza virus
MSGPNNNA

SEQ ID NO: 267616 - protein, 8 aa, Influenza virus
SGPNNNAS

SEQ ID NO: 267617 - protein, 8 aa, Influenza virus
GPNNNASA

SEQ ID NO: 267618 - protein, 8 aa, Influenza virus
PNNNASAV

SEQ ID NO: 267619 - protein, 8 aa, Influenza virus
NNNASAVV

SEQ ID NO: 267620 - protein, 8 aa, Influenza virus
NNASAVVW

SEQ ID NO: 267621 - protein, 8 aa, Influenza virus
NASAVVWY

SEQ ID NO: 267622 - protein, 8 aa, Influenza virus
TEIASWAG

SEQ ID NO: 267623 - protein, 8 aa, Influenza virus
EIASWAGN

SEQ ID NO: 267624 - protein, 8 aa, Influenza virus
IASWAGNI

SEQ ID NO: 267625 - protein, 8 aa, Influenza virus
ASWAGNIL

SEQ ID NO: 267626 - protein, 8 aa, Influenza virus
SWAGNILR

SEQ ID NO: 267627 - protein, 8 aa, Influenza virus
WAGNILRT

SEQ ID NO: 267628 - protein, 8 aa, Influenza virus
AGNILRTQ

SEQ ID NO: 267629 - protein, 8 aa, Influenza virus
GNILRTQE

SEQ ID NO: 267630 - protein, 8 aa, Influenza virus
NILRTQES

SEQ ID NO: 267631 - protein, 8 aa, Influenza virus
ILRTQESE

SEQ ID NO: 267632 - protein, 8 aa, Influenza virus
LRTQESEC

SEQ ID NO: 267633 - protein, 8 aa, Influenza virus
RTQESECV

SEQ ID NO: 267634 - protein, 8 aa, Influenza virus
TQESECVC

SEQ ID NO: 267635 - protein, 8 aa, Influenza virus
QESECVCH

SEQ ID NO: 267636 - protein, 8 aa, Influenza virus
ESECVCHN

SEQ ID NO: 267637 - protein, 8 aa, Influenza virus
SECVCHNG

SEQ ID NO: 267638 - protein, 8 aa, Influenza virus
ECVCHNGI

SEQ ID NO: 267639 - protein, 8 aa, Influenza virus
CVCHNGIC

SEQ ID NO: 267640 - protein, 8 aa, Influenza virus
VCHNGICP

SEQ ID NO: 267641 - protein, 8 aa, Influenza virus
CHNGICPV

SEQ ID NO: 267642 - protein, 8 aa, Influenza virus
HNGICPVV

SEQ ID NO: 267643 - protein, 8 aa, Influenza virus
GICPVVMT

SEQ ID NO: 267644 - protein, 8 aa, Influenza virus
ICPVVMTD

SEQ ID NO: 267645 - protein, 8 aa, Influenza virus
CPVVMTDG

SEQ ID NO: 267646 - protein, 8 aa, Influenza virus
PVVMTDGP

SEQ ID NO: 267647 - protein, 8 aa, Influenza virus
VVMTDGPA

SEQ ID NO: 267648 - protein, 8 aa, Influenza virus
VMTDGPAN

SEQ ID NO: 267649 - protein, 8 aa, Influenza virus
MTDGPANN

SEQ ID NO: 267650 - protein, 8 aa, Influenza virus
TDGPANNR

SEQ ID NO: 267651 - protein, 8 aa, Influenza virus
DGPANNRA

SEQ ID NO: 267652 - protein, 8 aa, Influenza virus
GSAQHIEE

SEQ ID NO: 267653 - protein, 8 aa, Influenza virus
SAQHIEEC

SEQ ID NO: 267654 - protein, 8 aa, Influenza virus
AQHIEECS

SEQ ID NO: 267655 - protein, 8 aa, Influenza virus
QHIEECSC

SEQ ID NO: 267656 - protein, 8 aa, Influenza virus
HIEECSCY

SEQ ID NO: 267657 - protein, 8 aa, Influenza virus
IEECSCYG

SEQ ID NO: 267658 - protein, 8 aa, Influenza virus
EECSCYGA

SEQ ID NO: 267659 - protein, 8 aa, Influenza virus
IKCICRDN

SEQ ID NO: 267660 - protein, 8 aa, Influenza virus
KCICRDNW

SEQ ID NO: 267661 - protein, 8 aa, Influenza virus
CICRDNWK

SEQ ID NO: 267662 - protein, 8 aa, Influenza virus
ICRDNWKG

SEQ ID NO: 267663 - protein, 8 aa, Influenza virus
CRDNWKGA

SEQ ID NO: 267664 - protein, 8 aa, Influenza virus
RDNWKGAN

SEQ ID NO: 267665 - protein, 8 aa, Influenza virus
DNWKGANR

SEQ ID NO: 267666 - protein, 8 aa, Influenza virus
NWKGANRP

SEQ ID NO: 267667 - protein, 8 aa, Influenza virus
WKGANRPV

SEQ ID NO: 267668 - protein, 8 aa, Influenza virus
KGANRPVI

SEQ ID NO: 267669 - protein, 8 aa, Influenza virus
GANRPVIT

SEQ ID NO: 267670 - protein, 8 aa, Influenza virus
ANRPVITI

SEQ ID NO: 267671 - protein, 8 aa, Influenza virus
NRPVITIN

SEQ ID NO: 267672 - protein, 8 aa, Influenza virus
MTHTSKYL

SEQ ID NO: 267673 - protein, 8 aa, Influenza virus
THTSKYLC

SEQ ID NO: 267674 - protein, 8 aa, Influenza virus
HTSKYLCS

SEQ ID NO: 267675 - protein, 8 aa, Influenza virus
YLCSKILT

SEQ ID NO: 267676 - protein, 8 aa, Influenza virus
LCSKILTD

SEQ ID NO: 267677 - protein, 8 aa, Influenza virus
CSKILTDT

SEQ ID NO: 267678 - protein, 8 aa, Influenza virus
SKILTDTS

SEQ ID NO: 267679 - protein, 8 aa, Influenza virus
KILTDTSR

SEQ ID NO: 267680 - protein, 8 aa, Influenza virus
ILTDTSRP

SEQ ID NO: 267681 - protein, 8 aa, Influenza virus
LTDTSRPN

SEQ ID NO: 267682 - protein, 8 aa, Influenza virus
TDTSRPND

SEQ ID NO: 267683 - protein, 8 aa, Influenza virus
DTSRPNDP

SEQ ID NO: 267684 - protein, 8 aa, Influenza virus
GGSPDPGV

SEQ ID NO: 267685 - protein, 8 aa, Influenza virus
GSPDPGVK

SEQ ID NO: 267686 - protein, 8 aa, Influenza virus
SPDPGVKG

SEQ ID NO: 267687 - protein, 8 aa, Influenza virus
PDPGVKGF

SEQ ID NO: 267688 - protein, 8 aa, Influenza virus
DPGVKGFA

SEQ ID NO: 267689 - protein, 8 aa, Influenza virus
PGVKGFAF

SEQ ID NO: 267690 - protein, 8 aa, Influenza virus
GVKGFAFL

SEQ ID NO: 267691 - protein, 8 aa, Influenza virus
VKGFAFLD

SEQ ID NO: 267692 - protein, 8 aa, Influenza virus
KGFAFLDG

SEQ ID NO: 267693 - protein, 8 aa, Influenza virus
GNSWLGRT

SEQ ID NO: 267694 - protein, 8 aa, Influenza virus
NSWLGRTI

SEQ ID NO: 267695 - protein, 8 aa, Influenza virus
SWLGRTIS

SEQ ID NO: 267696 - protein, 8 aa, Influenza virus
WLGRTISK

SEQ ID NO: 267697 - protein, 8 aa, Influenza virus
LGRTISKD

SEQ ID NO: 267698 - protein, 8 aa, Influenza virus
GRTISKDS

SEQ ID NO: 267699 - protein, 8 aa, Influenza virus
RTISKDSR

SEQ ID NO: 267700 - protein, 8 aa, Influenza virus
TISKDSRS

SEQ ID NO: 267701 - protein, 8 aa, Influenza virus
ISKDSRSG

SEQ ID NO: 267702 - protein, 8 aa, Influenza virus
SKDSRSGY

SEQ ID NO: 267703 - protein, 8 aa, Influenza virus
KDSRSGYE

SEQ ID NO: 267704 - protein, 8 aa, Influenza virus
DSRSGYEM

SEQ ID NO: 267705 - protein, 8 aa, Influenza virus
SRSGYEML

SEQ ID NO: 267706 - protein, 8 aa, Influenza virus
RSGYEMLK

SEQ ID NO: 267707 - protein, 8 aa, Influenza virus
SGYEMLKV

SEQ ID NO: 267708 - protein, 8 aa, Influenza virus
GYEMLKVP

SEQ ID NO: 267709 - protein, 8 aa, Influenza virus
YEMLKVPN

SEQ ID NO: 267710 - protein, 8 aa, Influenza virus
EMLKVPNA

SEQ ID NO: 267711 - protein, 8 aa, Influenza virus
MLKVPNAE

SEQ ID NO: 267712 - protein, 8 aa, Influenza virus
LKVPNAET

SEQ ID NO: 267713 - protein, 8 aa, Influenza virus
IVNNQNWS

SEQ ID NO: 267714 - protein, 8 aa, Influenza virus
VNNQNWSG

SEQ ID NO: 267715 - protein, 8 aa, Influenza virus
NNQNWSGY

SEQ ID NO: 267716 - protein, 8 aa, Influenza virus
NQNWSGYS

SEQ ID NO: 267717 - protein, 8 aa, Influenza virus
QNWSGYSG

SEQ ID NO: 267718 - protein, 8 aa, Influenza virus
NWSGYSGA

SEQ ID NO: 267719 - protein, 8 aa, Influenza virus
WSGYSGAF

SEQ ID NO: 267720 - protein, 8 aa, Influenza virus
SGYSGAFI

SEQ ID NO: 267721 - protein, 8 aa, Influenza virus
GYSGAFID

SEQ ID NO: 267722 - protein, 8 aa, Influenza virus
YSGAFIDY

SEQ ID NO: 267723 - protein, 8 aa, Influenza virus
SGAFIDYW

SEQ ID NO: 267724 - protein, 8 aa, Influenza virus
RECFNPCF

SEQ ID NO: 267725 - protein, 8 aa, Influenza virus
ECFNPCFY

SEQ ID NO: 267726 - protein, 8 aa, Influenza virus
CFNPCFYV

SEQ ID NO: 267727 - protein, 8 aa, Influenza virus
FNPCFYVE

SEQ ID NO: 267728 - protein, 8 aa, Influenza virus
NPCFYVEL

SEQ ID NO: 267729 - protein, 8 aa, Influenza virus
PCFYVELI

SEQ ID NO: 267730 - protein, 8 aa, Influenza virus
CFYVELIR

SEQ ID NO: 267731 - protein, 8 aa, Influenza virus
FYVELIRG

SEQ ID NO: 267732 - protein, 8 aa, Influenza virus
YVELIRGR

SEQ ID NO: 267733 - protein, 8 aa, Influenza virus
VELIRGRP

SEQ ID NO: 267734 - protein, 8 aa, Influenza virus
ELIRGRPK

SEQ ID NO: 267735 - protein, 8 aa, Influenza virus
LIRGRPKE

SEQ ID NO: 267736 - protein, 8 aa, Influenza virus
IRGRPKES

SEQ ID NO: 267737 - protein, 8 aa, Influenza virus
ESSVLWTS

SEQ ID NO: 267738 - protein, 8 aa, Influenza virus
SSVLWTSN

SEQ ID NO: 267739 - protein, 8 aa, Influenza virus
SVLWTSNS

SEQ ID NO: 267740 - protein, 8 aa, Influenza virus
VLWTSNSI

SEQ ID NO: 267741 - protein, 8 aa, Influenza virus
LWTSNSIV

SEQ ID NO: 267742 - protein, 8 aa, Influenza virus
WTSNSIVA

SEQ ID NO: 267743 - protein, 8 aa, Influenza virus
TSNSIVAL

SEQ ID NO: 267744 - protein, 8 aa, Influenza virus
SNSIVALC

SEQ ID NO: 267745 - protein, 8 aa, Influenza virus
NSIVALCG

SEQ ID NO: 267746 - protein, 8 aa, Influenza virus
SIVALCGS

SEQ ID NO: 267747 - protein, 8 aa, Influenza virus
IVALCGSK

SEQ ID NO: 267748 - protein, 8 aa, Influenza virus
VALCGSKE

SEQ ID NO: 267749 - protein, 8 aa, Influenza virus
ALCGSKER

SEQ ID NO: 267750 - protein, 8 aa, Influenza virus
LCGSKERL

SEQ ID NO: 267751 - protein, 8 aa, Influenza virus
CGSKERLG

SEQ ID NO: 267752 - protein, 8 aa, Influenza virus
GSKERLGS

SEQ ID NO: 267753 - protein, 8 aa, Influenza virus
SKERLGSW

SEQ ID NO: 267754 - protein, 8 aa, Influenza virus
KERLGSWS

SEQ ID NO: 267755 - protein, 8 aa, Influenza virus
ERLGSWSW

SEQ ID NO: 267756 - protein, 8 aa, Influenza virus
RLGSWSWH

SEQ ID NO: 267757 - protein, 8 aa, Influenza virus
LGSWSWHD

SEQ ID NO: 267758 - protein, 8 aa, Influenza virus
GSWSWHDG

SEQ ID NO: 267759 - protein, 8 aa, Influenza virus
SWSWHDGA

SEQ ID NO: 267760 - protein, 8 aa, Influenza virus
WSWHDGAE

SEQ ID NO: 267761 - protein, 8 aa, Influenza virus
SWHDGAEI

SEQ ID NO: 267762 - protein, 8 aa, Influenza virus
WHDGAEII

SEQ ID NO: 267763 - protein, 8 aa, Influenza virus
HDGAEIIY

SEQ ID NO: 267764 - protein, 8 aa, Influenza virus
DGAEIIYF

SEQ ID NO: 267765 - protein, 8 aa, Influenza virus
GAEIIYFK

SEQ ID NO: 267766 - protein, 8 aa, Influenza virus
MNPNQKLF

SEQ ID NO: 267767 - protein, 8 aa, Influenza virus
NPNQKLFA

SEQ ID NO: 267768 - protein, 8 aa, Influenza virus
PNQKLFAL

SEQ ID NO: 267769 - protein, 8 aa, Influenza virus
NQKLFALS

SEQ ID NO: 267770 - protein, 8 aa, Influenza virus
QKLFALSG

SEQ ID NO: 267771 - protein, 8 aa, Influenza virus
KLFALSGV

SEQ ID NO: 267772 - protein, 8 aa, Influenza virus
LFALSGVA

SEQ ID NO: 267773 - protein, 8 aa, Influenza virus
FALSGVAI

SEQ ID NO: 267774 - protein, 8 aa, Influenza virus
LNLLIGIS

SEQ ID NO: 267775 - protein, 8 aa, Influenza virus
NLLIGISN

SEQ ID NO: 267776 - protein, 8 aa, Influenza virus
LLIGISNV

SEQ ID NO: 267777 - protein, 8 aa, Influenza virus
LIGISNVG

SEQ ID NO: 267778 - protein, 8 aa, Influenza virus
IGISNVGL

SEQ ID NO: 267779 - protein, 8 aa, Influenza virus
GISNVGLN

SEQ ID NO: 267780 - protein, 8 aa, Influenza virus
SNVGLNVS

SEQ ID NO: 267781 - protein, 8 aa, Influenza virus
NVGLNVSL

SEQ ID NO: 267782 - protein, 8 aa, Influenza virus
VGLNVSLH

SEQ ID NO: 267783 - protein, 8 aa, Influenza virus
GLNVSLHL

SEQ ID NO: 267784 - protein, 8 aa, Influenza virus
LNVSLHLK

SEQ ID NO: 267785 - protein, 8 aa, Influenza virus
ENTYVNNT

SEQ ID NO: 267786 - protein, 8 aa, Influenza virus
NTYVNNTT

SEQ ID NO: 267787 - protein, 8 aa, Influenza virus
TYVNNTTV

SEQ ID NO: 267788 - protein, 8 aa, Influenza virus
YVNNTTVI

SEQ ID NO: 267789 - protein, 8 aa, Influenza virus
YLMLNKSL

SEQ ID NO: 267790 - protein, 8 aa, Influenza virus
LMLNKSLC

SEQ ID NO: 267791 - protein, 8 aa, Influenza virus
MLNKSLCK

SEQ ID NO: 267792 - protein, 8 aa, Influenza virus
LNKSLCKV

SEQ ID NO: 267793 - protein, 8 aa, Influenza virus
LCKVEGWV

SEQ ID NO: 267794 - protein, 8 aa, Influenza virus
GWVVVAKD

SEQ ID NO: 267795 - protein, 8 aa, Influenza virus
WVVVAKDN

SEQ ID NO: 267796 - protein, 8 aa, Influenza virus
VVVAKDNA

SEQ ID NO: 267797 - protein, 8 aa, Influenza virus
VVAKDNAI

SEQ ID NO: 267798 - protein, 8 aa, Influenza virus
VAKDNAIR

SEQ ID NO: 267799 - protein, 8 aa, Influenza virus
AKDNAIRF

SEQ ID NO: 267800 - protein, 8 aa, Influenza virus
KDNAIRFG

SEQ ID NO: 267801 - protein, 8 aa, Influenza virus
DNAIRFGE

SEQ ID NO: 267802 - protein, 8 aa, Influenza virus
NAIRFGES

SEQ ID NO: 267803 - protein, 8 aa, Influenza virus
AIRFGESE

SEQ ID NO: 267804 - protein, 8 aa, Influenza virus
IRFGESEQ

SEQ ID NO: 267805 - protein, 8 aa, Influenza virus
RFGESEQI

SEQ ID NO: 267806 - protein, 8 aa, Influenza virus
FGESEQII

SEQ ID NO: 267807 - protein, 8 aa, Influenza virus
GESEQIIV

SEQ ID NO: 267808 - protein, 8 aa, Influenza virus
ESEQIIVT

SEQ ID NO: 267809 - protein, 8 aa, Influenza virus
SEQIIVTR

SEQ ID NO: 267810 - protein, 8 aa, Influenza virus
EQIIVTRE

SEQ ID NO: 267811 - protein, 8 aa, Influenza virus
QIIVTREP

SEQ ID NO: 267812 - protein, 8 aa, Influenza virus
IIVTREPY

SEQ ID NO: 267813 - protein, 8 aa, Influenza virus
IVTREPYV

SEQ ID NO: 267814 - protein, 8 aa, Influenza virus
VTREPYVS

SEQ ID NO: 267815 - protein, 8 aa, Influenza virus
TREPYVSC

SEQ ID NO: 267816 - protein, 8 aa, Influenza virus
REPYVSCD

SEQ ID NO: 267817 - protein, 8 aa, Influenza virus
EPYVSCDP

SEQ ID NO: 267818 - protein, 8 aa, Influenza virus
PYVSCDPL

SEQ ID NO: 267819 - protein, 8 aa, Influenza virus
GCKMYALH

SEQ ID NO: 267820 - protein, 8 aa, Influenza virus
CKMYALHQ

SEQ ID NO: 267821 - protein, 8 aa, Influenza virus
KMYALHQG

SEQ ID NO: 267822 - protein, 8 aa, Influenza virus
MYALHQGT

SEQ ID NO: 267823 - protein, 8 aa, Influenza virus
YALHQGTT

SEQ ID NO: 267824 - protein, 8 aa, Influenza virus
ALHQGTTI

SEQ ID NO: 267825 - protein, 8 aa, Influenza virus
LHQGTTIR

SEQ ID NO: 267826 - protein, 8 aa, Influenza virus
HQGTTIRN

SEQ ID NO: 267827 - protein, 8 aa, Influenza virus
QGTTIRNK

SEQ ID NO: 267828 - protein, 8 aa, Influenza virus
GTTIRNKH

SEQ ID NO: 267829 - protein, 8 aa, Influenza virus
TTIRNKHS

SEQ ID NO: 267830 - protein, 8 aa, Influenza virus
TIRNKHSN

SEQ ID NO: 267831 - protein, 8 aa, Influenza virus
IRNKHSNG

SEQ ID NO: 267832 - protein, 8 aa, Influenza virus
RNKHSNGT

SEQ ID NO: 267833 - protein, 8 aa, Influenza virus
NKHSNGTI

SEQ ID NO: 267834 - protein, 8 aa, Influenza virus
KHSNGTIH

SEQ ID NO: 267835 - protein, 8 aa, Influenza virus
HSNGTIHD

SEQ ID NO: 267836 - protein, 8 aa, Influenza virus
SNGTIHDR

SEQ ID NO: 267837 - protein, 8 aa, Influenza virus
NGTIHDRT

SEQ ID NO: 267838 - protein, 8 aa, Influenza virus
TIHDRTAF

SEQ ID NO: 267839 - protein, 8 aa, Influenza virus
IHDRTAFR

SEQ ID NO: 267840 - protein, 8 aa, Influenza virus
HDRTAFRG

SEQ ID NO: 267841 - protein, 8 aa, Influenza virus
DRTAFRGL

SEQ ID NO: 267842 - protein, 8 aa, Influenza virus
RTAFRGLI

SEQ ID NO: 267843 - protein, 8 aa, Influenza virus
TAFRGLIS

SEQ ID NO: 267844 - protein, 8 aa, Influenza virus
AFRGLIST

SEQ ID NO: 267845 - protein, 8 aa, Influenza virus
FRGLISTP

SEQ ID NO: 267846 - protein, 8 aa, Influenza virus
RGLISTPL

SEQ ID NO: 267847 - protein, 8 aa, Influenza virus
GLISTPLG

SEQ ID NO: 267848 - protein, 8 aa, Influenza virus
STPLGSPP

SEQ ID NO: 267849 - protein, 8 aa, Influenza virus
SNSDFLCV

SEQ ID NO: 267850 - protein, 8 aa, Influenza virus
NSDFLCVG

SEQ ID NO: 267851 - protein, 8 aa, Influenza virus
SDFLCVGW

SEQ ID NO: 267852 - protein, 8 aa, Influenza virus
DFLCVGWS

SEQ ID NO: 267853 - protein, 8 aa, Influenza virus
FLCVGWSS

SEQ ID NO: 267854 - protein, 8 aa, Influenza virus
LCVGWSST

SEQ ID NO: 267855 - protein, 8 aa, Influenza virus
CVGWSSTS

SEQ ID NO: 267856 - protein, 8 aa, Influenza virus
VGWSSTSC

SEQ ID NO: 267857 - protein, 8 aa, Influenza virus
GWSSTSCH

SEQ ID NO: 267858 - protein, 8 aa, Influenza virus
WSSTSCHD

SEQ ID NO: 267859 - protein, 8 aa, Influenza virus
SSTSCHDG

SEQ ID NO: 267860 - protein, 8 aa, Influenza virus
STSCHDGI

SEQ ID NO: 267861 - protein, 8 aa, Influenza virus
CHDGIGRM

SEQ ID NO: 267862 - protein, 8 aa, Influenza virus
HDGIGRMT

SEQ ID NO: 267863 - protein, 8 aa, Influenza virus
DGIGRMTI

SEQ ID NO: 267864 - protein, 8 aa, Influenza virus
GIGRMTIC

SEQ ID NO: 267865 - protein, 8 aa, Influenza virus
GRMTICVQ

SEQ ID NO: 267866 - protein, 8 aa, Influenza virus
RMTICVQG

SEQ ID NO: 267867 - protein, 8 aa, Influenza virus
MTICVQGN

SEQ ID NO: 267868 - protein, 8 aa, Influenza virus
TICVQGNN

SEQ ID NO: 267869 - protein, 8 aa, Influenza virus
QGNNDNAT

SEQ ID NO: 267870 - protein, 8 aa, Influenza virus
GNNDNATA

SEQ ID NO: 267871 - protein, 8 aa, Influenza virus
NNDNATAT

SEQ ID NO: 267872 - protein, 8 aa, Influenza virus
NDNATATV

SEQ ID NO: 267873 - protein, 8 aa, Influenza virus
DNATATVY

SEQ ID NO: 267874 - protein, 8 aa, Influenza virus
NATATVYY

SEQ ID NO: 267875 - protein, 8 aa, Influenza virus
ATATVYYD

SEQ ID NO: 267876 - protein, 8 aa, Influenza virus
TATVYYDR

SEQ ID NO: 267877 - protein, 8 aa, Influenza virus
ATVYYDRR

SEQ ID NO: 267878 - protein, 8 aa, Influenza virus
TVYYDRRL

SEQ ID NO: 267879 - protein, 8 aa, Influenza virus
VYYDRRLT

SEQ ID NO: 267880 - protein, 8 aa, Influenza virus
YYDRRLTT

SEQ ID NO: 267881 - protein, 8 aa, Influenza virus
YDRRLTTT

SEQ ID NO: 267882 - protein, 8 aa, Influenza virus
DRRLTTTI

SEQ ID NO: 267883 - protein, 8 aa, Influenza virus
RRLTTTIK

SEQ ID NO: 267884 - protein, 8 aa, Influenza virus
RLTTTIKT

SEQ ID NO: 267885 - protein, 8 aa, Influenza virus
LTTTIKTW

SEQ ID NO: 267886 - protein, 8 aa, Influenza virus
TTTIKTWA

SEQ ID NO: 267887 - protein, 8 aa, Influenza virus
TTIKTWAG

SEQ ID NO: 267888 - protein, 8 aa, Influenza virus
TIKTWAGN

SEQ ID NO: 267889 - protein, 8 aa, Influenza virus
IKTWAGNI

SEQ ID NO: 267890 - protein, 8 aa, Influenza virus
KTWAGNIL

SEQ ID NO: 267891 - protein, 8 aa, Influenza virus
TWAGNILR

SEQ ID NO: 267892 - protein, 8 aa, Influenza virus
WAGNILRT

SEQ ID NO: 267893 - protein, 8 aa, Influenza virus
AGNILRTQ

SEQ ID NO: 267894 - protein, 8 aa, Influenza virus
GNILRTQE

SEQ ID NO: 267895 - protein, 8 aa, Influenza virus
NILRTQES

SEQ ID NO: 267896 - protein, 8 aa, Influenza virus
ILRTQESE

SEQ ID NO: 267897 - protein, 8 aa, Influenza virus
LRTQESEC

SEQ ID NO: 267898 - protein, 8 aa, Influenza virus
RTQESECV

SEQ ID NO: 267899 - protein, 8 aa, Influenza virus
TQESECVC

SEQ ID NO: 267900 - protein, 8 aa, Influenza virus
QESECVCH

SEQ ID NO: 267901 - protein, 8 aa, Influenza virus
ESECVCHN

SEQ ID NO: 267902 - protein, 8 aa, Influenza virus
SECVCHNG

SEQ ID NO: 267903 - protein, 8 aa, Influenza virus
ECVCHNGT

SEQ ID NO: 267904 - protein, 8 aa, Influenza virus
CVCHNGTC

SEQ ID NO: 267905 - protein, 8 aa, Influenza virus
VCHNGTCV

SEQ ID NO: 267906 - protein, 8 aa, Influenza virus
GTCVVIMT

SEQ ID NO: 267907 - protein, 8 aa, Influenza virus
TCVVIMTD

SEQ ID NO: 267908 - protein, 8 aa, Influenza virus
CVVIMTDG

SEQ ID NO: 267909 - protein, 8 aa, Influenza virus
VIMTDGSA

SEQ ID NO: 267910 - protein, 8 aa, Influenza virus
IMTDGSAS

SEQ ID NO: 267911 - protein, 8 aa, Influenza virus
MTDGSASS

SEQ ID NO: 267912 - protein, 8 aa, Influenza virus
TDGSASSQ

SEQ ID NO: 267913 - protein, 8 aa, Influenza virus
DGSASSQA

SEQ ID NO: 267914 - protein, 8 aa, Influenza virus
ASSQAYTK

SEQ ID NO: 267915 - protein, 8 aa, Influenza virus
LKGSARHI

SEQ ID NO: 267916 - protein, 8 aa, Influenza virus
KGSARHIE

SEQ ID NO: 267917 - protein, 8 aa, Influenza virus
GSARHIEE

SEQ ID NO: 267918 - protein, 8 aa, Influenza virus
SARHIEEC

SEQ ID NO: 267919 - protein, 8 aa, Influenza virus
ARHIEECS

SEQ ID NO: 267920 - protein, 8 aa, Influenza virus
RHIEECSC

SEQ ID NO: 267921 - protein, 8 aa, Influenza virus
HIEECSCY

SEQ ID NO: 267922 - protein, 8 aa, Influenza virus
IEECSCYG

SEQ ID NO: 267923 - protein, 8 aa, Influenza virus
EECSCYGH

SEQ ID NO: 267924 - protein, 8 aa, Influenza virus
ECSCYGHN

SEQ ID NO: 267925 - protein, 8 aa, Influenza virus
KVTCVCRD

SEQ ID NO: 267926 - protein, 8 aa, Influenza virus
VTCVCRDN

SEQ ID NO: 267927 - protein, 8 aa, Influenza virus
TCVCRDNW

SEQ ID NO: 267928 - protein, 8 aa, Influenza virus
CVCRDNWQ

SEQ ID NO: 267929 - protein, 8 aa, Influenza virus
VCRDNWQG

SEQ ID NO: 267930 - protein, 8 aa, Influenza virus
CRDNWQGA

SEQ ID NO: 267931 - protein, 8 aa, Influenza virus
RDNWQGAN

SEQ ID NO: 267932 - protein, 8 aa, Influenza virus
DNWQGANR

SEQ ID NO: 267933 - protein, 8 aa, Influenza virus
NWQGANRP

SEQ ID NO: 267934 - protein, 8 aa, Influenza virus
WQGANRPV

SEQ ID NO: 267935 - protein, 8 aa, Influenza virus
QGANRPVI

SEQ ID NO: 267936 - protein, 8 aa, Influenza virus
GANRPVIE

SEQ ID NO: 267937 - protein, 8 aa, Influenza virus
ANRPVIEI

SEQ ID NO: 267938 - protein, 8 aa, Influenza virus
NRPVIEID

SEQ ID NO: 267939 - protein, 8 aa, Influenza virus
RPVIEIDM

SEQ ID NO: 267940 - protein, 8 aa, Influenza virus
HTSQYLCT

SEQ ID NO: 267941 - protein, 8 aa, Influenza virus
TSQYLCTG

SEQ ID NO: 267942 - protein, 8 aa, Influenza virus
CTGVLTDT

SEQ ID NO: 267943 - protein, 8 aa, Influenza virus
TGVLTDTS

SEQ ID NO: 267944 - protein, 8 aa, Influenza virus
GVLTDTSR

SEQ ID NO: 267945 - protein, 8 aa, Influenza virus
VLTDTSRP

SEQ ID NO: 267946 - protein, 8 aa, Influenza virus
LTDTSRPS

SEQ ID NO: 267947 - protein, 8 aa, Influenza virus
TDTSRPSD

SEQ ID NO: 267948 - protein, 8 aa, Influenza virus
DTSRPSDK

SEQ ID NO: 267949 - protein, 8 aa, Influenza virus
GDCNNPIT

SEQ ID NO: 267950 - protein, 8 aa, Influenza virus
DCNNPITG

SEQ ID NO: 267951 - protein, 8 aa, Influenza virus
CNNPITGS

SEQ ID NO: 267952 - protein, 8 aa, Influenza virus
NNPITGSP

SEQ ID NO: 267953 - protein, 8 aa, Influenza virus
NPITGSPG

SEQ ID NO: 267954 - protein, 8 aa, Influenza virus
PITGSPGA

SEQ ID NO: 267955 - protein, 8 aa, Influenza virus
ITGSPGAP

SEQ ID NO: 267956 - protein, 8 aa, Influenza virus
TGSPGAPG

SEQ ID NO: 267957 - protein, 8 aa, Influenza virus
APGVKGFG

SEQ ID NO: 267958 - protein, 8 aa, Influenza virus
PGVKGFGF

SEQ ID NO: 267959 - protein, 8 aa, Influenza virus
GVKGFGFL

SEQ ID NO: 267960 - protein, 8 aa, Influenza virus
VKGFGFLD

SEQ ID NO: 267961 - protein, 8 aa, Influenza virus
KGFGFLDS

SEQ ID NO: 267962 - protein, 8 aa, Influenza virus
GNTWLGRT

SEQ ID NO: 267963 - protein, 8 aa, Influenza virus
NTWLGRTI

SEQ ID NO: 267964 - protein, 8 aa, Influenza virus
TWLGRTIS

SEQ ID NO: 267965 - protein, 8 aa, Influenza virus
WLGRTISP

SEQ ID NO: 267966 - protein, 8 aa, Influenza virus
LGRTISPR

SEQ ID NO: 267967 - protein, 8 aa, Influenza virus
GRTISPRS

SEQ ID NO: 267968 - protein, 8 aa, Influenza virus
RTISPRSR

SEQ ID NO: 267969 - protein, 8 aa, Influenza virus
TISPRSRS

SEQ ID NO: 267970 - protein, 8 aa, Influenza virus
ISPRSRSG

SEQ ID NO: 267971 - protein, 8 aa, Influenza virus
SPRSRSGF

SEQ ID NO: 267972 - protein, 8 aa, Influenza virus
PRSRSGFE

SEQ ID NO: 267973 - protein, 8 aa, Influenza virus
RSRSGFEM

SEQ ID NO: 267974 - protein, 8 aa, Influenza virus
SRSGFEML

SEQ ID NO: 267975 - protein, 8 aa, Influenza virus
RSGFEMLK

SEQ ID NO: 267976 - protein, 8 aa, Influenza virus
SGFEMLKI

SEQ ID NO: 267977 - protein, 8 aa, Influenza virus
GFEMLKIP

SEQ ID NO: 267978 - protein, 8 aa, Influenza virus
FEMLKIPN

SEQ ID NO: 267979 - protein, 8 aa, Influenza virus
EMLKIPNA

SEQ ID NO: 267980 - protein, 8 aa, Influenza virus
MLKIPNAG

SEQ ID NO: 267981 - protein, 8 aa, Influenza virus
LKIPNAGT

SEQ ID NO: 267982 - protein, 8 aa, Influenza virus
KIPNAGTD

SEQ ID NO: 267983 - protein, 8 aa, Influenza virus
IPNAGTDP

SEQ ID NO: 267984 - protein, 8 aa, Influenza virus
ERQEIVDN

SEQ ID NO: 267985 - protein, 8 aa, Influenza virus
NWSGYSGS

SEQ ID NO: 267986 - protein, 8 aa, Influenza virus
WSGYSGSF

SEQ ID NO: 267987 - protein, 8 aa, Influenza virus
SGYSGSFI

SEQ ID NO: 267988 - protein, 8 aa, Influenza virus
GYSGSFID

SEQ ID NO: 267989 - protein, 8 aa, Influenza virus
YSGSFIDY

SEQ ID NO: 267990 - protein, 8 aa, Influenza virus
SGSFIDYW

SEQ ID NO: 267991 - protein, 8 aa, Influenza virus
GSFIDYWD

SEQ ID NO: 267992 - protein, 8 aa, Influenza virus
SFIDYWDE

SEQ ID NO: 267993 - protein, 8 aa, Influenza virus
SECYNPCF

SEQ ID NO: 267994 - protein, 8 aa, Influenza virus
ECYNPCFY

SEQ ID NO: 267995 - protein, 8 aa, Influenza virus
CYNPCFYV

SEQ ID NO: 267996 - protein, 8 aa, Influenza virus
YNPCFYVE

SEQ ID NO: 267997 - protein, 8 aa, Influenza virus
NPCFYVEL

SEQ ID NO: 267998 - protein, 8 aa, Influenza virus
PCFYVELI

SEQ ID NO: 267999 - protein, 8 aa, Influenza virus
CFYVELIR

SEQ ID NO: 268000 - protein, 8 aa, Influenza virus
FYVELIRG

SEQ ID NO: 268001 - protein, 8 aa, Influenza virus
YVELIRGR

SEQ ID NO: 268002 - protein, 8 aa, Influenza virus
VELIRGRP

SEQ ID NO: 268003 - protein, 8 aa, Influenza virus
ELIRGRPE

SEQ ID NO: 268004 - protein, 8 aa, Influenza virus
LIRGRPEE

SEQ ID NO: 268005 - protein, 8 aa, Influenza virus
IRGRPEEA

SEQ ID NO: 268006 - protein, 8 aa, Influenza virus
RGRPEEAK

SEQ ID NO: 268007 - protein, 8 aa, Influenza virus
GRPEEAKY

SEQ ID NO: 268008 - protein, 8 aa, Influenza virus
RPEEAKYV

SEQ ID NO: 268009 - protein, 8 aa, Influenza virus
PEEAKYVW

SEQ ID NO: 268010 - protein, 8 aa, Influenza virus
EEAKYVWW

SEQ ID NO: 268011 - protein, 8 aa, Influenza virus
EAKYVWWT

SEQ ID NO: 268012 - protein, 8 aa, Influenza virus
AKYVWWTS

SEQ ID NO: 268013 - protein, 8 aa, Influenza virus
KYVWWTSN

SEQ ID NO: 268014 - protein, 8 aa, Influenza virus
YVWWTSNS

SEQ ID NO: 268015 - protein, 8 aa, Influenza virus
VWWTSNSL

SEQ ID NO: 268016 - protein, 8 aa, Influenza virus
WWTSNSLV

SEQ ID NO: 268017 - protein, 8 aa, Influenza virus
WTSNSLVA

SEQ ID NO: 268018 - protein, 8 aa, Influenza virus
TSNSLVAL

SEQ ID NO: 268019 - protein, 8 aa, Influenza virus
SNSLVALC

SEQ ID NO: 268020 - protein, 8 aa, Influenza virus
NSLVALCG

SEQ ID NO: 268021 - protein, 8 aa, Influenza virus
SLVALCGS

SEQ ID NO: 268022 - protein, 8 aa, Influenza virus
LVALCGSP

SEQ ID NO: 268023 - protein, 8 aa, Influenza virus
VALCGSPI

SEQ ID NO: 268024 - protein, 8 aa, Influenza virus
SVGSGSFP

SEQ ID NO: 268025 - protein, 8 aa, Influenza virus
VGSGSFPD

SEQ ID NO: 268026 - protein, 8 aa, Influenza virus
GSGSFPDG

SEQ ID NO: 268027 - protein, 8 aa, Influenza virus
SGSFPDGA

SEQ ID NO: 268028 - protein, 8 aa, Influenza virus
GSFPDGAQ

SEQ ID NO: 268029 - protein, 8 aa, Influenza virus
SFPDGAQI

SEQ ID NO: 268030 - protein, 8 aa, Influenza virus
FPDGAQIQ

SEQ ID NO: 268031 - protein, 8 aa, Influenza virus
PDGAQIQY

SEQ ID NO: 268032 - protein, 8 aa, Influenza virus
DGAQIQYF

SEQ ID NO: 268033 - protein, 8 aa, Influenza virus
GAQIQYFS

SEQ ID NO: 268034 - protein, 8 aa, Influenza virus
REYNETVR

SEQ ID NO: 268035 - protein, 8 aa, Influenza virus
EYNETVRV

SEQ ID NO: 268036 - protein, 8 aa, Influenza virus
YNETVRVE

SEQ ID NO: 268037 - protein, 8 aa, Influenza virus
KGFAPFSK

SEQ ID NO: 268038 - protein, 8 aa, Influenza virus
GFAPFSKD

SEQ ID NO: 268039 - protein, 8 aa, Influenza virus
FAPFSKDN

SEQ ID NO: 268040 - protein, 8 aa, Influenza virus
APFSKDNG

SEQ ID NO: 268041 - protein, 8 aa, Influenza virus
PFSKDNGI

SEQ ID NO: 268042 - protein, 8 aa, Influenza virus
FSKDNGIR

SEQ ID NO: 268043 - protein, 8 aa, Influenza virus
SKDNGIRI

SEQ ID NO: 268044 - protein, 8 aa, Influenza virus
KDNGIRIG

SEQ ID NO: 268045 - protein, 8 aa, Influenza virus
DNGIRIGS

SEQ ID NO: 268046 - protein, 8 aa, Influenza virus
NGIRIGSR

SEQ ID NO: 268047 - protein, 8 aa, Influenza virus
GIRIGSRG

SEQ ID NO: 268048 - protein, 8 aa, Influenza virus
IRIGSRGH

SEQ ID NO: 268049 - protein, 8 aa, Influenza virus
RIGSRGHV

SEQ ID NO: 268050 - protein, 8 aa, Influenza virus
IGSRGHVF

SEQ ID NO: 268051 - protein, 8 aa, Influenza virus
GSRGHVFV

SEQ ID NO: 268052 - protein, 8 aa, Influenza virus
SRGHVFVI

SEQ ID NO: 268053 - protein, 8 aa, Influenza virus
RGHVFVIR

SEQ ID NO: 268054 - protein, 8 aa, Influenza virus
GHVFVIRE

SEQ ID NO: 268055 - protein, 8 aa, Influenza virus
HVFVIREP

SEQ ID NO: 268056 - protein, 8 aa, Influenza virus
VFVIREPF

SEQ ID NO: 268057 - protein, 8 aa, Influenza virus
FVIREPFV

SEQ ID NO: 268058 - protein, 8 aa, Influenza virus
VIREPFVS

SEQ ID NO: 268059 - protein, 8 aa, Influenza virus
IREPFVSC

SEQ ID NO: 268060 - protein, 8 aa, Influenza virus
REPFVSCS

SEQ ID NO: 268061 - protein, 8 aa, Influenza virus
EPFVSCSP

SEQ ID NO: 268062 - protein, 8 aa, Influenza virus
ECRTFFLT

SEQ ID NO: 268063 - protein, 8 aa, Influenza virus
CRTFFLTQ

SEQ ID NO: 268064 - protein, 8 aa, Influenza virus
RTFFLTQG

SEQ ID NO: 268065 - protein, 8 aa, Influenza virus
TFFLTQGS

SEQ ID NO: 268066 - protein, 8 aa, Influenza virus
FFLTQGSL

SEQ ID NO: 268067 - protein, 8 aa, Influenza virus
FLTQGSLL

SEQ ID NO: 268068 - protein, 8 aa, Influenza virus
LTQGSLLN

SEQ ID NO: 268069 - protein, 8 aa, Influenza virus
TQGSLLND

SEQ ID NO: 268070 - protein, 8 aa, Influenza virus
QGSLLNDK

SEQ ID NO: 268071 - protein, 8 aa, Influenza virus
GSLLNDKH

SEQ ID NO: 268072 - protein, 8 aa, Influenza virus
SLLNDKHS

SEQ ID NO: 268073 - protein, 8 aa, Influenza virus
LLNDKHSN

SEQ ID NO: 268074 - protein, 8 aa, Influenza virus
LNDKHSNG

SEQ ID NO: 268075 - protein, 8 aa, Influenza virus
NDKHSNGT

SEQ ID NO: 268076 - protein, 8 aa, Influenza virus
DKHSNGTV

SEQ ID NO: 268077 - protein, 8 aa, Influenza virus
KHSNGTVK

SEQ ID NO: 268078 - protein, 8 aa, Influenza virus
HSNGTVKD

SEQ ID NO: 268079 - protein, 8 aa, Influenza virus
SNGTVKDR

SEQ ID NO: 268080 - protein, 8 aa, Influenza virus
NGTVKDRS

SEQ ID NO: 268081 - protein, 8 aa, Influenza virus
GTVKDRSP

SEQ ID NO: 268082 - protein, 8 aa, Influenza virus
TVKDRSPY

SEQ ID NO: 268083 - protein, 8 aa, Influenza virus
VKDRSPYR

SEQ ID NO: 268084 - protein, 8 aa, Influenza virus
KDRSPYRT

SEQ ID NO: 268085 - protein, 8 aa, Influenza virus
DRSPYRTL

SEQ ID NO: 268086 - protein, 8 aa, Influenza virus
RSPYRTLM

SEQ ID NO: 268087 - protein, 8 aa, Influenza virus
SPYRTLMS

SEQ ID NO: 268088 - protein, 8 aa, Influenza virus
PYRTLMSV

SEQ ID NO: 268089 - protein, 8 aa, Influenza virus
YRTLMSVE

SEQ ID NO: 268090 - protein, 8 aa, Influenza virus
RTLMSVEI

SEQ ID NO: 268091 - protein, 8 aa, Influenza virus
TLMSVEIG

SEQ ID NO: 268092 - protein, 8 aa, Influenza virus
LMSVEIGQ

SEQ ID NO: 268093 - protein, 8 aa, Influenza virus
MSVEIGQS

SEQ ID NO: 268094 - protein, 8 aa, Influenza virus
IGQSPNVY

SEQ ID NO: 268095 - protein, 8 aa, Influenza virus
GQSPNVYQ

SEQ ID NO: 268096 - protein, 8 aa, Influenza virus
QSPNVYQA

SEQ ID NO: 268097 - protein, 8 aa, Influenza virus
SPNVYQAR

SEQ ID NO: 268098 - protein, 8 aa, Influenza virus
PNVYQARF

SEQ ID NO: 268099 - protein, 8 aa, Influenza virus
NVYQARFE

SEQ ID NO: 268100 - protein, 8 aa, Influenza virus
VYQARFEA

SEQ ID NO: 268101 - protein, 8 aa, Influenza virus
YQARFEAV

SEQ ID NO: 268102 - protein, 8 aa, Influenza virus
QARFEAVA

SEQ ID NO: 268103 - protein, 8 aa, Influenza virus
ARFEAVAW

SEQ ID NO: 268104 - protein, 8 aa, Influenza virus
RFEAVAWS

SEQ ID NO: 268105 - protein, 8 aa, Influenza virus
FEAVAWSA

SEQ ID NO: 268106 - protein, 8 aa, Influenza virus
EAVAWSAT

SEQ ID NO: 268107 - protein, 8 aa, Influenza virus
AVAWSATA

SEQ ID NO: 268108 - protein, 8 aa, Influenza virus
VAWSATAC

SEQ ID NO: 268109 - protein, 8 aa, Influenza virus
AWSATACH

SEQ ID NO: 268110 - protein, 8 aa, Influenza virus
WSATACHD

SEQ ID NO: 268111 - protein, 8 aa, Influenza virus
SATACHDG

SEQ ID NO: 268112 - protein, 8 aa, Influenza virus
ATACHDGK

SEQ ID NO: 268113 - protein, 8 aa, Influenza virus
TACHDGKK

SEQ ID NO: 268114 - protein, 8 aa, Influenza virus
ACHDGKKW

SEQ ID NO: 268115 - protein, 8 aa, Influenza virus
CHDGKKWM

SEQ ID NO: 268116 - protein, 8 aa, Influenza virus
HDGKKWMT

SEQ ID NO: 268117 - protein, 8 aa, Influenza virus
KWMTIGVT

SEQ ID NO: 268118 - protein, 8 aa, Influenza virus
WMTIGVTG

SEQ ID NO: 268119 - protein, 8 aa, Influenza virus
TIGVTGPD

SEQ ID NO: 268120 - protein, 8 aa, Influenza virus
SWAGDILR

SEQ ID NO: 268121 - protein, 8 aa, Influenza virus
WAGDILRT

SEQ ID NO: 268122 - protein, 8 aa, Influenza virus
AGDILRTQ

SEQ ID NO: 268123 - protein, 8 aa, Influenza virus
GDILRTQE

SEQ ID NO: 268124 - protein, 8 aa, Influenza virus
DILRTQES

SEQ ID NO: 268125 - protein, 8 aa, Influenza virus
ILRTQESS

SEQ ID NO: 268126 - protein, 8 aa, Influenza virus
LRTQESSC

SEQ ID NO: 268127 - protein, 8 aa, Influenza virus
RTQESSCT

SEQ ID NO: 268128 - protein, 8 aa, Influenza virus
TQESSCTC

SEQ ID NO: 268129 - protein, 8 aa, Influenza virus
QESSCTCI

SEQ ID NO: 268130 - protein, 8 aa, Influenza virus
ESSCTCIQ

SEQ ID NO: 268131 - protein, 8 aa, Influenza virus
SSCTCIQG

SEQ ID NO: 268132 - protein, 8 aa, Influenza virus
GECYWVMT

SEQ ID NO: 268133 - protein, 8 aa, Influenza virus
ECYWVMTD

SEQ ID NO: 268134 - protein, 8 aa, Influenza virus
CYWVMTDG

SEQ ID NO: 268135 - protein, 8 aa, Influenza virus
YWVMTDGP

SEQ ID NO: 268136 - protein, 8 aa, Influenza virus
WVMTDGPA

SEQ ID NO: 268137 - protein, 8 aa, Influenza virus
VMTDGPAN

SEQ ID NO: 268138 - protein, 8 aa, Influenza virus
MTDGPANR

SEQ ID NO: 268139 - protein, 8 aa, Influenza virus
TDGPANRQ

SEQ ID NO: 268140 - protein, 8 aa, Influenza virus
DGPANRQA

SEQ ID NO: 268141 - protein, 8 aa, Influenza virus
FNGGHIEE

SEQ ID NO: 268142 - protein, 8 aa, Influenza virus
NGGHIEEC

SEQ ID NO: 268143 - protein, 8 aa, Influenza virus
GGHIEECS

SEQ ID NO: 268144 - protein, 8 aa, Influenza virus
GHIEECSC

SEQ ID NO: 268145 - protein, 8 aa, Influenza virus
HIEECSCY

SEQ ID NO: 268146 - protein, 8 aa, Influenza virus
IEECSCYP

SEQ ID NO: 268147 - protein, 8 aa, Influenza virus
EECSCYPN

SEQ ID NO: 268148 - protein, 8 aa, Influenza virus
ECSCYPNE

SEQ ID NO: 268149 - protein, 8 aa, Influenza virus
CSCYPNEG

SEQ ID NO: 268150 - protein, 8 aa, Influenza virus
SCYPNEGK

SEQ ID NO: 268151 - protein, 8 aa, Influenza virus
CYPNEGKV

SEQ ID NO: 268152 - protein, 8 aa, Influenza virus
YPNEGKVE

SEQ ID NO: 268153 - protein, 8 aa, Influenza virus
PNEGKVEC

SEQ ID NO: 268154 - protein, 8 aa, Influenza virus
NEGKVECV

SEQ ID NO: 268155 - protein, 8 aa, Influenza virus
EGKVECVC

SEQ ID NO: 268156 - protein, 8 aa, Influenza virus
GKVECVCR

SEQ ID NO: 268157 - protein, 8 aa, Influenza virus
KVECVCRD

SEQ ID NO: 268158 - protein, 8 aa, Influenza virus
VECVCRDN

SEQ ID NO: 268159 - protein, 8 aa, Influenza virus
ECVCRDNW

SEQ ID NO: 268160 - protein, 8 aa, Influenza virus
CVCRDNWT

SEQ ID NO: 268161 - protein, 8 aa, Influenza virus
VCRDNWTG

SEQ ID NO: 268162 - protein, 8 aa, Influenza virus
CRDNWTGT

SEQ ID NO: 268163 - protein, 8 aa, Influenza virus
RDNWTGTN

SEQ ID NO: 268164 - protein, 8 aa, Influenza virus
DNWTGTNR

SEQ ID NO: 268165 - protein, 8 aa, Influenza virus
NWTGTNRP

SEQ ID NO: 268166 - protein, 8 aa, Influenza virus
WTGTNRPV

SEQ ID NO: 268167 - protein, 8 aa, Influenza virus
TGTNRPVL

SEQ ID NO: 268168 - protein, 8 aa, Influenza virus
GTNRPVLV

SEQ ID NO: 268169 - protein, 8 aa, Influenza virus
TNRPVLVI

SEQ ID NO: 268170 - protein, 8 aa, Influenza virus
NRPVLVIS

SEQ ID NO: 268171 - protein, 8 aa, Influenza virus
LVISPDLS

SEQ ID NO: 268172 - protein, 8 aa, Influenza virus
VISPDLSY

SEQ ID NO: 268173 - protein, 8 aa, Influenza virus
LSYRVGYL

SEQ ID NO: 268174 - protein, 8 aa, Influenza virus
SYRVGYLC

SEQ ID NO: 268175 - protein, 8 aa, Influenza virus
YRVGYLCA

SEQ ID NO: 268176 - protein, 8 aa, Influenza virus
RVGYLCAG

SEQ ID NO: 268177 - protein, 8 aa, Influenza virus
VGYLCAGL

SEQ ID NO: 268178 - protein, 8 aa, Influenza virus
GYLCAGLP

SEQ ID NO: 268179 - protein, 8 aa, Influenza virus
YLCAGLPS

SEQ ID NO: 268180 - protein, 8 aa, Influenza virus
LCAGLPSD

SEQ ID NO: 268181 - protein, 8 aa, Influenza virus
CAGLPSDT

SEQ ID NO: 268182 - protein, 8 aa, Influenza virus
AGLPSDTP

SEQ ID NO: 268183 - protein, 8 aa, Influenza virus
GLPSDTPR

SEQ ID NO: 268184 - protein, 8 aa, Influenza virus
LPSDTPRG

SEQ ID NO: 268185 - protein, 8 aa, Influenza virus
PSDTPRGE

SEQ ID NO: 268186 - protein, 8 aa, Influenza virus
SDTPRGED

SEQ ID NO: 268187 - protein, 8 aa, Influenza virus
DTPRGEDS

SEQ ID NO: 268188 - protein, 8 aa, Influenza virus
TPRGEDSQ

SEQ ID NO: 268189 - protein, 8 aa, Influenza virus
PRGEDSQF

SEQ ID NO: 268190 - protein, 8 aa, Influenza virus
QGYGVKGF

SEQ ID NO: 268191 - protein, 8 aa, Influenza virus
GYGVKGFG

SEQ ID NO: 268192 - protein, 8 aa, Influenza virus
YGVKGFGF

SEQ ID NO: 268193 - protein, 8 aa, Influenza virus
GVKGFGFR

SEQ ID NO: 268194 - protein, 8 aa, Influenza virus
VKGFGFRQ

SEQ ID NO: 268195 - protein, 8 aa, Influenza virus
KGFGFRQG

SEQ ID NO: 268196 - protein, 8 aa, Influenza virus
GFGFRQGN

SEQ ID NO: 268197 - protein, 8 aa, Influenza virus
FGFRQGND

SEQ ID NO: 268198 - protein, 8 aa, Influenza virus
GFRQGNDV

SEQ ID NO: 268199 - protein, 8 aa, Influenza virus
FRQGNDVW

SEQ ID NO: 268200 - protein, 8 aa, Influenza virus
DVWMGRTI

SEQ ID NO: 268201 - protein, 8 aa, Influenza virus
VWMGRTIS

SEQ ID NO: 268202 - protein, 8 aa, Influenza virus
RTSRSGFE

SEQ ID NO: 268203 - protein, 8 aa, Influenza virus
TSRSGFEI

SEQ ID NO: 268204 - protein, 8 aa, Influenza virus
DNLNWSGY

SEQ ID NO: 268205 - protein, 8 aa, Influenza virus
NLNWSGYS

SEQ ID NO: 268206 - protein, 8 aa, Influenza virus
LNWSGYSG

SEQ ID NO: 268207 - protein, 8 aa, Influenza virus
NWSGYSGS

SEQ ID NO: 268208 - protein, 8 aa, Influenza virus
WSGYSGSF

SEQ ID NO: 268209 - protein, 8 aa, Influenza virus
SGYSGSFT

SEQ ID NO: 268210 - protein, 8 aa, Influenza virus
GYSGSFTL

SEQ ID NO: 268211 - protein, 8 aa, Influenza virus
YSGSFTLP

SEQ ID NO: 268212 - protein, 8 aa, Influenza virus
SGSFTLPV

SEQ ID NO: 268213 - protein, 8 aa, Influenza virus
GSFTLPVE

SEQ ID NO: 268214 - protein, 8 aa, Influenza virus
SFTLPVEL

SEQ ID NO: 268215 - protein, 8 aa, Influenza virus
NCLVPCFW

SEQ ID NO: 268216 - protein, 8 aa, Influenza virus
CLVPCFWV

SEQ ID NO: 268217 - protein, 8 aa, Influenza virus
LVPCFWVE

SEQ ID NO: 268218 - protein, 8 aa, Influenza virus
VPCFWVEM

SEQ ID NO: 268219 - protein, 8 aa, Influenza virus
PCFWVEMI

SEQ ID NO: 268220 - protein, 8 aa, Influenza virus
CFWVEMIR

SEQ ID NO: 268221 - protein, 8 aa, Influenza virus
FWVEMIRG

SEQ ID NO: 268222 - protein, 8 aa, Influenza virus
WVEMIRGK

SEQ ID NO: 268223 - protein, 8 aa, Influenza virus
VEMIRGKP

SEQ ID NO: 268224 - protein, 8 aa, Influenza virus
EMIRGKPE

SEQ ID NO: 268225 - protein, 8 aa, Influenza virus
MIRGKPEE

SEQ ID NO: 268226 - protein, 8 aa, Influenza virus
TIWTSSSS

SEQ ID NO: 268227 - protein, 8 aa, Influenza virus
IWTSSSSI

SEQ ID NO: 268228 - protein, 8 aa, Influenza virus
WTSSSSIV

SEQ ID NO: 268229 - protein, 8 aa, Influenza virus
TSSSSIVM

SEQ ID NO: 268230 - protein, 8 aa, Influenza virus
SSSSIVMC

SEQ ID NO: 268231 - protein, 8 aa, Influenza virus
SSSIVMCG

SEQ ID NO: 268232 - protein, 8 aa, Influenza virus
SSIVMCGV

SEQ ID NO: 268233 - protein, 8 aa, Influenza virus
SIVMCGVD

SEQ ID NO: 268234 - protein, 8 aa, Influenza virus
IVMCGVDH

SEQ ID NO: 268235 - protein, 8 aa, Influenza virus
ADWSWHDG

SEQ ID NO: 268236 - protein, 8 aa, Influenza virus
DWSWHDGA

SEQ ID NO: 268237 - protein, 8 aa, Influenza virus
WSWHDGAI

SEQ ID NO: 268238 - protein, 8 aa, Influenza virus
SWHDGAIL

SEQ ID NO: 268239 - protein, 8 aa, Influenza virus
WHDGAILP

SEQ ID NO: 268240 - protein, 8 aa, Influenza virus
HDGAILPF

SEQ ID NO: 268241 - protein, 8 aa, Influenza virus
DGAILPFD

SEQ ID NO: 268242 - protein, 8 aa, Influenza virus
GAILPFDI

SEQ ID NO: 268243 - protein, 8 aa, Influenza virus
AILPFDID

SEQ ID NO: 268244 - protein, 8 aa, Influenza virus
PFDFDKIS

SEQ ID NO: 268245 - protein, 8 aa, Influenza virus
FDIDKIIT

SEQ ID NO: 268246 - protein, 8 aa, Influenza virus
MNPNQKIL

SEQ ID NO: 268247 - protein, 8 aa, Influenza virus
NPNQKILC

SEQ ID NO: 268248 - protein, 8 aa, Influenza virus
PNQKILCT

SEQ ID NO: 268249 - protein, 8 aa, Influenza virus
NQKILCTS

SEQ ID NO: 268250 - protein, 8 aa, Influenza virus
QKILCTSA

SEQ ID NO: 268251 - protein, 8 aa, Influenza virus
KILCTSAT

SEQ ID NO: 268252 - protein, 8 aa, Influenza virus
ILCTSATA

SEQ ID NO: 268253 - protein, 8 aa, Influenza virus
LCTSATAI

SEQ ID NO: 268254 - protein, 8 aa, Influenza virus
GIANLGLN

SEQ ID NO: 268255 - protein, 8 aa, Influenza virus
ANLGLNIG

SEQ ID NO: 268256 - protein, 8 aa, Influenza virus
NLGLNIGL

SEQ ID NO: 268257 - protein, 8 aa, Influenza virus
LGLNIGLH

SEQ ID NO: 268258 - protein, 8 aa, Influenza virus
GLNIGLHL

SEQ ID NO: 268259 - protein, 8 aa, Influenza virus
LNIGLHLK

SEQ ID NO: 268260 - protein, 8 aa, Influenza virus
NIGLHLKP

SEQ ID NO: 268261 - protein, 8 aa, Influenza virus
SQTIINNY

SEQ ID NO: 268262 - protein, 8 aa, Influenza virus
QTIINNYY

SEQ ID NO: 268263 - protein, 8 aa, Influenza virus
TIINNYYN

SEQ ID NO: 268264 - protein, 8 aa, Influenza virus
IINNYYNE

SEQ ID NO: 268265 - protein, 8 aa, Influenza virus
INNYYNET

SEQ ID NO: 268266 - protein, 8 aa, Influenza virus
NNYYNETN

SEQ ID NO: 268267 - protein, 8 aa, Influenza virus
ITQISNTN

SEQ ID NO: 268268 - protein, 8 aa, Influenza virus
TQISNTNI

SEQ ID NO: 268269 - protein, 8 aa, Influenza virus
FNNLTKGL

SEQ ID NO: 268270 - protein, 8 aa, Influenza virus
NNLTKGLC

SEQ ID NO: 268271 - protein, 8 aa, Influenza virus
NLTKGLCT

SEQ ID NO: 268272 - protein, 8 aa, Influenza virus
LTKGLCTI

SEQ ID NO: 268273 - protein, 8 aa, Influenza virus
TKGLCTIN

SEQ ID NO: 268274 - protein, 8 aa, Influenza virus
KGLCTINS

SEQ ID NO: 268275 - protein, 8 aa, Influenza virus
GLCTINSW

SEQ ID NO: 268276 - protein, 8 aa, Influenza virus
LCTINSWH

SEQ ID NO: 268277 - protein, 8 aa, Influenza virus
CTINSWHI

SEQ ID NO: 268278 - protein, 8 aa, Influenza virus
TINSWHIY

SEQ ID NO: 268279 - protein, 8 aa, Influenza virus
INSWHIYG

SEQ ID NO: 268280 - protein, 8 aa, Influenza virus
NSWHIYGK

SEQ ID NO: 268281 - protein, 8 aa, Influenza virus
SWHIYGKD

SEQ ID NO: 268282 - protein, 8 aa, Influenza virus
WHIYGKDN

SEQ ID NO: 268283 - protein, 8 aa, Influenza virus
HIYGKDNA

SEQ ID NO: 268284 - protein, 8 aa, Influenza virus
IYGKDNAV

SEQ ID NO: 268285 - protein, 8 aa, Influenza virus
YGKDNAVR

SEQ ID NO: 268286 - protein, 8 aa, Influenza virus
GKDNAVRI

SEQ ID NO: 268287 - protein, 8 aa, Influenza virus
KDNAVRIG

SEQ ID NO: 268288 - protein, 8 aa, Influenza virus
DNAVRIGE

SEQ ID NO: 268289 - protein, 8 aa, Influenza virus
NAVRIGED

SEQ ID NO: 268290 - protein, 8 aa, Influenza virus
AVRIGEDS

SEQ ID NO: 268291 - protein, 8 aa, Influenza virus
RIGEDSDV

SEQ ID NO: 268292 - protein, 8 aa, Influenza virus
IGEDSDVL

SEQ ID NO: 268293 - protein, 8 aa, Influenza virus
GEDSDVLV

SEQ ID NO: 268294 - protein, 8 aa, Influenza virus
EDSDVLVT

SEQ ID NO: 268295 - protein, 8 aa, Influenza virus
DSDVLVTR

SEQ ID NO: 268296 - protein, 8 aa, Influenza virus
SDVLVTRE

SEQ ID NO: 268297 - protein, 8 aa, Influenza virus
DVLVTREP

SEQ ID NO: 268298 - protein, 8 aa, Influenza virus
VLVTREPY

SEQ ID NO: 268299 - protein, 8 aa, Influenza virus
LVTREPYV

SEQ ID NO: 268300 - protein, 8 aa, Influenza virus
VTREPYVS

SEQ ID NO: 268301 - protein, 8 aa, Influenza virus
TREPYVSC

SEQ ID NO: 268302 - protein, 8 aa, Influenza virus
REPYVSCD

SEQ ID NO: 268303 - protein, 8 aa, Influenza virus
EPYVSCDP

SEQ ID NO: 268304 - protein, 8 aa, Influenza virus
PYVSCDPD

SEQ ID NO: 268305 - protein, 8 aa, Influenza virus
YVSCDPDE

SEQ ID NO: 268306 - protein, 8 aa, Influenza virus
VSCDPDEC

SEQ ID NO: 268307 - protein, 8 aa, Influenza virus
SCDPDECR

SEQ ID NO: 268308 - protein, 8 aa, Influenza virus
CDPDECRF

SEQ ID NO: 268309 - protein, 8 aa, Influenza virus
DPDECRFY

SEQ ID NO: 268310 - protein, 8 aa, Influenza virus
PDECRFYA

SEQ ID NO: 268311 - protein, 8 aa, Influenza virus
DECRFYAL

SEQ ID NO: 268312 - protein, 8 aa, Influenza virus
ECRFYALS

SEQ ID NO: 268313 - protein, 8 aa, Influenza virus
CRFYALSQ

SEQ ID NO: 268314 - protein, 8 aa, Influenza virus
RFYALSQG

SEQ ID NO: 268315 - protein, 8 aa, Influenza virus
FYALSQGT

SEQ ID NO: 268316 - protein, 8 aa, Influenza virus
YALSQGTT

SEQ ID NO: 268317 - protein, 8 aa, Influenza virus
ALSQGTTI

SEQ ID NO: 268318 - protein, 8 aa, Influenza virus
LSQGTTIR

SEQ ID NO: 268319 - protein, 8 aa, Influenza virus
SQGTTIRG

SEQ ID NO: 268320 - protein, 8 aa, Influenza virus
QGTTIRGK

SEQ ID NO: 268321 - protein, 8 aa, Influenza virus
GTTIRGKH

SEQ ID NO: 268322 - protein, 8 aa, Influenza virus
TTIRGKHS

SEQ ID NO: 268323 - protein, 8 aa, Influenza virus
TIRGKHSN

SEQ ID NO: 268324 - protein, 8 aa, Influenza virus
IRGKHSNG

SEQ ID NO: 268325 - protein, 8 aa, Influenza virus
RGKHSNGT

SEQ ID NO: 268326 - protein, 8 aa, Influenza virus
GKHSNGTI

SEQ ID NO: 268327 - protein, 8 aa, Influenza virus
KHSNGTIH

SEQ ID NO: 268328 - protein, 8 aa, Influenza virus
HSNGTIHD

SEQ ID NO: 268329 - protein, 8 aa, Influenza virus
SNGTIHDR

SEQ ID NO: 268330 - protein, 8 aa, Influenza virus
NGTIHDRS

SEQ ID NO: 268331 - protein, 8 aa, Influenza virus
GTIHDRSQ

SEQ ID NO: 268332 - protein, 8 aa, Influenza virus
TIHDRSQY

SEQ ID NO: 268333 - protein, 8 aa, Influenza virus
IHDRSQYR

SEQ ID NO: 268334 - protein, 8 aa, Influenza virus
HDRSQYRA

SEQ ID NO: 268335 - protein, 8 aa, Influenza virus
DRSQYRAL

SEQ ID NO: 268336 - protein, 8 aa, Influenza virus
RSQYRALI

SEQ ID NO: 268337 - protein, 8 aa, Influenza virus
SQYRALIS

SEQ ID NO: 268338 - protein, 8 aa, Influenza virus
QYRALISW

SEQ ID NO: 268339 - protein, 8 aa, Influenza virus
YRALISWP

SEQ ID NO: 268340 - protein, 8 aa, Influenza virus
RALISWPL

SEQ ID NO: 268341 - protein, 8 aa, Influenza virus
ALISWPLS

SEQ ID NO: 268342 - protein, 8 aa, Influenza virus
LISWPLSS

SEQ ID NO: 268343 - protein, 8 aa, Influenza virus
ISWPLSSP

SEQ ID NO: 268344 - protein, 8 aa, Influenza virus
SWPLSSPP

SEQ ID NO: 268345 - protein, 8 aa, Influenza virus
WPLSSPPT

SEQ ID NO: 268346 - protein, 8 aa, Influenza virus
PLSSPPTV

SEQ ID NO: 268347 - protein, 8 aa, Influenza virus
LSSPPTVY

SEQ ID NO: 268348 - protein, 8 aa, Influenza virus
SSPPTVYN

SEQ ID NO: 268349 - protein, 8 aa, Influenza virus
SPPTVYNS

SEQ ID NO: 268350 - protein, 8 aa, Influenza virus
PPTVYNSR

SEQ ID NO: 268351 - protein, 8 aa, Influenza virus
RVECIGWS

SEQ ID NO: 268352 - protein, 8 aa, Influenza virus
VECIGWSS

SEQ ID NO: 268353 - protein, 8 aa, Influenza virus
ECIGWSST

SEQ ID NO: 268354 - protein, 8 aa, Influenza virus
CIGWSSTS

SEQ ID NO: 268355 - protein, 8 aa, Influenza virus
IGWSSTSC

SEQ ID NO: 268356 - protein, 8 aa, Influenza virus
GWSSTSCH

SEQ ID NO: 268357 - protein, 8 aa, Influenza virus
WSSTSCHD

SEQ ID NO: 268358 - protein, 8 aa, Influenza virus
SSTSCHDG

SEQ ID NO: 268359 - protein, 8 aa, Influenza virus
STSCHDGR

SEQ ID NO: 268360 - protein, 8 aa, Influenza virus
TSCHDGRA

SEQ ID NO: 268361 - protein, 8 aa, Influenza virus
SCHDGRAR

SEQ ID NO: 268362 - protein, 8 aa, Influenza virus
CHDGRARM

SEQ ID NO: 268363 - protein, 8 aa, Influenza virus
HDGRARMS

SEQ ID NO: 268364 - protein, 8 aa, Influenza virus
RMSICISG

SEQ ID NO: 268365 - protein, 8 aa, Influenza virus
MSICISGP

SEQ ID NO: 268366 - protein, 8 aa, Influenza virus
SICISGPN

SEQ ID NO: 268367 - protein, 8 aa, Influenza virus
ICISGPNN

SEQ ID NO: 268368 - protein, 8 aa, Influenza virus
CISGPNNN

SEQ ID NO: 268369 - protein, 8 aa, Influenza virus
ISGPNNNA

SEQ ID NO: 268370 - protein, 8 aa, Influenza virus
SGPNNNAS

SEQ ID NO: 268371 - protein, 8 aa, Influenza virus
GPNNNASA

SEQ ID NO: 268372 - protein, 8 aa, Influenza virus
PNNNASAV

SEQ ID NO: 268373 - protein, 8 aa, Influenza virus
NNNASAVI

SEQ ID NO: 268374 - protein, 8 aa, Influenza virus
NNASAVIW

SEQ ID NO: 268375 - protein, 8 aa, Influenza virus
NASAVIWY

SEQ ID NO: 268376 - protein, 8 aa, Influenza virus
ASAVIWYN

SEQ ID NO: 268377 - protein, 8 aa, Influenza virus
RRPVTEIN

SEQ ID NO: 268378 - protein, 8 aa, Influenza virus
RPVTEINT

SEQ ID NO: 268379 - protein, 8 aa, Influenza virus
PVTEINTW

SEQ ID NO: 268380 - protein, 8 aa, Influenza virus
VTEINTWA

SEQ ID NO: 268381 - protein, 8 aa, Influenza virus
TEINTWAR

SEQ ID NO: 268382 - protein, 8 aa, Influenza virus
EINTWARN

SEQ ID NO: 268383 - protein, 8 aa, Influenza virus
INTWARNI

SEQ ID NO: 268384 - protein, 8 aa, Influenza virus
NTWARNIL

SEQ ID NO: 268385 - protein, 8 aa, Influenza virus
TWARNILR

SEQ ID NO: 268386 - protein, 8 aa, Influenza virus
WARNILRT

SEQ ID NO: 268387 - protein, 8 aa, Influenza virus
ARNILRTQ

SEQ ID NO: 268388 - protein, 8 aa, Influenza virus
RNILRTQE

SEQ ID NO: 268389 - protein, 8 aa, Influenza virus
NILRTQES

SEQ ID NO: 268390 - protein, 8 aa, Influenza virus
ILRTQESE

SEQ ID NO: 268391 - protein, 8 aa, Influenza virus
LRTQESEC

SEQ ID NO: 268392 - protein, 8 aa, Influenza virus
RTQESECV

SEQ ID NO: 268393 - protein, 8 aa, Influenza virus
TQESECVC

SEQ ID NO: 268394 - protein, 8 aa, Influenza virus
QESECVCH

SEQ ID NO: 268395 - protein, 8 aa, Influenza virus
ESECVCHN

SEQ ID NO: 268396 - protein, 8 aa, Influenza virus
SECVCHNG

SEQ ID NO: 268397 - protein, 8 aa, Influenza virus
ECVCHNGV

SEQ ID NO: 268398 - protein, 8 aa, Influenza virus
CVCHNGVC

SEQ ID NO: 268399 - protein, 8 aa, Influenza virus
VCHNGVCP

SEQ ID NO: 268400 - protein, 8 aa, Influenza virus
CHNGVCPV

SEQ ID NO: 268401 - protein, 8 aa, Influenza virus
HNGVCPVV

SEQ ID NO: 268402 - protein, 8 aa, Influenza virus
NGVCPVVF

SEQ ID NO: 268403 - protein, 8 aa, Influenza virus
GVCPVVFT

SEQ ID NO: 268404 - protein, 8 aa, Influenza virus
VCPVVFTD

SEQ ID NO: 268405 - protein, 8 aa, Influenza virus
CPVVFTDG

SEQ ID NO: 268406 - protein, 8 aa, Influenza virus
PVVFTDGS

SEQ ID NO: 268407 - protein, 8 aa, Influenza virus
VVFTDGSA

SEQ ID NO: 268408 - protein, 8 aa, Influenza virus
VFTDGSAT

SEQ ID NO: 268409 - protein, 8 aa, Influenza virus
FTDGSATG

SEQ ID NO: 268410 - protein, 8 aa, Influenza virus
TDGSATGP

SEQ ID NO: 268411 - protein, 8 aa, Influenza virus
DGSATGPA

SEQ ID NO: 268412 - protein, 8 aa, Influenza virus
GSATGPAE

SEQ ID NO: 268413 - protein, 8 aa, Influenza virus
SATGPAET

SEQ ID NO: 268414 - protein, 8 aa, Influenza virus
ATGPAETR

SEQ ID NO: 268415 - protein, 8 aa, Influenza virus
TGPAETRV

SEQ ID NO: 268416 - protein, 8 aa, Influenza virus
GPAETRVY

SEQ ID NO: 268417 - protein, 8 aa, Influenza virus
PAETRVYY

SEQ ID NO: 268418 - protein, 8 aa, Influenza virus
AETRVYYF

SEQ ID NO: 268419 - protein, 8 aa, Influenza virus
TRVYYFKE

SEQ ID NO: 268420 - protein, 8 aa, Influenza virus
RVYYFKEG

SEQ ID NO: 268421 - protein, 8 aa, Influenza virus
EGKILKWE

SEQ ID NO: 268422 - protein, 8 aa, Influenza virus
GKILKWEP

SEQ ID NO: 268423 - protein, 8 aa, Influenza virus
KILKWEPL

SEQ ID NO: 268424 - protein, 8 aa, Influenza virus
KWEPLTGT

SEQ ID NO: 268425 - protein, 8 aa, Influenza virus
WEPLTGTA

SEQ ID NO: 268426 - protein, 8 aa, Influenza virus
LTGTAKHI

SEQ ID NO: 268427 - protein, 8 aa, Influenza virus
TGTAKHIE

SEQ ID NO: 268428 - protein, 8 aa, Influenza virus
GTAKHIEE

SEQ ID NO: 268429 - protein, 8 aa, Influenza virus
TAKHIEEC

SEQ ID NO: 268430 - protein, 8 aa, Influenza virus
AKHIEECS

SEQ ID NO: 268431 - protein, 8 aa, Influenza virus
KHIEECSC

SEQ ID NO: 268432 - protein, 8 aa, Influenza virus
HIEECSCY

SEQ ID NO: 268433 - protein, 8 aa, Influenza virus
IEECSCYG

SEQ ID NO: 268434 - protein, 8 aa, Influenza virus
EECSCYGE

SEQ ID NO: 268435 - protein, 8 aa, Influenza virus
ITCTCRDN

SEQ ID NO: 268436 - protein, 8 aa, Influenza virus
TCTCRDNW

SEQ ID NO: 268437 - protein, 8 aa, Influenza virus
CTCRDNWQ

SEQ ID NO: 268438 - protein, 8 aa, Influenza virus
TCRDNWQG

SEQ ID NO: 268439 - protein, 8 aa, Influenza virus
CRDNWQGS

SEQ ID NO: 268440 - protein, 8 aa, Influenza virus
RDNWQGSN

SEQ ID NO: 268441 - protein, 8 aa, Influenza virus
DNWQGSNR

SEQ ID NO: 268442 - protein, 8 aa, Influenza virus
NWQGSNRP

SEQ ID NO: 268443 - protein, 8 aa, Influenza virus
WQGSNRPV

SEQ ID NO: 268444 - protein, 8 aa, Influenza virus
QGSNRPVI

SEQ ID NO: 268445 - protein, 8 aa, Influenza virus
GSNRPVIQ

SEQ ID NO: 268446 - protein, 8 aa, Influenza virus
SNRPVIQI

SEQ ID NO: 268447 - protein, 8 aa, Influenza virus
NRPVIQID

SEQ ID NO: 268448 - protein, 8 aa, Influenza virus
RPVIQIDP

SEQ ID NO: 268449 - protein, 8 aa, Influenza virus
AMTHTSQY

SEQ ID NO: 268450 - protein, 8 aa, Influenza virus
MTHTSQYI

SEQ ID NO: 268451 - protein, 8 aa, Influenza virus
THTSQYIC

SEQ ID NO: 268452 - protein, 8 aa, Influenza virus
HTSQYICS

SEQ ID NO: 268453 - protein, 8 aa, Influenza virus
TSQYICSP

SEQ ID NO: 268454 - protein, 8 aa, Influenza virus
SQYICSPV

SEQ ID NO: 268455 - protein, 8 aa, Influenza virus
QYICSPVL

SEQ ID NO: 268456 - protein, 8 aa, Influenza virus
YICSPVLT

SEQ ID NO: 268457 - protein, 8 aa, Influenza virus
ICSPVLTD

SEQ ID NO: 268458 - protein, 8 aa, Influenza virus
CSPVLTDN

SEQ ID NO: 268459 - protein, 8 aa, Influenza virus
SPVLTDNP

SEQ ID NO: 268460 - protein, 8 aa, Influenza virus
PVLTDNPR

SEQ ID NO: 268461 - protein, 8 aa, Influenza virus
VLTDNPRP

SEQ ID NO: 268462 - protein, 8 aa, Influenza virus
LTDNPRPN

SEQ ID NO: 268463 - protein, 8 aa, Influenza virus
TDNPRPND

SEQ ID NO: 268464 - protein, 8 aa, Influenza virus
DNPRPNDP

SEQ ID NO: 268465 - protein, 8 aa, Influenza virus
NPRPNDPA

SEQ ID NO: 268466 - protein, 8 aa, Influenza virus
VGKCNDPY

SEQ ID NO: 268467 - protein, 8 aa, Influenza virus
GKCNDPYP

SEQ ID NO: 268468 - protein, 8 aa, Influenza virus
KCNDPYPG

SEQ ID NO: 268469 - protein, 8 aa, Influenza virus
CNDPYPGN

SEQ ID NO: 268470 - protein, 8 aa, Influenza virus
NDPYPGNN

SEQ ID NO: 268471 - protein, 8 aa, Influenza virus
DPYPGNNN

SEQ ID NO: 268472 - protein, 8 aa, Influenza virus
PYPGNNNN

SEQ ID NO: 268473 - protein, 8 aa, Influenza virus
YPGNNNNG

SEQ ID NO: 268474 - protein, 8 aa, Influenza virus
PGNNNNGV

SEQ ID NO: 268475 - protein, 8 aa, Influenza virus
GNNNNGVK

SEQ ID NO: 268476 - protein, 8 aa, Influenza virus
NNNNGVKG

SEQ ID NO: 268477 - protein, 8 aa, Influenza virus
NNNGVKGF

SEQ ID NO: 268478 - protein, 8 aa, Influenza virus
NNGVKGFS

SEQ ID NO: 268479 - protein, 8 aa, Influenza virus
NGVKGFSY

SEQ ID NO: 268480 - protein, 8 aa, Influenza virus
GVKGFSYL

SEQ ID NO: 268481 - protein, 8 aa, Influenza virus
VKGFSYLD

SEQ ID NO: 268482 - protein, 8 aa, Influenza virus
KGFSYLDG

SEQ ID NO: 268483 - protein, 8 aa, Influenza virus
GNTWLGRT

SEQ ID NO: 268484 - protein, 8 aa, Influenza virus
NTWLGRTI

SEQ ID NO: 268485 - protein, 8 aa, Influenza virus
TWLGRTIS

SEQ ID NO: 268486 - protein, 8 aa, Influenza virus
WLGRTIST

SEQ ID NO: 268487 - protein, 8 aa, Influenza virus
LGRTISTA

SEQ ID NO: 268488 - protein, 8 aa, Influenza virus
GRTISTAS

SEQ ID NO: 268489 - protein, 8 aa, Influenza virus
RTISTASR

SEQ ID NO: 268490 - protein, 8 aa, Influenza virus
TISTASRS

SEQ ID NO: 268491 - protein, 8 aa, Influenza virus
ISTASRSG

SEQ ID NO: 268492 - protein, 8 aa, Influenza virus
STASRSGY

SEQ ID NO: 268493 - protein, 8 aa, Influenza virus
TASRSGYE

SEQ ID NO: 268494 - protein, 8 aa, Influenza virus
ASRSGYEM

SEQ ID NO: 268495 - protein, 8 aa, Influenza virus
SRSGYEML

SEQ ID NO: 268496 - protein, 8 aa, Influenza virus
RSGYEMLK

SEQ ID NO: 268497 - protein, 8 aa, Influenza virus
SGYEMLKV

SEQ ID NO: 268498 - protein, 8 aa, Influenza virus
GYEMLKVP

SEQ ID NO: 268499 - protein, 8 aa, Influenza virus
YEMLKVPN

SEQ ID NO: 268500 - protein, 8 aa, Influenza virus
EMLKVPNA

SEQ ID NO: 268501 - protein, 8 aa, Influenza virus
MLKVPNAL

SEQ ID NO: 268502 - protein, 8 aa, Influenza virus
LKVPNALT

SEQ ID NO: 268503 - protein, 8 aa, Influenza virus
KVPNALTD

SEQ ID NO: 268504 - protein, 8 aa, Influenza virus
VPNALTDD

SEQ ID NO: 268505 - protein, 8 aa, Influenza virus
PNALTDDR

SEQ ID NO: 268506 - protein, 8 aa, Influenza virus
NALTDDRS

SEQ ID NO: 268507 - protein, 8 aa, Influenza virus
ALTDDRSK

SEQ ID NO: 268508 - protein, 8 aa, Influenza virus
LTDDRSKP

SEQ ID NO: 268509 - protein, 8 aa, Influenza virus
RSKPTQGQ

SEQ ID NO: 268510 - protein, 8 aa, Influenza virus
SKPTQGQT

SEQ ID NO: 268511 - protein, 8 aa, Influenza virus
PTQGQTIV

SEQ ID NO: 268512 - protein, 8 aa, Influenza virus
QGQTIVLN

SEQ ID NO: 268513 - protein, 8 aa, Influenza virus
GQTIVLNT

SEQ ID NO: 268514 - protein, 8 aa, Influenza virus
QTIVLNTD

SEQ ID NO: 268515 - protein, 8 aa, Influenza virus
TIVLNTDW

SEQ ID NO: 268516 - protein, 8 aa, Influenza virus
IVLNTDWS

SEQ ID NO: 268517 - protein, 8 aa, Influenza virus
VLNTDWSG

SEQ ID NO: 268518 - protein, 8 aa, Influenza virus
LNTDWSGY

SEQ ID NO: 268519 - protein, 8 aa, Influenza virus
NTDWSGYS

SEQ ID NO: 268520 - protein, 8 aa, Influenza virus
TDWSGYSG

SEQ ID NO: 268521 - protein, 8 aa, Influenza virus
DWSGYSGS

SEQ ID NO: 268522 - protein, 8 aa, Influenza virus
WSGYSGSF

SEQ ID NO: 268523 - protein, 8 aa, Influenza virus
SGYSGSFM

SEQ ID NO: 268524 - protein, 8 aa, Influenza virus
GYSGSFMD

SEQ ID NO: 268525 - protein, 8 aa, Influenza virus
YSGSFMDY

SEQ ID NO: 268526 - protein, 8 aa, Influenza virus
SGSFMDYW

SEQ ID NO: 268527 - protein, 8 aa, Influenza virus
GSFMDYWA

SEQ ID NO: 268528 - protein, 8 aa, Influenza virus
SFMDYWAE

SEQ ID NO: 268529 - protein, 8 aa, Influenza virus
FMDYWAEG

SEQ ID NO: 268530 - protein, 8 aa, Influenza virus
DYWAEGEC

SEQ ID NO: 268531 - protein, 8 aa, Influenza virus
YWAEGECY

SEQ ID NO: 268532 - protein, 8 aa, Influenza virus
WAEGECYR

SEQ ID NO: 268533 - protein, 8 aa, Influenza virus
AEGECYRA

SEQ ID NO: 268534 - protein, 8 aa, Influenza virus
EGECYRAC

SEQ ID NO: 268535 - protein, 8 aa, Influenza virus
GECYRACF

SEQ ID NO: 268536 - protein, 8 aa, Influenza virus
ECYRACFY

SEQ ID NO: 268537 - protein, 8 aa, Influenza virus
CYRACFYV

SEQ ID NO: 268538 - protein, 8 aa, Influenza virus
YRACFYVE

SEQ ID NO: 268539 - protein, 8 aa, Influenza virus
RACFYVEL

SEQ ID NO: 268540 - protein, 8 aa, Influenza virus
ACFYVELI

SEQ ID NO: 268541 - protein, 8 aa, Influenza virus
CFYVELIR

SEQ ID NO: 268542 - protein, 8 aa, Influenza virus
FYVELIRG

SEQ ID NO: 268543 - protein, 8 aa, Influenza virus
YVELIRGR

SEQ ID NO: 268544 - protein, 8 aa, Influenza virus
VELIRGRP

SEQ ID NO: 268545 - protein, 8 aa, Influenza virus
ELIRGRPK

SEQ ID NO: 268546 - protein, 8 aa, Influenza virus
LIRGRPKE

SEQ ID NO: 268547 - protein, 8 aa, Influenza virus
IRGRPKED

SEQ ID NO: 268548 - protein, 8 aa, Influenza virus
RGRPKEDK

SEQ ID NO: 268549 - protein, 8 aa, Influenza virus
GRPKEDKV

SEQ ID NO: 268550 - protein, 8 aa, Influenza virus
RPKEDKVW

SEQ ID NO: 268551 - protein, 8 aa, Influenza virus
PKEDKVWW

SEQ ID NO: 268552 - protein, 8 aa, Influenza virus
KEDKVWWT

SEQ ID NO: 268553 - protein, 8 aa, Influenza virus
EDKVWWTS

SEQ ID NO: 268554 - protein, 8 aa, Influenza virus
DKVWWTSN

SEQ ID NO: 268555 - protein, 8 aa, Influenza virus
KVWWTSNS

SEQ ID NO: 268556 - protein, 8 aa, Influenza virus
VWWTSNSI

SEQ ID NO: 268557 - protein, 8 aa, Influenza virus
WWTSNSIV

SEQ ID NO: 268558 - protein, 8 aa, Influenza virus
WTSNSIVS

SEQ ID NO: 268559 - protein, 8 aa, Influenza virus
TSNSIVSM

SEQ ID NO: 268560 - protein, 8 aa, Influenza virus
SNSIVSMC

SEQ ID NO: 268561 - protein, 8 aa, Influenza virus
NSIVSMCS

SEQ ID NO: 268562 - protein, 8 aa, Influenza virus
SIVSMCSS

SEQ ID NO: 268563 - protein, 8 aa, Influenza virus
IVSMCSST

SEQ ID NO: 268564 - protein, 8 aa, Influenza virus
VSMCSSTE

SEQ ID NO: 268565 - protein, 8 aa, Influenza virus
SMCSSTEF

SEQ ID NO: 268566 - protein, 8 aa, Influenza virus
MCSSTEFL

SEQ ID NO: 268567 - protein, 8 aa, Influenza virus
CSSTEFLG

SEQ ID NO: 268568 - protein, 8 aa, Influenza virus
SSTEFLGQ

SEQ ID NO: 268569 - protein, 8 aa, Influenza virus
STEFLGQW

SEQ ID NO: 268570 - protein, 8 aa, Influenza virus
TEFLGQWN

SEQ ID NO: 268571 - protein, 8 aa, Influenza virus
EFLGQWNW

SEQ ID NO: 268572 - protein, 8 aa, Influenza virus
FLGQWNWP

SEQ ID NO: 268573 - protein, 8 aa, Influenza virus
LGQWNWPD

SEQ ID NO: 268574 - protein, 8 aa, Influenza virus
GQWNWPDG

SEQ ID NO: 268575 - protein, 8 aa, Influenza virus
QWNWPDGA

SEQ ID NO: 268576 - protein, 8 aa, Influenza virus
WNWPDGAK

SEQ ID NO: 268577 - protein, 8 aa, Influenza virus
NWPDGAKI

SEQ ID NO: 268578 - protein, 8 aa, Influenza virus
WPDGAKIE

SEQ ID NO: 268579 - protein, 8 aa, Influenza virus
PDGAKIEY

SEQ ID NO: 268580 - protein, 8 aa, Influenza virus
DGAKIEYF

SEQ ID NO: 268581 - protein, 8 aa, Influenza virus
GAKIEYFL

SEQ ID NO: 268582 - protein, 8 aa, Influenza virus
GLDKICLG

SEQ ID NO: 268583 - protein, 8 aa, Influenza virus
LDKICLGH

SEQ ID NO: 268584 - protein, 8 aa, Influenza virus
DKICLGHH

SEQ ID NO: 268585 - protein, 8 aa, Influenza virus
KICLGHHA

SEQ ID NO: 268586 - protein, 8 aa, Influenza virus
ICLGHHAV

SEQ ID NO: 268587 - protein, 8 aa, Influenza virus
CLGHHAVS

SEQ ID NO: 268588 - protein, 8 aa, Influenza virus
LGHHAVSN

SEQ ID NO: 268589 - protein, 8 aa, Influenza virus
GHHAVSNG

SEQ ID NO: 268590 - protein, 8 aa, Influenza virus
HHAVSNGT

SEQ ID NO: 268591 - protein, 8 aa, Influenza virus
NGTIVKTL

SEQ ID NO: 268592 - protein, 8 aa, Influenza virus
GTIVKTLT

SEQ ID NO: 268593 - protein, 8 aa, Influenza virus
KEEVTNAT

SEQ ID NO: 268594 - protein, 8 aa, Influenza virus
EEVTNATE

SEQ ID NO: 268595 - protein, 8 aa, Influenza virus
EVTNATET

SEQ ID NO: 268596 - protein, 8 aa, Influenza virus
VTNATETV

SEQ ID NO: 268597 - protein, 8 aa, Influenza virus
TNATETVE

SEQ ID NO: 268598 - protein, 8 aa, Influenza virus
NATETVES

SEQ ID NO: 268599 - protein, 8 aa, Influenza virus
KDLGNCHP

SEQ ID NO: 268600 - protein, 8 aa, Influenza virus
DLGNCHPI

SEQ ID NO: 268601 - protein, 8 aa, Influenza virus
LGNCHPIG

SEQ ID NO: 268602 - protein, 8 aa, Influenza virus
GNCHPIGM

SEQ ID NO: 268603 - protein, 8 aa, Influenza virus
HLTGTWDT

SEQ ID NO: 268604 - protein, 8 aa, Influenza virus
GTWDTLIE

SEQ ID NO: 268605 - protein, 8 aa, Influenza virus
TWDTLIER

SEQ ID NO: 268606 - protein, 8 aa, Influenza virus
WDTLIERD

SEQ ID NO: 268607 - protein, 8 aa, Influenza virus
AYCYPGAT

SEQ ID NO: 268608 - protein, 8 aa, Influenza virus
VNEEALRQ

SEQ ID NO: 268609 - protein, 8 aa, Influenza virus
NEEALRQK

SEQ ID NO: 268610 - protein, 8 aa, Influenza virus
EEALRQKI

SEQ ID NO: 268611 - protein, 8 aa, Influenza virus
EALRQKIM

SEQ ID NO: 268612 - protein, 8 aa, Influenza virus
ALRQKIME

SEQ ID NO: 268613 - protein, 8 aa, Influenza virus
LRQKIMES

SEQ ID NO: 268614 - protein, 8 aa, Influenza virus
RQKIMESG

SEQ ID NO: 268615 - protein, 8 aa, Influenza virus
QKIMESGG

SEQ ID NO: 268616 - protein, 8 aa, Influenza virus
KIMESGGI

SEQ ID NO: 268617 - protein, 8 aa, Influenza virus
MESGGIDK

SEQ ID NO: 268618 - protein, 8 aa, Influenza virus
SFYAELKW

SEQ ID NO: 268619 - protein, 8 aa, Influenza virus
FYAELKWL

SEQ ID NO: 268620 - protein, 8 aa, Influenza virus
ELKWLVSK

SEQ ID NO: 268621 - protein, 8 aa, Influenza virus
KGQNFPQT

SEQ ID NO: 268622 - protein, 8 aa, Influenza virus
GQNFPQTT

SEQ ID NO: 268623 - protein, 8 aa, Influenza virus
QNFPQTTN

SEQ ID NO: 268624 - protein, 8 aa, Influenza virus
NFPQTTNT

SEQ ID NO: 268625 - protein, 8 aa, Influenza virus
FPQTTNTY

SEQ ID NO: 268626 - protein, 8 aa, Influenza virus
PQTTNTYR

SEQ ID NO: 268627 - protein, 8 aa, Influenza virus
QTTNTYRN

SEQ ID NO: 268628 - protein, 8 aa, Influenza virus
TTNTYRNT

SEQ ID NO: 268629 - protein, 8 aa, Influenza virus
TNTYRNTD

SEQ ID NO: 268630 - protein, 8 aa, Influenza virus
NTYRNTDS

SEQ ID NO: 268631 - protein, 8 aa, Influenza virus
IWGIHHPS

SEQ ID NO: 268632 - protein, 8 aa, Influenza virus
WGIHHPSS

SEQ ID NO: 268633 - protein, 8 aa, Influenza virus
GIHHPSST

SEQ ID NO: 268634 - protein, 8 aa, Influenza virus
EKNDLYGT

SEQ ID NO: 268635 - protein, 8 aa, Influenza virus
LYGTQSLS

SEQ ID NO: 268636 - protein, 8 aa, Influenza virus
YGTQSLSI

SEQ ID NO: 268637 - protein, 8 aa, Influenza virus
GTQSLSIS

SEQ ID NO: 268638 - protein, 8 aa, Influenza virus
TQSLSISV

SEQ ID NO: 268639 - protein, 8 aa, Influenza virus
QSLSISVG

SEQ ID NO: 268640 - protein, 8 aa, Influenza virus
SLSISVGS

SEQ ID NO: 268641 - protein, 8 aa, Influenza virus
LSISVGSS

SEQ ID NO: 268642 - protein, 8 aa, Influenza virus
SISVGSST

SEQ ID NO: 268643 - protein, 8 aa, Influenza virus
ISVGSSTY

SEQ ID NO: 268644 - protein, 8 aa, Influenza virus
SVGSSTYQ

SEQ ID NO: 268645 - protein, 8 aa, Influenza virus
VGSSTYQN

SEQ ID NO: 268646 - protein, 8 aa, Influenza virus
GSSTYQNN

SEQ ID NO: 268647 - protein, 8 aa, Influenza virus
SSTYQNNF

SEQ ID NO: 268648 - protein, 8 aa, Influenza virus
STYQNNFV

SEQ ID NO: 268649 - protein, 8 aa, Influenza virus
TYQNNFVP

SEQ ID NO: 268650 - protein, 8 aa, Influenza virus
YQNNFVPV

SEQ ID NO: 268651 - protein, 8 aa, Influenza virus
QNNFVPVV

SEQ ID NO: 268652 - protein, 8 aa, Influenza virus
NNFVPVVG

SEQ ID NO: 268653 - protein, 8 aa, Influenza virus
NFVPVVGA

SEQ ID NO: 268654 - protein, 8 aa, Influenza virus
FVPVVGAR

SEQ ID NO: 268655 - protein, 8 aa, Influenza virus
VPVVGARP

SEQ ID NO: 268656 - protein, 8 aa, Influenza virus
PVVGARPQ

SEQ ID NO: 268657 - protein, 8 aa, Influenza virus
VVGARPQV

SEQ ID NO: 268658 - protein, 8 aa, Influenza virus
VGARPQVN

SEQ ID NO: 268659 - protein, 8 aa, Influenza virus
GARPQVNG

SEQ ID NO: 268660 - protein, 8 aa, Influenza virus
ARPQVNGQ

SEQ ID NO: 268661 - protein, 8 aa, Influenza virus
RPQVNGQS

SEQ ID NO: 268662 - protein, 8 aa, Influenza virus
PQVNGQSG

SEQ ID NO: 268663 - protein, 8 aa, Influenza virus
QVNGQSGR

SEQ ID NO: 268664 - protein, 8 aa, Influenza virus
VNGQSGRI

SEQ ID NO: 268665 - protein, 8 aa, Influenza virus
NGQSGRID

SEQ ID NO: 268666 - protein, 8 aa, Influenza virus
GQSGRIDF

SEQ ID NO: 268667 - protein, 8 aa, Influenza virus
QSGRIDFH

SEQ ID NO: 268668 - protein, 8 aa, Influenza virus
SGRIDFHW

SEQ ID NO: 268669 - protein, 8 aa, Influenza virus
GRIDFHWT

SEQ ID NO: 268670 - protein, 8 aa, Influenza virus
QPGDNITF

SEQ ID NO: 268671 - protein, 8 aa, Influenza virus
PGDNITFS

SEQ ID NO: 268672 - protein, 8 aa, Influenza virus
GDNITFSH

SEQ ID NO: 268673 - protein, 8 aa, Influenza virus
DNITFSHN

SEQ ID NO: 268674 - protein, 8 aa, Influenza virus
NITFSHNG

SEQ ID NO: 268675 - protein, 8 aa, Influenza virus
ITFSHNGG

SEQ ID NO: 268676 - protein, 8 aa, Influenza virus
TFSHNGGL

SEQ ID NO: 268677 - protein, 8 aa, Influenza virus
FSHNGGLI

SEQ ID NO: 268678 - protein, 8 aa, Influenza virus
SHNGGLIA

SEQ ID NO: 268679 - protein, 8 aa, Influenza virus
HNGGLIAP

SEQ ID NO: 268680 - protein, 8 aa, Influenza virus
NGGLIAPS

SEQ ID NO: 268681 - protein, 8 aa, Influenza virus
GGLIAPSR

SEQ ID NO: 268682 - protein, 8 aa, Influenza virus
GLIAPSRV

SEQ ID NO: 268683 - protein, 8 aa, Influenza virus
IAPSRVSK

SEQ ID NO: 268684 - protein, 8 aa, Influenza virus
APSRVSKL

SEQ ID NO: 268685 - protein, 8 aa, Influenza virus
GRGLGIQS

SEQ ID NO: 268686 - protein, 8 aa, Influenza virus
DCESKCFW

SEQ ID NO: 268687 - protein, 8 aa, Influenza virus
CESKCFWK

SEQ ID NO: 268688 - protein, 8 aa, Influenza virus
ESKCFWKG

SEQ ID NO: 268689 - protein, 8 aa, Influenza virus
SKCFWKGG

SEQ ID NO: 268690 - protein, 8 aa, Influenza virus
KCFWKGGS

SEQ ID NO: 268691 - protein, 8 aa, Influenza virus
CFWKGGSI

SEQ ID NO: 268692 - protein, 8 aa, Influenza virus
FWKGGSIN

SEQ ID NO: 268693 - protein, 8 aa, Influenza virus
WKGGSINT

SEQ ID NO: 268694 - protein, 8 aa, Influenza virus
GGSINTKL

SEQ ID NO: 268695 - protein, 8 aa, Influenza virus
GSINTKLP

SEQ ID NO: 268696 - protein, 8 aa, Influenza virus
SINTKLPF

SEQ ID NO: 268697 - protein, 8 aa, Influenza virus
INTKLPFQ

SEQ ID NO: 268698 - protein, 8 aa, Influenza virus
NTKLPFQN

SEQ ID NO: 268699 - protein, 8 aa, Influenza virus
TKLPFQNL

SEQ ID NO: 268700 - protein, 8 aa, Influenza virus
KLPFQNLS

SEQ ID NO: 268701 - protein, 8 aa, Influenza virus
LPFQNLSP

SEQ ID NO: 268702 - protein, 8 aa, Influenza virus
PFQNLSPR

SEQ ID NO: 268703 - protein, 8 aa, Influenza virus
FQNLSPRT

SEQ ID NO: 268704 - protein, 8 aa, Influenza virus
QNLSPRTV

SEQ ID NO: 268705 - protein, 8 aa, Influenza virus
NLSPRTVG

SEQ ID NO: 268706 - protein, 8 aa, Influenza virus
LSPRTVGQ

SEQ ID NO: 268707 - protein, 8 aa, Influenza virus
SPRTVGQC

SEQ ID NO: 268708 - protein, 8 aa, Influenza virus
PRTVGQCP

SEQ ID NO: 268709 - protein, 8 aa, Influenza virus
RTVGQCPK

SEQ ID NO: 268710 - protein, 8 aa, Influenza virus
TVGQCPKY

SEQ ID NO: 268711 - protein, 8 aa, Influenza virus
VGQCPKYV

SEQ ID NO: 268712 - protein, 8 aa, Influenza virus
GQCPKYVN

SEQ ID NO: 268713 - protein, 8 aa, Influenza virus
QCPKYVNK

SEQ ID NO: 268714 - protein, 8 aa, Influenza virus
KSLLLATG

SEQ ID NO: 268715 - protein, 8 aa, Influenza virus
SLLLATGM

SEQ ID NO: 268716 - protein, 8 aa, Influenza virus
LLLATGMR

SEQ ID NO: 268717 - protein, 8 aa, Influenza virus
LLATGMRN

SEQ ID NO: 268718 - protein, 8 aa, Influenza virus
LATGMRNV

SEQ ID NO: 268719 - protein, 8 aa, Influenza virus
ATGMRNVP

SEQ ID NO: 268720 - protein, 8 aa, Influenza virus
TGMRNVPE

SEQ ID NO: 268721 - protein, 8 aa, Influenza virus
GMRNVPEV

SEQ ID NO: 268722 - protein, 8 aa, Influenza virus
QGRGLFGA

SEQ ID NO: 268723 - protein, 8 aa, Influenza virus
GRGLFGAI

SEQ ID NO: 268724 - protein, 8 aa, Influenza virus
RGLFGAIA

SEQ ID NO: 268725 - protein, 8 aa, Influenza virus
GLFGAIAG

SEQ ID NO: 268726 - protein, 8 aa, Influenza virus
LFGAIAGF

SEQ ID NO: 268727 - protein, 8 aa, Influenza virus
FGAIAGFI

SEQ ID NO: 268728 - protein, 8 aa, Influenza virus
GAIAGFIE

SEQ ID NO: 268729 - protein, 8 aa, Influenza virus
AIAGFIEN

SEQ ID NO: 268730 - protein, 8 aa, Influenza virus
IAGFIENG

SEQ ID NO: 268731 - protein, 8 aa, Influenza virus
AGFIENGW

SEQ ID NO: 268732 - protein, 8 aa, Influenza virus
GFIENGWE

SEQ ID NO: 268733 - protein, 8 aa, Influenza virus
FIENGWEG

SEQ ID NO: 268734 - protein, 8 aa, Influenza virus
IENGWEGM

SEQ ID NO: 268735 - protein, 8 aa, Influenza virus
ENGWEGMV

SEQ ID NO: 268736 - protein, 8 aa, Influenza virus
NGWEGMVD

SEQ ID NO: 268737 - protein, 8 aa, Influenza virus
GWEGMVDG

SEQ ID NO: 268738 - protein, 8 aa, Influenza virus
WEGMVDGW

SEQ ID NO: 268739 - protein, 8 aa, Influenza virus
EGMVDGWY

SEQ ID NO: 268740 - protein, 8 aa, Influenza virus
GMVDGWYG

SEQ ID NO: 268741 - protein, 8 aa, Influenza virus
MVDGWYGF

SEQ ID NO: 268742 - protein, 8 aa, Influenza virus
VDGWYGFR

SEQ ID NO: 268743 - protein, 8 aa, Influenza virus
DGWYGFRH

SEQ ID NO: 268744 - protein, 8 aa, Influenza virus
GWYGFRHQ

SEQ ID NO: 268745 - protein, 8 aa, Influenza virus
WYGFRHQN

SEQ ID NO: 268746 - protein, 8 aa, Influenza virus
YGFRHQNA

SEQ ID NO: 268747 - protein, 8 aa, Influenza virus
GFRHQNAQ

SEQ ID NO: 268748 - protein, 8 aa, Influenza virus
FRHQNAQG

SEQ ID NO: 268749 - protein, 8 aa, Influenza virus
RHQNAQGT

SEQ ID NO: 268750 - protein, 8 aa, Influenza virus
HQNAQGTG

SEQ ID NO: 268751 - protein, 8 aa, Influenza virus
QNAQGTGQ

SEQ ID NO: 268752 - protein, 8 aa, Influenza virus
NAQGTGQA

SEQ ID NO: 268753 - protein, 8 aa, Influenza virus
AQGTGQAA

SEQ ID NO: 268754 - protein, 8 aa, Influenza virus
QGTGQAAD

SEQ ID NO: 268755 - protein, 8 aa, Influenza virus
GTGQAADY

SEQ ID NO: 268756 - protein, 8 aa, Influenza virus
TGQAADYK

SEQ ID NO: 268757 - protein, 8 aa, Influenza virus
GQAADYKS

SEQ ID NO: 268758 - protein, 8 aa, Influenza virus
QAADYKST

SEQ ID NO: 268759 - protein, 8 aa, Influenza virus
AADYKSTQ

SEQ ID NO: 268760 - protein, 8 aa, Influenza virus
ADYKSTQA

SEQ ID NO: 268761 - protein, 8 aa, Influenza virus
DYKSTQAA

SEQ ID NO: 268762 - protein, 8 aa, Influenza virus
YKSTQAAI

SEQ ID NO: 268763 - protein, 8 aa, Influenza virus
AIDQITGK

SEQ ID NO: 268764 - protein, 8 aa, Influenza virus
IDQITGKL

SEQ ID NO: 268765 - protein, 8 aa, Influenza virus
DQITGKLN

SEQ ID NO: 268766 - protein, 8 aa, Influenza virus
QITGKLNR

SEQ ID NO: 268767 - protein, 8 aa, Influenza virus
ITGKLNRL

SEQ ID NO: 268768 - protein, 8 aa, Influenza virus
TGKLNRLI

SEQ ID NO: 268769 - protein, 8 aa, Influenza virus
GKLNRLIE

SEQ ID NO: 268770 - protein, 8 aa, Influenza virus
KLNRLIEK

SEQ ID NO: 268771 - protein, 8 aa, Influenza virus
LNRLIEKT

SEQ ID NO: 268772 - protein, 8 aa, Influenza virus
NRLIEKTN

SEQ ID NO: 268773 - protein, 8 aa, Influenza virus
RLIEKTNT

SEQ ID NO: 268774 - protein, 8 aa, Influenza virus
LIEKTNTE

SEQ ID NO: 268775 - protein, 8 aa, Influenza virus
IEKTNTEF

SEQ ID NO: 268776 - protein, 8 aa, Influenza virus
EKTNTEFE

SEQ ID NO: 268777 - protein, 8 aa, Influenza virus
KTNTEFES

SEQ ID NO: 268778 - protein, 8 aa, Influenza virus
TNTEFESI

SEQ ID NO: 268779 - protein, 8 aa, Influenza virus
NTEFESIE

SEQ ID NO: 268780 - protein, 8 aa, Influenza virus
TEFESIES

SEQ ID NO: 268781 - protein, 8 aa, Influenza virus
EFESIESE

SEQ ID NO: 268782 - protein, 8 aa, Influenza virus
FESIESEF

SEQ ID NO: 268783 - protein, 8 aa, Influenza virus
ESIESEFS

SEQ ID NO: 268784 - protein, 8 aa, Influenza virus
SIESEFSE

SEQ ID NO: 268785 - protein, 8 aa, Influenza virus
IESEFSEI

SEQ ID NO: 268786 - protein, 8 aa, Influenza virus
ESEFSEIE

SEQ ID NO: 268787 - protein, 8 aa, Influenza virus
SEFSEIEH

SEQ ID NO: 268788 - protein, 8 aa, Influenza virus
EFSEIEHQ

SEQ ID NO: 268789 - protein, 8 aa, Influenza virus
FSEIEHQI

SEQ ID NO: 268790 - protein, 8 aa, Influenza virus
SEIEHQIG

SEQ ID NO: 268791 - protein, 8 aa, Influenza virus
EIEHQIGN

SEQ ID NO: 268792 - protein, 8 aa, Influenza virus
IEHQIGNV

SEQ ID NO: 268793 - protein, 8 aa, Influenza virus
EHQIGNVI

SEQ ID NO: 268794 - protein, 8 aa, Influenza virus
HQIGNVIN

SEQ ID NO: 268795 - protein, 8 aa, Influenza virus
QIGNVINW

SEQ ID NO: 268796 - protein, 8 aa, Influenza virus
IGNVINWT

SEQ ID NO: 268797 - protein, 8 aa, Influenza virus
GNVINWTK

SEQ ID NO: 268798 - protein, 8 aa, Influenza virus
NVINWTKD

SEQ ID NO: 268799 - protein, 8 aa, Influenza virus
VINWTKDS

SEQ ID NO: 268800 - protein, 8 aa, Influenza virus
INWTKDSI

SEQ ID NO: 268801 - protein, 8 aa, Influenza virus
NWTKDSIT

SEQ ID NO: 268802 - protein, 8 aa, Influenza virus
WTKDSITD

SEQ ID NO: 268803 - protein, 8 aa, Influenza virus
TKDSITDI

SEQ ID NO: 268804 - protein, 8 aa, Influenza virus
KDSITDIW

SEQ ID NO: 268805 - protein, 8 aa, Influenza virus
DSITDIWT

SEQ ID NO: 268806 - protein, 8 aa, Influenza virus
SITDIWTY

SEQ ID NO: 268807 - protein, 8 aa, Influenza virus
ITDIWTYQ

SEQ ID NO: 268808 - protein, 8 aa, Influenza virus
TDIWTYQA

SEQ ID NO: 268809 - protein, 8 aa, Influenza virus
DIWTYQAE

SEQ ID NO: 268810 - protein, 8 aa, Influenza virus
IWTYQAEL

SEQ ID NO: 268811 - protein, 8 aa, Influenza virus
WTYQAELL

SEQ ID NO: 268812 - protein, 8 aa, Influenza virus
TYQAELLV

SEQ ID NO: 268813 - protein, 8 aa, Influenza virus
YQAELLVA

SEQ ID NO: 268814 - protein, 8 aa, Influenza virus
QAELLVAM

SEQ ID NO: 268815 - protein, 8 aa, Influenza virus
AELLVAME

SEQ ID NO: 268816 - protein, 8 aa, Influenza virus
ELLVAMEN

SEQ ID NO: 268817 - protein, 8 aa, Influenza virus
LLVAMENQ

SEQ ID NO: 268818 - protein, 8 aa, Influenza virus
LVAMENQH

SEQ ID NO: 268819 - protein, 8 aa, Influenza virus
VAMENQHT

SEQ ID NO: 268820 - protein, 8 aa, Influenza virus
AMENQHTI

SEQ ID NO: 268821 - protein, 8 aa, Influenza virus
MENQHTID

SEQ ID NO: 268822 - protein, 8 aa, Influenza virus
ENQHTIDM

SEQ ID NO: 268823 - protein, 8 aa, Influenza virus
NQHTIDMA

SEQ ID NO: 268824 - protein, 8 aa, Influenza virus
QHTIDMAD

SEQ ID NO: 268825 - protein, 8 aa, Influenza virus
HTIDMADS

SEQ ID NO: 268826 - protein, 8 aa, Influenza virus
TIDMADSE

SEQ ID NO: 268827 - protein, 8 aa, Influenza virus
IDMADSEM

SEQ ID NO: 268828 - protein, 8 aa, Influenza virus
DMADSEML

SEQ ID NO: 268829 - protein, 8 aa, Influenza virus
MADSEMLN

SEQ ID NO: 268830 - protein, 8 aa, Influenza virus
ADSEMLNL

SEQ ID NO: 268831 - protein, 8 aa, Influenza virus
DSEMLNLY

SEQ ID NO: 268832 - protein, 8 aa, Influenza virus
SEMLNLYE

SEQ ID NO: 268833 - protein, 8 aa, Influenza virus
EMLNLYER

SEQ ID NO: 268834 - protein, 8 aa, Influenza virus
MLNLYERV

SEQ ID NO: 268835 - protein, 8 aa, Influenza virus
LNLYERVR

SEQ ID NO: 268836 - protein, 8 aa, Influenza virus
NLYERVRK

SEQ ID NO: 268837 - protein, 8 aa, Influenza virus
LYERVRKQ

SEQ ID NO: 268838 - protein, 8 aa, Influenza virus
YERVRKQL

SEQ ID NO: 268839 - protein, 8 aa, Influenza virus
ERVRKQLR

SEQ ID NO: 268840 - protein, 8 aa, Influenza virus
RVRKQLRQ

SEQ ID NO: 268841 - protein, 8 aa, Influenza virus
VRKQLRQN

SEQ ID NO: 268842 - protein, 8 aa, Influenza virus
RKQLRQNA

SEQ ID NO: 268843 - protein, 8 aa, Influenza virus
KQLRQNAE

SEQ ID NO: 268844 - protein, 8 aa, Influenza virus
QLRQNAEE

SEQ ID NO: 268845 - protein, 8 aa, Influenza virus
LRQNAEED

SEQ ID NO: 268846 - protein, 8 aa, Influenza virus
RQNAEEDG

SEQ ID NO: 268847 - protein, 8 aa, Influenza virus
QNAEEDGK

SEQ ID NO: 268848 - protein, 8 aa, Influenza virus
NAEEDGKG

SEQ ID NO: 268849 - protein, 8 aa, Influenza virus
AEEDGKGC

SEQ ID NO: 268850 - protein, 8 aa, Influenza virus
EEDGKGCF

SEQ ID NO: 268851 - protein, 8 aa, Influenza virus
EDGKGCFE

SEQ ID NO: 268852 - protein, 8 aa, Influenza virus
DGKGCFEI

SEQ ID NO: 268853 - protein, 8 aa, Influenza virus
GKGCFEIY

SEQ ID NO: 268854 - protein, 8 aa, Influenza virus
KGCFEIYH

SEQ ID NO: 268855 - protein, 8 aa, Influenza virus
GCFEIYHK

SEQ ID NO: 268856 - protein, 8 aa, Influenza virus
CFEIYHKC

SEQ ID NO: 268857 - protein, 8 aa, Influenza virus
FEIYHKCD

SEQ ID NO: 268858 - protein, 8 aa, Influenza virus
NCMESIRN

SEQ ID NO: 268859 - protein, 8 aa, Influenza virus
CMESIRNN

SEQ ID NO: 268860 - protein, 8 aa, Influenza virus
MESIRNNT

SEQ ID NO: 268861 - protein, 8 aa, Influenza virus
ESIRNNTY

SEQ ID NO: 268862 - protein, 8 aa, Influenza virus
SIRNNTYD

SEQ ID NO: 268863 - protein, 8 aa, Influenza virus
IRNNTYDH

SEQ ID NO: 268864 - protein, 8 aa, Influenza virus
RNNTYDHT

SEQ ID NO: 268865 - protein, 8 aa, Influenza virus
NNTYDHTQ

SEQ ID NO: 268866 - protein, 8 aa, Influenza virus
NTYDHTQY

SEQ ID NO: 268867 - protein, 8 aa, Influenza virus
TYDHTQYR

SEQ ID NO: 268868 - protein, 8 aa, Influenza virus
YDHTQYRE

SEQ ID NO: 268869 - protein, 8 aa, Influenza virus
DHTQYREE

SEQ ID NO: 268870 - protein, 8 aa, Influenza virus
HTQYREEA

SEQ ID NO: 268871 - protein, 8 aa, Influenza virus
TQYREEAL

SEQ ID NO: 268872 - protein, 8 aa, Influenza virus
QYREEALL

SEQ ID NO: 268873 - protein, 8 aa, Influenza virus
YREEALLN

SEQ ID NO: 268874 - protein, 8 aa, Influenza virus
REEALLNR

SEQ ID NO: 268875 - protein, 8 aa, Influenza virus
EEALLNRL

SEQ ID NO: 268876 - protein, 8 aa, Influenza virus
EALLNRLN

SEQ ID NO: 268877 - protein, 8 aa, Influenza virus
ALLNRLNI

SEQ ID NO: 268878 - protein, 8 aa, Influenza virus
LLNRLNIN

SEQ ID NO: 268879 - protein, 8 aa, Influenza virus
LNRLNINP

SEQ ID NO: 268880 - protein, 8 aa, Influenza virus
NRLNINPV

SEQ ID NO: 268881 - protein, 8 aa, Influenza virus
INPVKLSS

SEQ ID NO: 268882 - protein, 8 aa, Influenza virus
NPVKLSSG

SEQ ID NO: 268883 - protein, 8 aa, Influenza virus
PVKLSSGY

SEQ ID NO: 268884 - protein, 8 aa, Influenza virus
VKLSSGYK

SEQ ID NO: 268885 - protein, 8 aa, Influenza virus
KLSSGYKD

SEQ ID NO: 268886 - protein, 8 aa, Influenza virus
LSSGYKDV

SEQ ID NO: 268887 - protein, 8 aa, Influenza virus
SSGYKDVI

SEQ ID NO: 268888 - protein, 8 aa, Influenza virus
SGYKDVIL

SEQ ID NO: 268889 - protein, 8 aa, Influenza virus
GYKDVILW

SEQ ID NO: 268890 - protein, 8 aa, Influenza virus
YKDVILWF

SEQ ID NO: 268891 - protein, 8 aa, Influenza virus
KDVILWFS

SEQ ID NO: 268892 - protein, 8 aa, Influenza virus
DVILWFSF

SEQ ID NO: 268893 - protein, 8 aa, Influenza virus
VILWFSFG

SEQ ID NO: 268894 - protein, 8 aa, Influenza virus
ILWFSFGA

SEQ ID NO: 268895 - protein, 8 aa, Influenza virus
LWFSFGAS

SEQ ID NO: 268896 - protein, 8 aa, Influenza virus
WFSFGASC

SEQ ID NO: 268897 - protein, 8 aa, Influenza virus
FSFGASCF

SEQ ID NO: 268898 - protein, 8 aa, Influenza virus
SFGASCFV

SEQ ID NO: 268899 - protein, 8 aa, Influenza virus
FGASCFVL

SEQ ID NO: 268900 - protein, 8 aa, Influenza virus
GASCFVLL

SEQ ID NO: 268901 - protein, 8 aa, Influenza virus
ASCFVLLA

SEQ ID NO: 268902 - protein, 8 aa, Influenza virus
SCFVLLAV

SEQ ID NO: 268903 - protein, 8 aa, Influenza virus
FFCLKNGN

SEQ ID NO: 268904 - protein, 8 aa, Influenza virus
FCLKNGNM

SEQ ID NO: 268905 - protein, 8 aa, Influenza virus
CLKNGNMR

SEQ ID NO: 268906 - protein, 8 aa, Influenza virus
MRCTISLV

SEQ ID NO: 268907 - protein, 8 aa, Influenza virus
RCTISLVK

SEQ ID NO: 268908 - protein, 8 aa, Influenza virus
CTISLVKT

SEQ ID NO: 268909 - protein, 8 aa, Influenza virus
TISLVKTT

SEQ ID NO: 268910 - protein, 8 aa, Influenza virus
ISLVKTTL

SEQ ID NO: 268911 - protein, 8 aa, Influenza virus
SLVKTTLF

SEQ ID NO: 268912 - protein, 8 aa, Influenza virus
LVKTTLFL

SEQ ID NO: 268913 - protein, 8 aa, Influenza virus
GLDKICLG

SEQ ID NO: 268914 - protein, 8 aa, Influenza virus
LDKICLGH

SEQ ID NO: 268915 - protein, 8 aa, Influenza virus
DKICLGHH

SEQ ID NO: 268916 - protein, 8 aa, Influenza virus
KICLGHHA

SEQ ID NO: 268917 - protein, 8 aa, Influenza virus
ICLGHHAV

SEQ ID NO: 268918 - protein, 8 aa, Influenza virus
CLGHHAVS

SEQ ID NO: 268919 - protein, 8 aa, Influenza virus
LGHHAVSN

SEQ ID NO: 268920 - protein, 8 aa, Influenza virus
GHHAVSNG

SEQ ID NO: 268921 - protein, 8 aa, Influenza virus
HHAVSNGT

SEQ ID NO: 268922 - protein, 8 aa, Influenza virus
HAVSNGTI

SEQ ID NO: 268923 - protein, 8 aa, Influenza virus
SNGTIVKT

SEQ ID NO: 268924 - protein, 8 aa, Influenza virus
NGTIVKTL

SEQ ID NO: 268925 - protein, 8 aa, Influenza virus
GTIVKTLT

SEQ ID NO: 268926 - protein, 8 aa, Influenza virus
TIVKTLTN

SEQ ID NO: 268927 - protein, 8 aa, Influenza virus
IVKTLTNE

SEQ ID NO: 268928 - protein, 8 aa, Influenza virus
VKTLTNEK

SEQ ID NO: 268929 - protein, 8 aa, Influenza virus
KTLTNEKE

SEQ ID NO: 268930 - protein, 8 aa, Influenza virus
TLTNEKEE

SEQ ID NO: 268931 - protein, 8 aa, Influenza virus
LTNEKEEV

SEQ ID NO: 268932 - protein, 8 aa, Influenza virus
EKEEVTNA

SEQ ID NO: 268933 - protein, 8 aa, Influenza virus
KEEVTNAT

SEQ ID NO: 268934 - protein, 8 aa, Influenza virus
EEVTNATE

SEQ ID NO: 268935 - protein, 8 aa, Influenza virus
EVTNATET

SEQ ID NO: 268936 - protein, 8 aa, Influenza virus
VTNATETV

SEQ ID NO: 268937 - protein, 8 aa, Influenza virus
TNATETVE

SEQ ID NO: 268938 - protein, 8 aa, Influenza virus
NATETVES

SEQ ID NO: 268939 - protein, 8 aa, Influenza virus
ATETVESK

SEQ ID NO: 268940 - protein, 8 aa, Influenza virus
YKDLGNCH

SEQ ID NO: 268941 - protein, 8 aa, Influenza virus
KDLGNCHP

SEQ ID NO: 268942 - protein, 8 aa, Influenza virus
DLGNCHPI

SEQ ID NO: 268943 - protein, 8 aa, Influenza virus
LGNCHPIG

SEQ ID NO: 268944 - protein, 8 aa, Influenza virus
GNCHPIGM

SEQ ID NO: 268945 - protein, 8 aa, Influenza virus
NCHPIGMV

SEQ ID NO: 268946 - protein, 8 aa, Influenza virus
CHPIGMVI

SEQ ID NO: 268947 - protein, 8 aa, Influenza virus
HPIGMVIG

SEQ ID NO: 268948 - protein, 8 aa, Influenza virus
IGTPACDL

SEQ ID NO: 268949 - protein, 8 aa, Influenza virus
GTPACDLH

SEQ ID NO: 268950 - protein, 8 aa, Influenza virus
TPACDLHL

SEQ ID NO: 268951 - protein, 8 aa, Influenza virus
PACDLHLT

SEQ ID NO: 268952 - protein, 8 aa, Influenza virus
ACDLHLTG

SEQ ID NO: 268953 - protein, 8 aa, Influenza virus
CDLHLTGT

SEQ ID NO: 268954 - protein, 8 aa, Influenza virus
DLHLTGTW

SEQ ID NO: 268955 - protein, 8 aa, Influenza virus
LHLTGTWD

SEQ ID NO: 268956 - protein, 8 aa, Influenza virus
HLTGTWDT

SEQ ID NO: 268957 - protein, 8 aa, Influenza virus
LTGTWDTL

SEQ ID NO: 268958 - protein, 8 aa, Influenza virus
TGTWDTLI

SEQ ID NO: 268959 - protein, 8 aa, Influenza virus
GTWDTLIE

SEQ ID NO: 268960 - protein, 8 aa, Influenza virus
TWDTLIER

SEQ ID NO: 268961 - protein, 8 aa, Influenza virus
WDTLIERD

SEQ ID NO: 268962 - protein, 8 aa, Influenza virus
DTLIERDN

SEQ ID NO: 268963 - protein, 8 aa, Influenza virus
TLIERDNS

SEQ ID NO: 268964 - protein, 8 aa, Influenza virus
SIAYCYPG

SEQ ID NO: 268965 - protein, 8 aa, Influenza virus
IAYCYPGA

SEQ ID NO: 268966 - protein, 8 aa, Influenza virus
AYCYPGAT

SEQ ID NO: 268967 - protein, 8 aa, Influenza virus
YCYPGATV

SEQ ID NO: 268968 - protein, 8 aa, Influenza virus
CYPGATVN

SEQ ID NO: 268969 - protein, 8 aa, Influenza virus
YPGATVNE

SEQ ID NO: 268970 - protein, 8 aa, Influenza virus
PGATVNEE

SEQ ID NO: 268971 - protein, 8 aa, Influenza virus
GATVNEEA

SEQ ID NO: 268972 - protein, 8 aa, Influenza virus
ATVNEEAL

SEQ ID NO: 268973 - protein, 8 aa, Influenza virus
TVNEEALR

SEQ ID NO: 268974 - protein, 8 aa, Influenza virus
VNEEALRQ

SEQ ID NO: 268975 - protein, 8 aa, Influenza virus
NEEALRQK

SEQ ID NO: 268976 - protein, 8 aa, Influenza virus
EEALRQKI

SEQ ID NO: 268977 - protein, 8 aa, Influenza virus
EALRQKIM

SEQ ID NO: 268978 - protein, 8 aa, Influenza virus
ALRQKIME

SEQ ID NO: 268979 - protein, 8 aa, Influenza virus
LRQKIMES

SEQ ID NO: 268980 - protein, 8 aa, Influenza virus
RQKIMESG

SEQ ID NO: 268981 - protein, 8 aa, Influenza virus
QKIMESGG

SEQ ID NO: 268982 - protein, 8 aa, Influenza virus
KIMESGGI

SEQ ID NO: 268983 - protein, 8 aa, Influenza virus
IMESGGID

SEQ ID NO: 268984 - protein, 8 aa, Influenza virus
MESGGIDK

SEQ ID NO: 268985 - protein, 8 aa, Influenza virus
ESGGIDKI

SEQ ID NO: 268986 - protein, 8 aa, Influenza virus
SGGIDKIS

SEQ ID NO: 268987 - protein, 8 aa, Influenza virus
GGIDKIST

SEQ ID NO: 268988 - protein, 8 aa, Influenza virus
FTYGSSIN

SEQ ID NO: 268989 - protein, 8 aa, Influenza virus
TYGSSINS

SEQ ID NO: 268990 - protein, 8 aa, Influenza virus
YGSSINSA

SEQ ID NO: 268991 - protein, 8 aa, Influenza virus
GSSINSAG

SEQ ID NO: 268992 - protein, 8 aa, Influenza virus
SINSAGTT

SEQ ID NO: 268993 - protein, 8 aa, Influenza virus
GGNSFYAE

SEQ ID NO: 268994 - protein, 8 aa, Influenza virus
GNSFYAEL

SEQ ID NO: 268995 - protein, 8 aa, Influenza virus
NSFYAELK

SEQ ID NO: 268996 - protein, 8 aa, Influenza virus
SFYAELKW

SEQ ID NO: 268997 - protein, 8 aa, Influenza virus
FYAELKWL

SEQ ID NO: 268998 - protein, 8 aa, Influenza virus
YAELKWLV

SEQ ID NO: 268999 - protein, 8 aa, Influenza virus
AELKWLVS

SEQ ID NO: 269000 - protein, 8 aa, Influenza virus
ELKWLVSK

SEQ ID NO: 269001 - protein, 8 aa, Influenza virus
LKWLVSKS

SEQ ID NO: 269002 - protein, 8 aa, Influenza virus
KWLVSKSK

SEQ ID NO: 269003 - protein, 8 aa, Influenza virus
WLVSKSKG

SEQ ID NO: 269004 - protein, 8 aa, Influenza virus
LVSKSKGQ

SEQ ID NO: 269005 - protein, 8 aa, Influenza virus
KGQNFPQT

SEQ ID NO: 269006 - protein, 8 aa, Influenza virus
QNFPQTTN

SEQ ID NO: 269007 - protein, 8 aa, Influenza virus
NFPQTTNT

SEQ ID NO: 269008 - protein, 8 aa, Influenza virus
FPQTTNTY

SEQ ID NO: 269009 - protein, 8 aa, Influenza virus
PQTTNTYR

SEQ ID NO: 269010 - protein, 8 aa, Influenza virus
QTTNTYRN

SEQ ID NO: 269011 - protein, 8 aa, Influenza virus
TTNTYRNT

SEQ ID NO: 269012 - protein, 8 aa, Influenza virus
TNTYRNTD

SEQ ID NO: 269013 - protein, 8 aa, Influenza virus
NTYRNTDS

SEQ ID NO: 269014 - protein, 8 aa, Influenza virus
EHLIIWGI

SEQ ID NO: 269015 - protein, 8 aa, Influenza virus
HLIIWGIH

SEQ ID NO: 269016 - protein, 8 aa, Influenza virus
LIIWGIHH

SEQ ID NO: 269017 - protein, 8 aa, Influenza virus
IIWGIHHP

SEQ ID NO: 269018 - protein, 8 aa, Influenza virus
IWGIHHPS

SEQ ID NO: 269019 - protein, 8 aa, Influenza virus
WGIHHPSS

SEQ ID NO: 269020 - protein, 8 aa, Influenza virus
GIHHPSST

SEQ ID NO: 269021 - protein, 8 aa, Influenza virus
IHHPSSTQ

SEQ ID NO: 269022 - protein, 8 aa, Influenza virus
HHPSSTQE

SEQ ID NO: 269023 - protein, 8 aa, Influenza virus
HPSSTQEK

SEQ ID NO: 269024 - protein, 8 aa, Influenza virus
PSSTQEKN

SEQ ID NO: 269025 - protein, 8 aa, Influenza virus
SSTQEKND

SEQ ID NO: 269026 - protein, 8 aa, Influenza virus
STQEKNDL

SEQ ID NO: 269027 - protein, 8 aa, Influenza virus
TQEKNDLY

SEQ ID NO: 269028 - protein, 8 aa, Influenza virus
QEKNDLYG

SEQ ID NO: 269029 - protein, 8 aa, Influenza virus
EKNDLYGT

SEQ ID NO: 269030 - protein, 8 aa, Influenza virus
KNDLYGTQ

SEQ ID NO: 269031 - protein, 8 aa, Influenza virus
NDLYGTQS

SEQ ID NO: 269032 - protein, 8 aa, Influenza virus
DLYGTQSL

SEQ ID NO: 269033 - protein, 8 aa, Influenza virus
LYGTQSLS

SEQ ID NO: 269034 - protein, 8 aa, Influenza virus
YGTQSLSI

SEQ ID NO: 269035 - protein, 8 aa, Influenza virus
GTQSLSIS

SEQ ID NO: 269036 - protein, 8 aa, Influenza virus
TQSLSISV

SEQ ID NO: 269037 - protein, 8 aa, Influenza virus
QSLSISVG

SEQ ID NO: 269038 - protein, 8 aa, Influenza virus
SLSISVGS

SEQ ID NO: 269039 - protein, 8 aa, Influenza virus
LSISVGSS

SEQ ID NO: 269040 - protein, 8 aa, Influenza virus
SISVGSST

SEQ ID NO: 269041 - protein, 8 aa, Influenza virus
ISVGSSTY

SEQ ID NO: 269042 - protein, 8 aa, Influenza virus
SVGSSTYQ

SEQ ID NO: 269043 - protein, 8 aa, Influenza virus
VGSSTYQN

SEQ ID NO: 269044 - protein, 8 aa, Influenza virus
GSSTYQNN

SEQ ID NO: 269045 - protein, 8 aa, Influenza virus
SSTYQNNF

SEQ ID NO: 269046 - protein, 8 aa, Influenza virus
STYQNNFV

SEQ ID NO: 269047 - protein, 8 aa, Influenza virus
TYQNNFVP

SEQ ID NO: 269048 - protein, 8 aa, Influenza virus
YQNNFVPV

SEQ ID NO: 269049 - protein, 8 aa, Influenza virus
QNNFVPVV

SEQ ID NO: 269050 - protein, 8 aa, Influenza virus
NNFVPVVG

SEQ ID NO: 269051 - protein, 8 aa, Influenza virus
NFVPVVGA

SEQ ID NO: 269052 - protein, 8 aa, Influenza virus
FVPVVGAR

SEQ ID NO: 269053 - protein, 8 aa, Influenza virus
VPVVGARP

SEQ ID NO: 269054 - protein, 8 aa, Influenza virus
PVVGARPQ

SEQ ID NO: 269055 - protein, 8 aa, Influenza virus
VVGARPQV

SEQ ID NO: 269056 - protein, 8 aa, Influenza virus
VGARPQVN

SEQ ID NO: 269057 - protein, 8 aa, Influenza virus
GARPQVNG

SEQ ID NO: 269058 - protein, 8 aa, Influenza virus
ARPQVNGQ

SEQ ID NO: 269059 - protein, 8 aa, Influenza virus
RPQVNGQS

SEQ ID NO: 269060 - protein, 8 aa, Influenza virus
PQVNGQSG

SEQ ID NO: 269061 - protein, 8 aa, Influenza virus
QVNGQSGR

SEQ ID NO: 269062 - protein, 8 aa, Influenza virus
VNGQSGRI

SEQ ID NO: 269063 - protein, 8 aa, Influenza virus
NGQSGRID

SEQ ID NO: 269064 - protein, 8 aa, Influenza virus
GQSGRIDF

SEQ ID NO: 269065 - protein, 8 aa, Influenza virus
QSGRIDFH

SEQ ID NO: 269066 - protein, 8 aa, Influenza virus
SGRIDFHW

SEQ ID NO: 269067 - protein, 8 aa, Influenza virus
GRIDFHWT

SEQ ID NO: 269068 - protein, 8 aa, Influenza virus
MVQPGDNI

SEQ ID NO: 269069 - protein, 8 aa, Influenza virus
VQPGDNIT

SEQ ID NO: 269070 - protein, 8 aa, Influenza virus
QPGDNITF

SEQ ID NO: 269071 - protein, 8 aa, Influenza virus
PGDNITFS

SEQ ID NO: 269072 - protein, 8 aa, Influenza virus
GDNITFSH

SEQ ID NO: 269073 - protein, 8 aa, Influenza virus
DNITFSHN

SEQ ID NO: 269074 - protein, 8 aa, Influenza virus
NITFSHNG

SEQ ID NO: 269075 - protein, 8 aa, Influenza virus
ITFSHNGG

SEQ ID NO: 269076 - protein, 8 aa, Influenza virus
TFSHNGGL

SEQ ID NO: 269077 - protein, 8 aa, Influenza virus
FSHNGGLI

SEQ ID NO: 269078 - protein, 8 aa, Influenza virus
SHNGGLIA

SEQ ID NO: 269079 - protein, 8 aa, Influenza virus
HNGGLIAP

SEQ ID NO: 269080 - protein, 8 aa, Influenza virus
NGGLIAPS

SEQ ID NO: 269081 - protein, 8 aa, Influenza virus
GGLIAPSR

SEQ ID NO: 269082 - protein, 8 aa, Influenza virus
GLIAPSRV

SEQ ID NO: 269083 - protein, 8 aa, Influenza virus
LIAPSRVS

SEQ ID NO: 269084 - protein, 8 aa, Influenza virus
IAPSRVSK

SEQ ID NO: 269085 - protein, 8 aa, Influenza virus
APSRVSKL

SEQ ID NO: 269086 - protein, 8 aa, Influenza virus
PSRVSKLK

SEQ ID NO: 269087 - protein, 8 aa, Influenza virus
SRVSKLKG

SEQ ID NO: 269088 - protein, 8 aa, Influenza virus
GRGLGIQS

SEQ ID NO: 269089 - protein, 8 aa, Influenza virus
RGLGIQSG

SEQ ID NO: 269090 - protein, 8 aa, Influenza virus
GLGIQSGA

SEQ ID NO: 269091 - protein, 8 aa, Influenza virus
DNDCESKC

SEQ ID NO: 269092 - protein, 8 aa, Influenza virus
NDCESKCF

SEQ ID NO: 269093 - protein, 8 aa, Influenza virus
DCESKCFW

SEQ ID NO: 269094 - protein, 8 aa, Influenza virus
CESKCFWK

SEQ ID NO: 269095 - protein, 8 aa, Influenza virus
ESKCFWKG

SEQ ID NO: 269096 - protein, 8 aa, Influenza virus
SKCFWKGG

SEQ ID NO: 269097 - protein, 8 aa, Influenza virus
KCFWKGGS

SEQ ID NO: 269098 - protein, 8 aa, Influenza virus
CFWKGGSI

SEQ ID NO: 269099 - protein, 8 aa, Influenza virus
FWKGGSIN

SEQ ID NO: 269100 - protein, 8 aa, Influenza virus
WKGGSINT

SEQ ID NO: 269101 - protein, 8 aa, Influenza virus
KGGSINTK

SEQ ID NO: 269102 - protein, 8 aa, Influenza virus
GGSINTKL

SEQ ID NO: 269103 - protein, 8 aa, Influenza virus
GSINTKLP

SEQ ID NO: 269104 - protein, 8 aa, Influenza virus
SINTKLPF

SEQ ID NO: 269105 - protein, 8 aa, Influenza virus
INTKLPFQ

SEQ ID NO: 269106 - protein, 8 aa, Influenza virus
NTKLPFQN

SEQ ID NO: 269107 - protein, 8 aa, Influenza virus
TKLPFQNL

SEQ ID NO: 269108 - protein, 8 aa, Influenza virus
KLPFQNLS

SEQ ID NO: 269109 - protein, 8 aa, Influenza virus
LPFQNLSP

SEQ ID NO: 269110 - protein, 8 aa, Influenza virus
PFQNLSPR

SEQ ID NO: 269111 - protein, 8 aa, Influenza virus
FQNLSPRT

SEQ ID NO: 269112 - protein, 8 aa, Influenza virus
QNLSPRTV

SEQ ID NO: 269113 - protein, 8 aa, Influenza virus
NLSPRTVG

SEQ ID NO: 269114 - protein, 8 aa, Influenza virus
LSPRTVGQ

SEQ ID NO: 269115 - protein, 8 aa, Influenza virus
SPRTVGQC

SEQ ID NO: 269116 - protein, 8 aa, Influenza virus
PRTVGQCP

SEQ ID NO: 269117 - protein, 8 aa, Influenza virus
RTVGQCPK

SEQ ID NO: 269118 - protein, 8 aa, Influenza virus
TVGQCPKY

SEQ ID NO: 269119 - protein, 8 aa, Influenza virus
VGQCPKYV

SEQ ID NO: 269120 - protein, 8 aa, Influenza virus
GQCPKYVN

SEQ ID NO: 269121 - protein, 8 aa, Influenza virus
QCPKYVNK

SEQ ID NO: 269122 - protein, 8 aa, Influenza virus
KSLLLATG

SEQ ID NO: 269123 - protein, 8 aa, Influenza virus
SLLLATGM

SEQ ID NO: 269124 - protein, 8 aa, Influenza virus
LLLATGMR

SEQ ID NO: 269125 - protein, 8 aa, Influenza virus
LLATGMRN

SEQ ID NO: 269126 - protein, 8 aa, Influenza virus
LATGMRNV

SEQ ID NO: 269127 - protein, 8 aa, Influenza virus
ATGMRNVP

SEQ ID NO: 269128 - protein, 8 aa, Influenza virus
TGMRNVPE

SEQ ID NO: 269129 - protein, 8 aa, Influenza virus
GMRNVPEV

SEQ ID NO: 269130 - protein, 8 aa, Influenza virus
QGRGLFGA

SEQ ID NO: 269131 - protein, 8 aa, Influenza virus
GRGLFGAI

SEQ ID NO: 269132 - protein, 8 aa, Influenza virus
RGLFGAIA

SEQ ID NO: 269133 - protein, 8 aa, Influenza virus
GLFGAIAG

SEQ ID NO: 269134 - protein, 8 aa, Influenza virus
LFGAIAGF

SEQ ID NO: 269135 - protein, 8 aa, Influenza virus
FGAIAGFI

SEQ ID NO: 269136 - protein, 8 aa, Influenza virus
GAIAGFIE

SEQ ID NO: 269137 - protein, 8 aa, Influenza virus
AIAGFIEN

SEQ ID NO: 269138 - protein, 8 aa, Influenza virus
IAGFIENG

SEQ ID NO: 269139 - protein, 8 aa, Influenza virus
AGFIENGW

SEQ ID NO: 269140 - protein, 8 aa, Influenza virus
GFIENGWE

SEQ ID NO: 269141 - protein, 8 aa, Influenza virus
FIENGWEG

SEQ ID NO: 269142 - protein, 8 aa, Influenza virus
IENGWEGM

SEQ ID NO: 269143 - protein, 8 aa, Influenza virus
ENGWEGMV

SEQ ID NO: 269144 - protein, 8 aa, Influenza virus
NGWEGMVD

SEQ ID NO: 269145 - protein, 8 aa, Influenza virus
GWEGMVDG

SEQ ID NO: 269146 - protein, 8 aa, Influenza virus
WEGMVDGW

SEQ ID NO: 269147 - protein, 8 aa, Influenza virus
EGMVDGWY

SEQ ID NO: 269148 - protein, 8 aa, Influenza virus
GMVDGWYG

SEQ ID NO: 269149 - protein, 8 aa, Influenza virus
MVDGWYGF

SEQ ID NO: 269150 - protein, 8 aa, Influenza virus
VDGWYGFR

SEQ ID NO: 269151 - protein, 8 aa, Influenza virus
DGWYGFRH

SEQ ID NO: 269152 - protein, 8 aa, Influenza virus
GWYGFRHQ

SEQ ID NO: 269153 - protein, 8 aa, Influenza virus
WYGFRHQN

SEQ ID NO: 269154 - protein, 8 aa, Influenza virus
YGFRHQNA

SEQ ID NO: 269155 - protein, 8 aa, Influenza virus
GFRHQNAQ

SEQ ID NO: 269156 - protein, 8 aa, Influenza virus
FRHQNAQG

SEQ ID NO: 269157 - protein, 8 aa, Influenza virus
RHQNAQGT

SEQ ID NO: 269158 - protein, 8 aa, Influenza virus
HQNAQGTG

SEQ ID NO: 269159 - protein, 8 aa, Influenza virus
QNAQGTGQ

SEQ ID NO: 269160 - protein, 8 aa, Influenza virus
NAQGTGQA

SEQ ID NO: 269161 - protein, 8 aa, Influenza virus
AQGTGQAA

SEQ ID NO: 269162 - protein, 8 aa, Influenza virus
QGTGQAAD

SEQ ID NO: 269163 - protein, 8 aa, Influenza virus
GTGQAADY

SEQ ID NO: 269164 - protein, 8 aa, Influenza virus
TGQAADYK

SEQ ID NO: 269165 - protein, 8 aa, Influenza virus
GQAADYKS

SEQ ID NO: 269166 - protein, 8 aa, Influenza virus
QAADYKST

SEQ ID NO: 269167 - protein, 8 aa, Influenza virus
AADYKSTQ

SEQ ID NO: 269168 - protein, 8 aa, Influenza virus
ADYKSTQA

SEQ ID NO: 269169 - protein, 8 aa, Influenza virus
DYKSTQAA

SEQ ID NO: 269170 - protein, 8 aa, Influenza virus
YKSTQAAI

SEQ ID NO: 269171 - protein, 8 aa, Influenza virus
KSTQAAID

SEQ ID NO: 269172 - protein, 8 aa, Influenza virus
STQAAIDQ

SEQ ID NO: 269173 - protein, 8 aa, Influenza virus
TQAAIDQI

SEQ ID NO: 269174 - protein, 8 aa, Influenza virus
QAAIDQIT

SEQ ID NO: 269175 - protein, 8 aa, Influenza virus
AAIDQITG

SEQ ID NO: 269176 - protein, 8 aa, Influenza virus
AIDQITGK

SEQ ID NO: 269177 - protein, 8 aa, Influenza virus
IDQITGKL

SEQ ID NO: 269178 - protein, 8 aa, Influenza virus
DQITGKLN

SEQ ID NO: 269179 - protein, 8 aa, Influenza virus
QITGKLNR

SEQ ID NO: 269180 - protein, 8 aa, Influenza virus
ITGKLNRL

SEQ ID NO: 269181 - protein, 8 aa, Influenza virus
TGKLNRLI

SEQ ID NO: 269182 - protein, 8 aa, Influenza virus
GKLNRLIE

SEQ ID NO: 269183 - protein, 8 aa, Influenza virus
KLNRLIEK

SEQ ID NO: 269184 - protein, 8 aa, Influenza virus
LNRLIEKT

SEQ ID NO: 269185 - protein, 8 aa, Influenza virus
NRLIEKTN

SEQ ID NO: 269186 - protein, 8 aa, Influenza virus
RLIEKTNT

SEQ ID NO: 269187 - protein, 8 aa, Influenza virus
LIEKTNTE

SEQ ID NO: 269188 - protein, 8 aa, Influenza virus
IEKTNTEF

SEQ ID NO: 269189 - protein, 8 aa, Influenza virus
EKTNTEFE

SEQ ID NO: 269190 - protein, 8 aa, Influenza virus
KTNTEFES

SEQ ID NO: 269191 - protein, 8 aa, Influenza virus
TNTEFESI

SEQ ID NO: 269192 - protein, 8 aa, Influenza virus
NTEFESIE

SEQ ID NO: 269193 - protein, 8 aa, Influenza virus
TEFESIES

SEQ ID NO: 269194 - protein, 8 aa, Influenza virus
EFESIESE

SEQ ID NO: 269195 - protein, 8 aa, Influenza virus
FESIESEF

SEQ ID NO: 269196 - protein, 8 aa, Influenza virus
ESIESEFS

SEQ ID NO: 269197 - protein, 8 aa, Influenza virus
SIESEFSE

SEQ ID NO: 269198 - protein, 8 aa, Influenza virus
IESEFSEI

SEQ ID NO: 269199 - protein, 8 aa, Influenza virus
ESEFSEIE

SEQ ID NO: 269200 - protein, 8 aa, Influenza virus
SEFSEIEH

SEQ ID NO: 269201 - protein, 8 aa, Influenza virus
EFSEIEHQ

SEQ ID NO: 269202 - protein, 8 aa, Influenza virus
FSEIEHQI

SEQ ID NO: 269203 - protein, 8 aa, Influenza virus
SEIEHQIG

SEQ ID NO: 269204 - protein, 8 aa, Influenza virus
EIEHQIGN

SEQ ID NO: 269205 - protein, 8 aa, Influenza virus
IEHQIGNV

SEQ ID NO: 269206 - protein, 8 aa, Influenza virus
EHQIGNVI

SEQ ID NO: 269207 - protein, 8 aa, Influenza virus
HQIGNVIN

SEQ ID NO: 269208 - protein, 8 aa, Influenza virus
QIGNVINW

SEQ ID NO: 269209 - protein, 8 aa, Influenza virus
IGNVINWT

SEQ ID NO: 269210 - protein, 8 aa, Influenza virus
GNVINWTK

SEQ ID NO: 269211 - protein, 8 aa, Influenza virus
NVINWTKD

SEQ ID NO: 269212 - protein, 8 aa, Influenza virus
VINWTKDS

SEQ ID NO: 269213 - protein, 8 aa, Influenza virus
INWTKDSI

SEQ ID NO: 269214 - protein, 8 aa, Influenza virus
NWTKDSIT

SEQ ID NO: 269215 - protein, 8 aa, Influenza virus
WTKDSITD

SEQ ID NO: 269216 - protein, 8 aa, Influenza virus
TKDSITDI

SEQ ID NO: 269217 - protein, 8 aa, Influenza virus
KDSITDIW

SEQ ID NO: 269218 - protein, 8 aa, Influenza virus
DSITDIWT

SEQ ID NO: 269219 - protein, 8 aa, Influenza virus
SITDIWTY

SEQ ID NO: 269220 - protein, 8 aa, Influenza virus
ITDIWTYQ

SEQ ID NO: 269221 - protein, 8 aa, Influenza virus
TDIWTYQA

SEQ ID NO: 269222 - protein, 8 aa, Influenza virus
DIWTYQAE

SEQ ID NO: 269223 - protein, 8 aa, Influenza virus
IWTYQAEL

SEQ ID NO: 269224 - protein, 8 aa, Influenza virus
WTYQAELL

SEQ ID NO: 269225 - protein, 8 aa, Influenza virus
TYQAELLV

SEQ ID NO: 269226 - protein, 8 aa, Influenza virus
YQAELLVA

SEQ ID NO: 269227 - protein, 8 aa, Influenza virus
QAELLVAM

SEQ ID NO: 269228 - protein, 8 aa, Influenza virus
AELLVAME

SEQ ID NO: 269229 - protein, 8 aa, Influenza virus
ELLVAMEN

SEQ ID NO: 269230 - protein, 8 aa, Influenza virus
LLVAMENQ

SEQ ID NO: 269231 - protein, 8 aa, Influenza virus
LVAMENQH

SEQ ID NO: 269232 - protein, 8 aa, Influenza virus
VAMENQHT

SEQ ID NO: 269233 - protein, 8 aa, Influenza virus
AMENQHTI

SEQ ID NO: 269234 - protein, 8 aa, Influenza virus
MENQHTID

SEQ ID NO: 269235 - protein, 8 aa, Influenza virus
ENQHTIDM

SEQ ID NO: 269236 - protein, 8 aa, Influenza virus
NQHTIDMA

SEQ ID NO: 269237 - protein, 8 aa, Influenza virus
QHTIDMAD

SEQ ID NO: 269238 - protein, 8 aa, Influenza virus
HTIDMADS

SEQ ID NO: 269239 - protein, 8 aa, Influenza virus
TIDMADSE

SEQ ID NO: 269240 - protein, 8 aa, Influenza virus
IDMADSEM

SEQ ID NO: 269241 - protein, 8 aa, Influenza virus
DMADSEML

SEQ ID NO: 269242 - protein, 8 aa, Influenza virus
MADSEMLN

SEQ ID NO: 269243 - protein, 8 aa, Influenza virus
ADSEMLNL

SEQ ID NO: 269244 - protein, 8 aa, Influenza virus
DSEMLNLY

SEQ ID NO: 269245 - protein, 8 aa, Influenza virus
SEMLNLYE

SEQ ID NO: 269246 - protein, 8 aa, Influenza virus
EMLNLYER

SEQ ID NO: 269247 - protein, 8 aa, Influenza virus
MLNLYERV

SEQ ID NO: 269248 - protein, 8 aa, Influenza virus
LNLYERVR

SEQ ID NO: 269249 - protein, 8 aa, Influenza virus
NLYERVRK

SEQ ID NO: 269250 - protein, 8 aa, Influenza virus
LYERVRKQ

SEQ ID NO: 269251 - protein, 8 aa, Influenza virus
YERVRKQL

SEQ ID NO: 269252 - protein, 8 aa, Influenza virus
ERVRKQLR

SEQ ID NO: 269253 - protein, 8 aa, Influenza virus
RVRKQLRQ

SEQ ID NO: 269254 - protein, 8 aa, Influenza virus
VRKQLRQN

SEQ ID NO: 269255 - protein, 8 aa, Influenza virus
RKQLRQNA

SEQ ID NO: 269256 - protein, 8 aa, Influenza virus
KQLRQNAE

SEQ ID NO: 269257 - protein, 8 aa, Influenza virus
QLRQNAEE

SEQ ID NO: 269258 - protein, 8 aa, Influenza virus
LRQNAEED

SEQ ID NO: 269259 - protein, 8 aa, Influenza virus
RQNAEEDG

SEQ ID NO: 269260 - protein, 8 aa, Influenza virus
QNAEEDGK

SEQ ID NO: 269261 - protein, 8 aa, Influenza virus
NAEEDGKG

SEQ ID NO: 269262 - protein, 8 aa, Influenza virus
AEEDGKGC

SEQ ID NO: 269263 - protein, 8 aa, Influenza virus
EEDGKGCF

SEQ ID NO: 269264 - protein, 8 aa, Influenza virus
EDGKGCFE

SEQ ID NO: 269265 - protein, 8 aa, Influenza virus
DGKGCFEI

SEQ ID NO: 269266 - protein, 8 aa, Influenza virus
GKGCFEIY

SEQ ID NO: 269267 - protein, 8 aa, Influenza virus
KGCFEIYH

SEQ ID NO: 269268 - protein, 8 aa, Influenza virus
GCFEIYHK

SEQ ID NO: 269269 - protein, 8 aa, Influenza virus
CFEIYHKC

SEQ ID NO: 269270 - protein, 8 aa, Influenza virus
FEIYHKCD

SEQ ID NO: 269271 - protein, 8 aa, Influenza virus
CDDNCMES

SEQ ID NO: 269272 - protein, 8 aa, Influenza virus
DDNCMESI

SEQ ID NO: 269273 - protein, 8 aa, Influenza virus
DNCMESIR

SEQ ID NO: 269274 - protein, 8 aa, Influenza virus
NCMESIRN

SEQ ID NO: 269275 - protein, 8 aa, Influenza virus
CMESIRNN

SEQ ID NO: 269276 - protein, 8 aa, Influenza virus
MESIRNNT

SEQ ID NO: 269277 - protein, 8 aa, Influenza virus
ESIRNNTY

SEQ ID NO: 269278 - protein, 8 aa, Influenza virus
SIRNNTYD

SEQ ID NO: 269279 - protein, 8 aa, Influenza virus
IRNNTYDH

SEQ ID NO: 269280 - protein, 8 aa, Influenza virus
RNNTYDHT

SEQ ID NO: 269281 - protein, 8 aa, Influenza virus
NNTYDHTQ

SEQ ID NO: 269282 - protein, 8 aa, Influenza virus
NTYDHTQY

SEQ ID NO: 269283 - protein, 8 aa, Influenza virus
TYDHTQYR

SEQ ID NO: 269284 - protein, 8 aa, Influenza virus
YDHTQYRE

SEQ ID NO: 269285 - protein, 8 aa, Influenza virus
DHTQYREE

SEQ ID NO: 269286 - protein, 8 aa, Influenza virus
HTQYREEA

SEQ ID NO: 269287 - protein, 8 aa, Influenza virus
TQYREEAL

SEQ ID NO: 269288 - protein, 8 aa, Influenza virus
QYREEALL

SEQ ID NO: 269289 - protein, 8 aa, Influenza virus
YREEALLN

SEQ ID NO: 269290 - protein, 8 aa, Influenza virus
REEALLNR

SEQ ID NO: 269291 - protein, 8 aa, Influenza virus
EEALLNRL

SEQ ID NO: 269292 - protein, 8 aa, Influenza virus
EALLNRLN

SEQ ID NO: 269293 - protein, 8 aa, Influenza virus
ALLNRLNI

SEQ ID NO: 269294 - protein, 8 aa, Influenza virus
LLNRLNIN

SEQ ID NO: 269295 - protein, 8 aa, Influenza virus
LNRLNINP

SEQ ID NO: 269296 - protein, 8 aa, Influenza virus
NRLNINPV

SEQ ID NO: 269297 - protein, 8 aa, Influenza virus
RLNINPVK

SEQ ID NO: 269298 - protein, 8 aa, Influenza virus
LNINPVKL

SEQ ID NO: 269299 - protein, 8 aa, Influenza virus
NINPVKLS

SEQ ID NO: 269300 - protein, 8 aa, Influenza virus
INPVKLSS

SEQ ID NO: 269301 - protein, 8 aa, Influenza virus
NPVKLSSG

SEQ ID NO: 269302 - protein, 8 aa, Influenza virus
PVKLSSGY

SEQ ID NO: 269303 - protein, 8 aa, Influenza virus
VKLSSGYK

SEQ ID NO: 269304 - protein, 8 aa, Influenza virus
KLSSGYKD

SEQ ID NO: 269305 - protein, 8 aa, Influenza virus
LSSGYKDV

SEQ ID NO: 269306 - protein, 8 aa, Influenza virus
SSGYKDVI

SEQ ID NO: 269307 - protein, 8 aa, Influenza virus
SGYKDVIL

SEQ ID NO: 269308 - protein, 8 aa, Influenza virus
GYKDVILW

SEQ ID NO: 269309 - protein, 8 aa, Influenza virus
YKDVILWF

SEQ ID NO: 269310 - protein, 8 aa, Influenza virus
KDVILWFS

SEQ ID NO: 269311 - protein, 8 aa, Influenza virus
DVILWFSF

SEQ ID NO: 269312 - protein, 8 aa, Influenza virus
VILWFSFG

SEQ ID NO: 269313 - protein, 8 aa, Influenza virus
ILWFSFGA

SEQ ID NO: 269314 - protein, 8 aa, Influenza virus
LWFSFGAS

SEQ ID NO: 269315 - protein, 8 aa, Influenza virus
WFSFGASC

SEQ ID NO: 269316 - protein, 8 aa, Influenza virus
FSFGASCF

SEQ ID NO: 269317 - protein, 8 aa, Influenza virus
SFGASCFV

SEQ ID NO: 269318 - protein, 8 aa, Influenza virus
FGASCFVL

SEQ ID NO: 269319 - protein, 8 aa, Influenza virus
GASCFVLL

SEQ ID NO: 269320 - protein, 8 aa, Influenza virus
ASCFVLLA

SEQ ID NO: 269321 - protein, 8 aa, Influenza virus
SCFVLLAV

SEQ ID NO: 269322 - protein, 8 aa, Influenza virus
CFVLLAVI

SEQ ID NO: 269323 - protein, 8 aa, Influenza virus
LLAVIMGL

SEQ ID NO: 269324 - protein, 8 aa, Influenza virus
IMGLVFFC

SEQ ID NO: 269325 - protein, 8 aa, Influenza virus
MGLVFFCL

SEQ ID NO: 269326 - protein, 8 aa, Influenza virus
GLVFFCLK

SEQ ID NO: 269327 - protein, 8 aa, Influenza virus
LVFFCLKN

SEQ ID NO: 269328 - protein, 8 aa, Influenza virus
VFFCLKNG

SEQ ID NO: 269329 - protein, 8 aa, Influenza virus
FFCLKNGN

SEQ ID NO: 269330 - protein, 8 aa, Influenza virus
FCLKNGNM

SEQ ID NO: 269331 - protein, 8 aa, Influenza virus
CLKNGNMR

SEQ ID NO: 269332 - protein, 8 aa, Influenza virus
LKNGNMRC

SEQ ID NO: 269333 - protein, 8 aa, Influenza virus
KNGNMRCT

SEQ ID NO: 269334 - protein, 8 aa, Influenza virus
NGNMRCTI

SEQ ID NO: 269335 - protein, 8 aa, Influenza virus
GNMRCTIC

SEQ ID NO: 269336 - protein, 8 aa, Influenza virus
NMRCTICI

SEQ ID NO: 269337 - protein, 8 aa, Influenza virus
MNPNQKLF

SEQ ID NO: 269338 - protein, 8 aa, Influenza virus
NPNQKLFA

SEQ ID NO: 269339 - protein, 8 aa, Influenza virus
PNQKLFAL

SEQ ID NO: 269340 - protein, 8 aa, Influenza virus
NQKLFALS

SEQ ID NO: 269341 - protein, 8 aa, Influenza virus
QKLFALSG

SEQ ID NO: 269342 - protein, 8 aa, Influenza virus
KLFALSGV

SEQ ID NO: 269343 - protein, 8 aa, Influenza virus
LFALSGVA

SEQ ID NO: 269344 - protein, 8 aa, Influenza virus
FALSGVAI

SEQ ID NO: 269345 - protein, 8 aa, Influenza virus
ALSGVAIA

SEQ ID NO: 269346 - protein, 8 aa, Influenza virus
LSGVAIAL

SEQ ID NO: 269347 - protein, 8 aa, Influenza virus
SGVAIALS

SEQ ID NO: 269348 - protein, 8 aa, Influenza virus
LNLLIGIS

SEQ ID NO: 269349 - protein, 8 aa, Influenza virus
NLLIGISN

SEQ ID NO: 269350 - protein, 8 aa, Influenza virus
LLIGISNV

SEQ ID NO: 269351 - protein, 8 aa, Influenza virus
LIGISNVG

SEQ ID NO: 269352 - protein, 8 aa, Influenza virus
IGISNVGL

SEQ ID NO: 269353 - protein, 8 aa, Influenza virus
GISNVGLN

SEQ ID NO: 269354 - protein, 8 aa, Influenza virus
ISNVGLNV

SEQ ID NO: 269355 - protein, 8 aa, Influenza virus
SNVGLNVS

SEQ ID NO: 269356 - protein, 8 aa, Influenza virus
NVGLNVSL

SEQ ID NO: 269357 - protein, 8 aa, Influenza virus
VGLNVSLH

SEQ ID NO: 269358 - protein, 8 aa, Influenza virus
GLNVSLHL

SEQ ID NO: 269359 - protein, 8 aa, Influenza virus
LNVSLHLK

SEQ ID NO: 269360 - protein, 8 aa, Influenza virus
EKGTKQEE

SEQ ID NO: 269361 - protein, 8 aa, Influenza virus
TQNNTTLI

SEQ ID NO: 269362 - protein, 8 aa, Influenza virus
QNNTTLIE

SEQ ID NO: 269363 - protein, 8 aa, Influenza virus
NNTTLIEN

SEQ ID NO: 269364 - protein, 8 aa, Influenza virus
NTTLIENT

SEQ ID NO: 269365 - protein, 8 aa, Influenza virus
TTLIENTY

SEQ ID NO: 269366 - protein, 8 aa, Influenza virus
TLIENTYV

SEQ ID NO: 269367 - protein, 8 aa, Influenza virus
LIENTYVN

SEQ ID NO: 269368 - protein, 8 aa, Influenza virus
IENTYVNN

SEQ ID NO: 269369 - protein, 8 aa, Influenza virus
ENTYVNNT

SEQ ID NO: 269370 - protein, 8 aa, Influenza virus
NTYVNNTT

SEQ ID NO: 269371 - protein, 8 aa, Influenza virus
TYVNNTTV

SEQ ID NO: 269372 - protein, 8 aa, Influenza virus
YVNNTTVI

SEQ ID NO: 269373 - protein, 8 aa, Influenza virus
VNNTTVIN

SEQ ID NO: 269374 - protein, 8 aa, Influenza virus
NNTTVINK

SEQ ID NO: 269375 - protein, 8 aa, Influenza virus
YLMLNKSL

SEQ ID NO: 269376 - protein, 8 aa, Influenza virus
LMLNKSLC

SEQ ID NO: 269377 - protein, 8 aa, Influenza virus
MLNKSLCK

SEQ ID NO: 269378 - protein, 8 aa, Influenza virus
LNKSLCKV

SEQ ID NO: 269379 - protein, 8 aa, Influenza virus
NKSLCKVE

SEQ ID NO: 269380 - protein, 8 aa, Influenza virus
KSLCKVEG

SEQ ID NO: 269381 - protein, 8 aa, Influenza virus
SLCKVEGW

SEQ ID NO: 269382 - protein, 8 aa, Influenza virus
LCKVEGWV

SEQ ID NO: 269383 - protein, 8 aa, Influenza virus
CKVEGWVV

SEQ ID NO: 269384 - protein, 8 aa, Influenza virus
KVEGWVVV

SEQ ID NO: 269385 - protein, 8 aa, Influenza virus
VEGWVVVA

SEQ ID NO: 269386 - protein, 8 aa, Influenza virus
EGWVVVAK

SEQ ID NO: 269387 - protein, 8 aa, Influenza virus
GWVVVAKD

SEQ ID NO: 269388 - protein, 8 aa, Influenza virus
WVVVAKDN

SEQ ID NO: 269389 - protein, 8 aa, Influenza virus
VVVAKDNA

SEQ ID NO: 269390 - protein, 8 aa, Influenza virus
VVAKDNAI

SEQ ID NO: 269391 - protein, 8 aa, Influenza virus
VAKDNAIR

SEQ ID NO: 269392 - protein, 8 aa, Influenza virus
AKDNAIRF

SEQ ID NO: 269393 - protein, 8 aa, Influenza virus
KDNAIRFG

SEQ ID NO: 269394 - protein, 8 aa, Influenza virus
DNAIRFGE

SEQ ID NO: 269395 - protein, 8 aa, Influenza virus
NAIRFGES

SEQ ID NO: 269396 - protein, 8 aa, Influenza virus
AIRFGESE

SEQ ID NO: 269397 - protein, 8 aa, Influenza virus
IRFGESEQ

SEQ ID NO: 269398 - protein, 8 aa, Influenza virus
RFGESEQI

SEQ ID NO: 269399 - protein, 8 aa, Influenza virus
FGESEQII

SEQ ID NO: 269400 - protein, 8 aa, Influenza virus
GESEQIIV

SEQ ID NO: 269401 - protein, 8 aa, Influenza virus
ESEQIIVT

SEQ ID NO: 269402 - protein, 8 aa, Influenza virus
SEQIIVTR

SEQ ID NO: 269403 - protein, 8 aa, Influenza virus
EQIIVTRE

SEQ ID NO: 269404 - protein, 8 aa, Influenza virus
QIIVTREP

SEQ ID NO: 269405 - protein, 8 aa, Influenza virus
IIVTREPY

SEQ ID NO: 269406 - protein, 8 aa, Influenza virus
IVTREPYV

SEQ ID NO: 269407 - protein, 8 aa, Influenza virus
VTREPYVS

SEQ ID NO: 269408 - protein, 8 aa, Influenza virus
TREPYVSC

SEQ ID NO: 269409 - protein, 8 aa, Influenza virus
REPYVSCD

SEQ ID NO: 269410 - protein, 8 aa, Influenza virus
EPYVSCDP

SEQ ID NO: 269411 - protein, 8 aa, Influenza virus
PYVSCDPL

SEQ ID NO: 269412 - protein, 8 aa, Influenza virus
YVSCDPLG

SEQ ID NO: 269413 - protein, 8 aa, Influenza virus
VSCDPLGC

SEQ ID NO: 269414 - protein, 8 aa, Influenza virus
SCDPLGCK

SEQ ID NO: 269415 - protein, 8 aa, Influenza virus
CDPLGCKM

SEQ ID NO: 269416 - protein, 8 aa, Influenza virus
DPLGCKMY

SEQ ID NO: 269417 - protein, 8 aa, Influenza virus
PLGCKMYA

SEQ ID NO: 269418 - protein, 8 aa, Influenza virus
LGCKMYAL

SEQ ID NO: 269419 - protein, 8 aa, Influenza virus
GCKMYALH

SEQ ID NO: 269420 - protein, 8 aa, Influenza virus
CKMYALHQ

SEQ ID NO: 269421 - protein, 8 aa, Influenza virus
KMYALHQG

SEQ ID NO: 269422 - protein, 8 aa, Influenza virus
MYALHQGT

SEQ ID NO: 269423 - protein, 8 aa, Influenza virus
YALHQGTT

SEQ ID NO: 269424 - protein, 8 aa, Influenza virus
ALHQGTTI

SEQ ID NO: 269425 - protein, 8 aa, Influenza virus
LHQGTTIR

SEQ ID NO: 269426 - protein, 8 aa, Influenza virus
HQGTTIRN

SEQ ID NO: 269427 - protein, 8 aa, Influenza virus
QGTTIRNK

SEQ ID NO: 269428 - protein, 8 aa, Influenza virus
GTTIRNKH

SEQ ID NO: 269429 - protein, 8 aa, Influenza virus
TTIRNKHS

SEQ ID NO: 269430 - protein, 8 aa, Influenza virus
TIRNKHSN

SEQ ID NO: 269431 - protein, 8 aa, Influenza virus
IRNKHSNG

SEQ ID NO: 269432 - protein, 8 aa, Influenza virus
RNKHSNGT

SEQ ID NO: 269433 - protein, 8 aa, Influenza virus
NKHSNGTI

SEQ ID NO: 269434 - protein, 8 aa, Influenza virus
KHSNGTIH

SEQ ID NO: 269435 - protein, 8 aa, Influenza virus
HSNGTIHD

SEQ ID NO: 269436 - protein, 8 aa, Influenza virus
SNGTIHDR

SEQ ID NO: 269437 - protein, 8 aa, Influenza virus
NGTIHDRT

SEQ ID NO: 269438 - protein, 8 aa, Influenza virus
GTIHDRTA

SEQ ID NO: 269439 - protein, 8 aa, Influenza virus
TIHDRTAF

SEQ ID NO: 269440 - protein, 8 aa, Influenza virus
IHDRTAFR

SEQ ID NO: 269441 - protein, 8 aa, Influenza virus
HDRTAFRG

SEQ ID NO: 269442 - protein, 8 aa, Influenza virus
DRTAFRGL

SEQ ID NO: 269443 - protein, 8 aa, Influenza virus
RTAFRGLI

SEQ ID NO: 269444 - protein, 8 aa, Influenza virus
TAFRGLIS

SEQ ID NO: 269445 - protein, 8 aa, Influenza virus
AFRGLIST

SEQ ID NO: 269446 - protein, 8 aa, Influenza virus
FRGLISTP

SEQ ID NO: 269447 - protein, 8 aa, Influenza virus
RGLISTPL

SEQ ID NO: 269448 - protein, 8 aa, Influenza virus
GLISTPLG

SEQ ID NO: 269449 - protein, 8 aa, Influenza virus
LISTPLGS

SEQ ID NO: 269450 - protein, 8 aa, Influenza virus
ISTPLGSP

SEQ ID NO: 269451 - protein, 8 aa, Influenza virus
STPLGSPP

SEQ ID NO: 269452 - protein, 8 aa, Influenza virus
TPLGSPPI

SEQ ID NO: 269453 - protein, 8 aa, Influenza virus
PLGSPPIV

SEQ ID NO: 269454 - protein, 8 aa, Influenza virus
LGSPPIVS

SEQ ID NO: 269455 - protein, 8 aa, Influenza virus
GSPPIVSN

SEQ ID NO: 269456 - protein, 8 aa, Influenza virus
SPPIVSNS

SEQ ID NO: 269457 - protein, 8 aa, Influenza virus
PPIVSNSD

SEQ ID NO: 269458 - protein, 8 aa, Influenza virus
PIVSNSDF

SEQ ID NO: 269459 - protein, 8 aa, Influenza virus
VSNSDFLC

SEQ ID NO: 269460 - protein, 8 aa, Influenza virus
SNSDFLCV

SEQ ID NO: 269461 - protein, 8 aa, Influenza virus
NSDFLCVG

SEQ ID NO: 269462 - protein, 8 aa, Influenza virus
SDFLCVGW

SEQ ID NO: 269463 - protein, 8 aa, Influenza virus
DFLCVGWS

SEQ ID NO: 269464 - protein, 8 aa, Influenza virus
FLCVGWSS

SEQ ID NO: 269465 - protein, 8 aa, Influenza virus
LCVGWSST

SEQ ID NO: 269466 - protein, 8 aa, Influenza virus
CVGWSSTS

SEQ ID NO: 269467 - protein, 8 aa, Influenza virus
VGWSSTSC

SEQ ID NO: 269468 - protein, 8 aa, Influenza virus
GWSSTSCH

SEQ ID NO: 269469 - protein, 8 aa, Influenza virus
WSSTSCHD

SEQ ID NO: 269470 - protein, 8 aa, Influenza virus
SSTSCHDG

SEQ ID NO: 269471 - protein, 8 aa, Influenza virus
STSCHDGI

SEQ ID NO: 269472 - protein, 8 aa, Influenza virus
TSCHDGIG

SEQ ID NO: 269473 - protein, 8 aa, Influenza virus
SCHDGIGR

SEQ ID NO: 269474 - protein, 8 aa, Influenza virus
CHDGIGRM

SEQ ID NO: 269475 - protein, 8 aa, Influenza virus
HDGIGRMT

SEQ ID NO: 269476 - protein, 8 aa, Influenza virus
DGIGRMTI

SEQ ID NO: 269477 - protein, 8 aa, Influenza virus
GIGRMTIC

SEQ ID NO: 269478 - protein, 8 aa, Influenza virus
IGRMTICV

SEQ ID NO: 269479 - protein, 8 aa, Influenza virus
GRMTICVQ

SEQ ID NO: 269480 - protein, 8 aa, Influenza virus
RMTICVQG

SEQ ID NO: 269481 - protein, 8 aa, Influenza virus
MTICVQGN

SEQ ID NO: 269482 - protein, 8 aa, Influenza virus
TICVQGNN

SEQ ID NO: 269483 - protein, 8 aa, Influenza virus
ICVQGNND

SEQ ID NO: 269484 - protein, 8 aa, Influenza virus
CVQGNNDN

SEQ ID NO: 269485 - protein, 8 aa, Influenza virus
VQGNNDNA

SEQ ID NO: 269486 - protein, 8 aa, Influenza virus
QGNNDNAT

SEQ ID NO: 269487 - protein, 8 aa, Influenza virus
GNNDNATA

SEQ ID NO: 269488 - protein, 8 aa, Influenza virus
NNDNATAT

SEQ ID NO: 269489 - protein, 8 aa, Influenza virus
NDNATATV

SEQ ID NO: 269490 - protein, 8 aa, Influenza virus
DNATATVY

SEQ ID NO: 269491 - protein, 8 aa, Influenza virus
NATATVYY

SEQ ID NO: 269492 - protein, 8 aa, Influenza virus
ATATVYYD

SEQ ID NO: 269493 - protein, 8 aa, Influenza virus
TATVYYDR

SEQ ID NO: 269494 - protein, 8 aa, Influenza virus
ATVYYDRR

SEQ ID NO: 269495 - protein, 8 aa, Influenza virus
TVYYDRRL

SEQ ID NO: 269496 - protein, 8 aa, Influenza virus
VYYDRRLT

SEQ ID NO: 269497 - protein, 8 aa, Influenza virus
YYDRRLTT

SEQ ID NO: 269498 - protein, 8 aa, Influenza virus
YDRRLTTT

SEQ ID NO: 269499 - protein, 8 aa, Influenza virus
DRRLTTTI

SEQ ID NO: 269500 - protein, 8 aa, Influenza virus
RRLTTTIK

SEQ ID NO: 269501 - protein, 8 aa, Influenza virus
RLTTTIKT

SEQ ID NO: 269502 - protein, 8 aa, Influenza virus
LTTTIKTW

SEQ ID NO: 269503 - protein, 8 aa, Influenza virus
TTTIKTWA

SEQ ID NO: 269504 - protein, 8 aa, Influenza virus
TTIKTWAG

SEQ ID NO: 269505 - protein, 8 aa, Influenza virus
TIKTWAGN

SEQ ID NO: 269506 - protein, 8 aa, Influenza virus
IKTWAGNI

SEQ ID NO: 269507 - protein, 8 aa, Influenza virus
KTWAGNIL

SEQ ID NO: 269508 - protein, 8 aa, Influenza virus
TWAGNILR

SEQ ID NO: 269509 - protein, 8 aa, Influenza virus
WAGNILRT

SEQ ID NO: 269510 - protein, 8 aa, Influenza virus
AGNILRTQ

SEQ ID NO: 269511 - protein, 8 aa, Influenza virus
GNILRTQE

SEQ ID NO: 269512 - protein, 8 aa, Influenza virus
NILRTQES

SEQ ID NO: 269513 - protein, 8 aa, Influenza virus
ILRTQESE

SEQ ID NO: 269514 - protein, 8 aa, Influenza virus
LRTQESEC

SEQ ID NO: 269515 - protein, 8 aa, Influenza virus
RTQESECV

SEQ ID NO: 269516 - protein, 8 aa, Influenza virus
TQESECVC

SEQ ID NO: 269517 - protein, 8 aa, Influenza virus
QESECVCH

SEQ ID NO: 269518 - protein, 8 aa, Influenza virus
ESECVCHN

SEQ ID NO: 269519 - protein, 8 aa, Influenza virus
SECVCHNG

SEQ ID NO: 269520 - protein, 8 aa, Influenza virus
ECVCHNGT

SEQ ID NO: 269521 - protein, 8 aa, Influenza virus
CVCHNGTC

SEQ ID NO: 269522 - protein, 8 aa, Influenza virus
VCHNGTCV

SEQ ID NO: 269523 - protein, 8 aa, Influenza virus
CHNGTCVV

SEQ ID NO: 269524 - protein, 8 aa, Influenza virus
HNGTCVVI

SEQ ID NO: 269525 - protein, 8 aa, Influenza virus
NGTCVVIM

SEQ ID NO: 269526 - protein, 8 aa, Influenza virus
GTCVVIMT

SEQ ID NO: 269527 - protein, 8 aa, Influenza virus
TCVVIMTD

SEQ ID NO: 269528 - protein, 8 aa, Influenza virus
CVVIMTDG

SEQ ID NO: 269529 - protein, 8 aa, Influenza virus
VVIMTDGS

SEQ ID NO: 269530 - protein, 8 aa, Influenza virus
VIMTDGSA

SEQ ID NO: 269531 - protein, 8 aa, Influenza virus
IMTDGSAS

SEQ ID NO: 269532 - protein, 8 aa, Influenza virus
MTDGSASS

SEQ ID NO: 269533 - protein, 8 aa, Influenza virus
TDGSASSQ

SEQ ID NO: 269534 - protein, 8 aa, Influenza virus
DGSASSQA

SEQ ID NO: 269535 - protein, 8 aa, Influenza virus
GSASSQAY

SEQ ID NO: 269536 - protein, 8 aa, Influenza virus
SASSQAYT

SEQ ID NO: 269537 - protein, 8 aa, Influenza virus
ASSQAYTK

SEQ ID NO: 269538 - protein, 8 aa, Influenza virus
SSQAYTKV

SEQ ID NO: 269539 - protein, 8 aa, Influenza virus
QAYTKVLY

SEQ ID NO: 269540 - protein, 8 aa, Influenza virus
AYTKVLYF

SEQ ID NO: 269541 - protein, 8 aa, Influenza virus
YTKVLYFH

SEQ ID NO: 269542 - protein, 8 aa, Influenza virus
TKVLYFHK

SEQ ID NO: 269543 - protein, 8 aa, Influenza virus
KVLYFHKG

SEQ ID NO: 269544 - protein, 8 aa, Influenza virus
VLYFHKGL

SEQ ID NO: 269545 - protein, 8 aa, Influenza virus
LYFHKGLV

SEQ ID NO: 269546 - protein, 8 aa, Influenza virus
YFHKGLVI

SEQ ID NO: 269547 - protein, 8 aa, Influenza virus
FHKGLVIK

SEQ ID NO: 269548 - protein, 8 aa, Influenza virus
HKGLVIKE

SEQ ID NO: 269549 - protein, 8 aa, Influenza virus
KGLVIKEE

SEQ ID NO: 269550 - protein, 8 aa, Influenza virus
KEEALKGS

SEQ ID NO: 269551 - protein, 8 aa, Influenza virus
EEALKGSA

SEQ ID NO: 269552 - protein, 8 aa, Influenza virus
EALKGSAR

SEQ ID NO: 269553 - protein, 8 aa, Influenza virus
ALKGSARH

SEQ ID NO: 269554 - protein, 8 aa, Influenza virus
LKGSARHI

SEQ ID NO: 269555 - protein, 8 aa, Influenza virus
KGSARHIE

SEQ ID NO: 269556 - protein, 8 aa, Influenza virus
GSARHIEE

SEQ ID NO: 269557 - protein, 8 aa, Influenza virus
SARHIEEC

SEQ ID NO: 269558 - protein, 8 aa, Influenza virus
ARHIEECS

SEQ ID NO: 269559 - protein, 8 aa, Influenza virus
RHIEECSC

SEQ ID NO: 269560 - protein, 8 aa, Influenza virus
HIEECSCY

SEQ ID NO: 269561 - protein, 8 aa, Influenza virus
IEECSCYG

SEQ ID NO: 269562 - protein, 8 aa, Influenza virus
EECSCYGH

SEQ ID NO: 269563 - protein, 8 aa, Influenza virus
ECSCYGHN

SEQ ID NO: 269564 - protein, 8 aa, Influenza virus
CSCYGHNS

SEQ ID NO: 269565 - protein, 8 aa, Influenza virus
SCYGHNSK

SEQ ID NO: 269566 - protein, 8 aa, Influenza virus
CYGHNSKV

SEQ ID NO: 269567 - protein, 8 aa, Influenza virus
YGHNSKVT

SEQ ID NO: 269568 - protein, 8 aa, Influenza virus
GHNSKVTC

SEQ ID NO: 269569 - protein, 8 aa, Influenza virus
SKVTCVCR

SEQ ID NO: 269570 - protein, 8 aa, Influenza virus
KVTCVCRD

SEQ ID NO: 269571 - protein, 8 aa, Influenza virus
VTCVCRDN

SEQ ID NO: 269572 - protein, 8 aa, Influenza virus
TCVCRDNW

SEQ ID NO: 269573 - protein, 8 aa, Influenza virus
CVCRDNWQ

SEQ ID NO: 269574 - protein, 8 aa, Influenza virus
VCRDNWQG

SEQ ID NO: 269575 - protein, 8 aa, Influenza virus
CRDNWQGA

SEQ ID NO: 269576 - protein, 8 aa, Influenza virus
RDNWQGAN

SEQ ID NO: 269577 - protein, 8 aa, Influenza virus
DNWQGANR

SEQ ID NO: 269578 - protein, 8 aa, Influenza virus
NWQGANRP

SEQ ID NO: 269579 - protein, 8 aa, Influenza virus
WQGANRPV

SEQ ID NO: 269580 - protein, 8 aa, Influenza virus
QGANRPVI

SEQ ID NO: 269581 - protein, 8 aa, Influenza virus
GANRPVIE

SEQ ID NO: 269582 - protein, 8 aa, Influenza virus
ANRPVIEI

SEQ ID NO: 269583 - protein, 8 aa, Influenza virus
NRPVIEID

SEQ ID NO: 269584 - protein, 8 aa, Influenza virus
RPVIEIDM

SEQ ID NO: 269585 - protein, 8 aa, Influenza virus
AMEHTSQY

SEQ ID NO: 269586 - protein, 8 aa, Influenza virus
MEHTSQYL

SEQ ID NO: 269587 - protein, 8 aa, Influenza virus
EHTSQYLC

SEQ ID NO: 269588 - protein, 8 aa, Influenza virus
HTSQYLCT

SEQ ID NO: 269589 - protein, 8 aa, Influenza virus
TSQYLCTG

SEQ ID NO: 269590 - protein, 8 aa, Influenza virus
SQYLCTGV

SEQ ID NO: 269591 - protein, 8 aa, Influenza virus
QYLCTGVL

SEQ ID NO: 269592 - protein, 8 aa, Influenza virus
YLCTGVLT

SEQ ID NO: 269593 - protein, 8 aa, Influenza virus
LCTGVLTD

SEQ ID NO: 269594 - protein, 8 aa, Influenza virus
CTGVLTDT

SEQ ID NO: 269595 - protein, 8 aa, Influenza virus
TGVLTDTS

SEQ ID NO: 269596 - protein, 8 aa, Influenza virus
GVLTDTSR

SEQ ID NO: 269597 - protein, 8 aa, Influenza virus
VLTDTSRP

SEQ ID NO: 269598 - protein, 8 aa, Influenza virus
LTDTSRPS

SEQ ID NO: 269599 - protein, 8 aa, Influenza virus
TDTSRPSD

SEQ ID NO: 269600 - protein, 8 aa, Influenza virus
DTSRPSDK

SEQ ID NO: 269601 - protein, 8 aa, Influenza virus
GDCNNPIT

SEQ ID NO: 269602 - protein, 8 aa, Influenza virus
DCNNPITG

SEQ ID NO: 269603 - protein, 8 aa, Influenza virus
CNNPITGS

SEQ ID NO: 269604 - protein, 8 aa, Influenza virus
NNPITGSP

SEQ ID NO: 269605 - protein, 8 aa, Influenza virus
NPITGSPG

SEQ ID NO: 269606 - protein, 8 aa, Influenza virus
PITGSPGA

SEQ ID NO: 269607 - protein, 8 aa, Influenza virus
ITGSPGAP

SEQ ID NO: 269608 - protein, 8 aa, Influenza virus
TGSPGAPG

SEQ ID NO: 269609 - protein, 8 aa, Influenza virus
GSPGAPGV

SEQ ID NO: 269610 - protein, 8 aa, Influenza virus
SPGAPGVK

SEQ ID NO: 269611 - protein, 8 aa, Influenza virus
PGAPGVKG

SEQ ID NO: 269612 - protein, 8 aa, Influenza virus
GAPGVKGF

SEQ ID NO: 269613 - protein, 8 aa, Influenza virus
APGVKGFG

SEQ ID NO: 269614 - protein, 8 aa, Influenza virus
PGVKGFGF

SEQ ID NO: 269615 - protein, 8 aa, Influenza virus
GVKGFGFL

SEQ ID NO: 269616 - protein, 8 aa, Influenza virus
VKGFGFLD

SEQ ID NO: 269617 - protein, 8 aa, Influenza virus
KGFGFLDS

SEQ ID NO: 269618 - protein, 8 aa, Influenza virus
GNTWLGRT

SEQ ID NO: 269619 - protein, 8 aa, Influenza virus
NTWLGRTI

SEQ ID NO: 269620 - protein, 8 aa, Influenza virus
TWLGRTIS

SEQ ID NO: 269621 - protein, 8 aa, Influenza virus
WLGRTISP

SEQ ID NO: 269622 - protein, 8 aa, Influenza virus
LGRTISPR

SEQ ID NO: 269623 - protein, 8 aa, Influenza virus
GRTISPRS

SEQ ID NO: 269624 - protein, 8 aa, Influenza virus
RTISPRSR

SEQ ID NO: 269625 - protein, 8 aa, Influenza virus
TISPRSRS

SEQ ID NO: 269626 - protein, 8 aa, Influenza virus
ISPRSRSG

SEQ ID NO: 269627 - protein, 8 aa, Influenza virus
SPRSRSGF

SEQ ID NO: 269628 - protein, 8 aa, Influenza virus
PRSRSGFE

SEQ ID NO: 269629 - protein, 8 aa, Influenza virus
RSRSGFEM

SEQ ID NO: 269630 - protein, 8 aa, Influenza virus
SRSGFEML

SEQ ID NO: 269631 - protein, 8 aa, Influenza virus
RSGFEMLK

SEQ ID NO: 269632 - protein, 8 aa, Influenza virus
SGFEMLKI

SEQ ID NO: 269633 - protein, 8 aa, Influenza virus
GFEMLKIP

SEQ ID NO: 269634 - protein, 8 aa, Influenza virus
FEMLKIPN

SEQ ID NO: 269635 - protein, 8 aa, Influenza virus
EMLKIPNA

SEQ ID NO: 269636 - protein, 8 aa, Influenza virus
MLKIPNAG

SEQ ID NO: 269637 - protein, 8 aa, Influenza virus
LKIPNAGT

SEQ ID NO: 269638 - protein, 8 aa, Influenza virus
KIPNAGTD

SEQ ID NO: 269639 - protein, 8 aa, Influenza virus
IPNAGTDP

SEQ ID NO: 269640 - protein, 8 aa, Influenza virus
PNAGTDPN

SEQ ID NO: 269641 - protein, 8 aa, Influenza virus
NAGTDPNS

SEQ ID NO: 269642 - protein, 8 aa, Influenza virus
ITERQEIV

SEQ ID NO: 269643 - protein, 8 aa, Influenza virus
TERQEIVD

SEQ ID NO: 269644 - protein, 8 aa, Influenza virus
ERQEIVDN

SEQ ID NO: 269645 - protein, 8 aa, Influenza virus
RQEIVDNN

SEQ ID NO: 269646 - protein, 8 aa, Influenza virus
NNNWSGYS

SEQ ID NO: 269647 - protein, 8 aa, Influenza virus
NNWSGYSG

SEQ ID NO: 269648 - protein, 8 aa, Influenza virus
NWSGYSGS

SEQ ID NO: 269649 - protein, 8 aa, Influenza virus
WSGYSGSF

SEQ ID NO: 269650 - protein, 8 aa, Influenza virus
SGYSGSFI

SEQ ID NO: 269651 - protein, 8 aa, Influenza virus
GYSGSFID

SEQ ID NO: 269652 - protein, 8 aa, Influenza virus
YSGSFIDY

SEQ ID NO: 269653 - protein, 8 aa, Influenza virus
SGSFIDYW

SEQ ID NO: 269654 - protein, 8 aa, Influenza virus
GSFIDYWD

SEQ ID NO: 269655 - protein, 8 aa, Influenza virus
SFIDYWDE

SEQ ID NO: 269656 - protein, 8 aa, Influenza virus
SECYNPCF

SEQ ID NO: 269657 - protein, 8 aa, Influenza virus
ECYNPCFY

SEQ ID NO: 269658 - protein, 8 aa, Influenza virus
CYNPCFYV

SEQ ID NO: 269659 - protein, 8 aa, Influenza virus
YNPCFYVE

SEQ ID NO: 269660 - protein, 8 aa, Influenza virus
NPCFYVEL

SEQ ID NO: 269661 - protein, 8 aa, Influenza virus
PCFYVELI

SEQ ID NO: 269662 - protein, 8 aa, Influenza virus
CFYVELIR

SEQ ID NO: 269663 - protein, 8 aa, Influenza virus
FYVELIRG

SEQ ID NO: 269664 - protein, 8 aa, Influenza virus
YVELIRGR

SEQ ID NO: 269665 - protein, 8 aa, Influenza virus
VELIRGRP

SEQ ID NO: 269666 - protein, 8 aa, Influenza virus
ELIRGRPE

SEQ ID NO: 269667 - protein, 8 aa, Influenza virus
LIRGRPEE

SEQ ID NO: 269668 - protein, 8 aa, Influenza virus
IRGRPEEA

SEQ ID NO: 269669 - protein, 8 aa, Influenza virus
RGRPEEAK

SEQ ID NO: 269670 - protein, 8 aa, Influenza virus
GRPEEAKY

SEQ ID NO: 269671 - protein, 8 aa, Influenza virus
RPEEAKYV

SEQ ID NO: 269672 - protein, 8 aa, Influenza virus
PEEAKYVW

SEQ ID NO: 269673 - protein, 8 aa, Influenza virus
EEAKYVWW

SEQ ID NO: 269674 - protein, 8 aa, Influenza virus
EAKYVWWT

SEQ ID NO: 269675 - protein, 8 aa, Influenza virus
AKYVWWTS

SEQ ID NO: 269676 - protein, 8 aa, Influenza virus
KYVWWTSN

SEQ ID NO: 269677 - protein, 8 aa, Influenza virus
YVWWTSNS

SEQ ID NO: 269678 - protein, 8 aa, Influenza virus
VWWTSNSL

SEQ ID NO: 269679 - protein, 8 aa, Influenza virus
WWTSNSLV

SEQ ID NO: 269680 - protein, 8 aa, Influenza virus
WTSNSLVA

SEQ ID NO: 269681 - protein, 8 aa, Influenza virus
TSNSLVAL

SEQ ID NO: 269682 - protein, 8 aa, Influenza virus
SNSLVALC

SEQ ID NO: 269683 - protein, 8 aa, Influenza virus
NSLVALCG

SEQ ID NO: 269684 - protein, 8 aa, Influenza virus
SLVALCGS

SEQ ID NO: 269685 - protein, 8 aa, Influenza virus
LVALCGSP

SEQ ID NO: 269686 - protein, 8 aa, Influenza virus
VALCGSPI

SEQ ID NO: 269687 - protein, 8 aa, Influenza virus
ALCGSPIS

SEQ ID NO: 269688 - protein, 8 aa, Influenza virus
LCGSPISV

SEQ ID NO: 269689 - protein, 8 aa, Influenza virus
CGSPISVG

SEQ ID NO: 269690 - protein, 8 aa, Influenza virus
GSPISVGS

SEQ ID NO: 269691 - protein, 8 aa, Influenza virus
SPISVGSG

SEQ ID NO: 269692 - protein, 8 aa, Influenza virus
PISVGSGS

SEQ ID NO: 269693 - protein, 8 aa, Influenza virus
ISVGSGSF

SEQ ID NO: 269694 - protein, 8 aa, Influenza virus
SVGSGSFP

SEQ ID NO: 269695 - protein, 8 aa, Influenza virus
VGSGSFPD

SEQ ID NO: 269696 - protein, 8 aa, Influenza virus
GSGSFPDG

SEQ ID NO: 269697 - protein, 8 aa, Influenza virus
SGSFPDGA

SEQ ID NO: 269698 - protein, 8 aa, Influenza virus
GSFPDGAQ

SEQ ID NO: 269699 - protein, 8 aa, Influenza virus
SFPDGAQI

SEQ ID NO: 269700 - protein, 8 aa, Influenza virus
FPDGAQIQ

SEQ ID NO: 269701 - protein, 8 aa, Influenza virus
PDGAQIQY

SEQ ID NO: 269702 - protein, 8 aa, Influenza virus
DGAQIQYF

SEQ ID NO: 269703 - protein, 8 aa, Influenza virus
GAQIQYFS

SEQ ID NO: 269704 - protein, 8 aa, Influenza virus
QADEICIG

SEQ ID NO: 269705 - protein, 8 aa, Influenza virus
ADEICIGY

SEQ ID NO: 269706 - protein, 8 aa, Influenza virus
DEICIGYL

SEQ ID NO: 269707 - protein, 8 aa, Influenza virus
EICIGYLS

SEQ ID NO: 269708 - protein, 8 aa, Influenza virus
ICIGYLSN

SEQ ID NO: 269709 - protein, 8 aa, Influenza virus
CIGYLSNN

SEQ ID NO: 269710 - protein, 8 aa, Influenza virus
IGYLSNNS

SEQ ID NO: 269711 - protein, 8 aa, Influenza virus
GYLSNNST

SEQ ID NO: 269712 - protein, 8 aa, Influenza virus
YLSNNSTE

SEQ ID NO: 269713 - protein, 8 aa, Influenza virus
LSNNSTEK

SEQ ID NO: 269714 - protein, 8 aa, Influenza virus
SNNSTEKV

SEQ ID NO: 269715 - protein, 8 aa, Influenza virus
NNSTEKVD

SEQ ID NO: 269716 - protein, 8 aa, Influenza virus
NSTEKVDT

SEQ ID NO: 269717 - protein, 8 aa, Influenza virus
STEKVDTI

SEQ ID NO: 269718 - protein, 8 aa, Influenza virus
TEKVDTII

SEQ ID NO: 269719 - protein, 8 aa, Influenza virus
EKVDTIIE

SEQ ID NO: 269720 - protein, 8 aa, Influenza virus
KVDTIIES

SEQ ID NO: 269721 - protein, 8 aa, Influenza virus
VDTIIESN

SEQ ID NO: 269722 - protein, 8 aa, Influenza virus
DTIIESNV

SEQ ID NO: 269723 - protein, 8 aa, Influenza virus
TIIESNVT

SEQ ID NO: 269724 - protein, 8 aa, Influenza virus
IIESNVTV

SEQ ID NO: 269725 - protein, 8 aa, Influenza virus
IESNVTVT

SEQ ID NO: 269726 - protein, 8 aa, Influenza virus
ESNVTVTS

SEQ ID NO: 269727 - protein, 8 aa, Influenza virus
SNVTVTSS

SEQ ID NO: 269728 - protein, 8 aa, Influenza virus
NVTVTSSV

SEQ ID NO: 269729 - protein, 8 aa, Influenza virus
VTVTSSVE

SEQ ID NO: 269730 - protein, 8 aa, Influenza virus
TVTSSVEL

SEQ ID NO: 269731 - protein, 8 aa, Influenza virus
VTSSVELV

SEQ ID NO: 269732 - protein, 8 aa, Influenza virus
TSSVELVE

SEQ ID NO: 269733 - protein, 8 aa, Influenza virus
SSVELVEN

SEQ ID NO: 269734 - protein, 8 aa, Influenza virus
EHTGSFCS

SEQ ID NO: 269735 - protein, 8 aa, Influenza virus
HTGSFCSI

SEQ ID NO: 269736 - protein, 8 aa, Influenza virus
TGSFCSID

SEQ ID NO: 269737 - protein, 8 aa, Influenza virus
GSFCSIDG

SEQ ID NO: 269738 - protein, 8 aa, Influenza virus
SFCSIDGK

SEQ ID NO: 269739 - protein, 8 aa, Influenza virus
FCSIDGKA

SEQ ID NO: 269740 - protein, 8 aa, Influenza virus
CSIDGKAP

SEQ ID NO: 269741 - protein, 8 aa, Influenza virus
SIDGKAPI

SEQ ID NO: 269742 - protein, 8 aa, Influenza virus
IDGKAPIS

SEQ ID NO: 269743 - protein, 8 aa, Influenza virus
DGKAPISL

SEQ ID NO: 269744 - protein, 8 aa, Influenza virus
GKAPISLG

SEQ ID NO: 269745 - protein, 8 aa, Influenza virus
KAPISLGD

SEQ ID NO: 269746 - protein, 8 aa, Influenza virus
APISLGDC

SEQ ID NO: 269747 - protein, 8 aa, Influenza virus
PISLGDCS

SEQ ID NO: 269748 - protein, 8 aa, Influenza virus
ISLGDCSF

SEQ ID NO: 269749 - protein, 8 aa, Influenza virus
SLGDCSFA

SEQ ID NO: 269750 - protein, 8 aa, Influenza virus
LGDCSFAG

SEQ ID NO: 269751 - protein, 8 aa, Influenza virus
GDCSFAGW

SEQ ID NO: 269752 - protein, 8 aa, Influenza virus
DCSFAGWI

SEQ ID NO: 269753 - protein, 8 aa, Influenza virus
CSFAGWIL

SEQ ID NO: 269754 - protein, 8 aa, Influenza virus
SFAGWILG

SEQ ID NO: 269755 - protein, 8 aa, Influenza virus
FAGWILGN

SEQ ID NO: 269756 - protein, 8 aa, Influenza virus
AGWILGNP

SEQ ID NO: 269757 - protein, 8 aa, Influenza virus
GWILGNPM

SEQ ID NO: 269758 - protein, 8 aa, Influenza virus
WILGNPMC

SEQ ID NO: 269759 - protein, 8 aa, Influenza virus
ILGNPMCD

SEQ ID NO: 269760 - protein, 8 aa, Influenza virus
LGNPMCDD

SEQ ID NO: 269761 - protein, 8 aa, Influenza virus
GNPMCDDL

SEQ ID NO: 269762 - protein, 8 aa, Influenza virus
NPMCDDLI

SEQ ID NO: 269763 - protein, 8 aa, Influenza virus
PMCDDLIG

SEQ ID NO: 269764 - protein, 8 aa, Influenza virus
MCDDLIGK

SEQ ID NO: 269765 - protein, 8 aa, Influenza virus
CDDLIGKT

SEQ ID NO: 269766 - protein, 8 aa, Influenza virus
DDLIGKTS

SEQ ID NO: 269767 - protein, 8 aa, Influenza virus
DLIGKTSW

SEQ ID NO: 269768 - protein, 8 aa, Influenza virus
LIGKTSWS

SEQ ID NO: 269769 - protein, 8 aa, Influenza virus
IGKTSWSY

SEQ ID NO: 269770 - protein, 8 aa, Influenza virus
GKTSWSYI

SEQ ID NO: 269771 - protein, 8 aa, Influenza virus
KTSWSYIV

SEQ ID NO: 269772 - protein, 8 aa, Influenza virus
TSWSYIVE

SEQ ID NO: 269773 - protein, 8 aa, Influenza virus
SWSYIVEK

SEQ ID NO: 269774 - protein, 8 aa, Influenza virus
WSYIVEKP

SEQ ID NO: 269775 - protein, 8 aa, Influenza virus
SYIVEKPN

SEQ ID NO: 269776 - protein, 8 aa, Influenza virus
YIVEKPNP

SEQ ID NO: 269777 - protein, 8 aa, Influenza virus
NPTNGICY

SEQ ID NO: 269778 - protein, 8 aa, Influenza virus
PTNGICYP

SEQ ID NO: 269779 - protein, 8 aa, Influenza virus
TNGICYPG

SEQ ID NO: 269780 - protein, 8 aa, Influenza virus
NGICYPGT

SEQ ID NO: 269781 - protein, 8 aa, Influenza virus
GICYPGTL

SEQ ID NO: 269782 - protein, 8 aa, Influenza virus
ICYPGTLE

SEQ ID NO: 269783 - protein, 8 aa, Influenza virus
EEELRLKF

SEQ ID NO: 269784 - protein, 8 aa, Influenza virus
SFFRNMVW

SEQ ID NO: 269785 - protein, 8 aa, Influenza virus
FFRNMVWL

SEQ ID NO: 269786 - protein, 8 aa, Influenza virus
FRNMVWLI

SEQ ID NO: 269787 - protein, 8 aa, Influenza virus
MVWLIHQS

SEQ ID NO: 269788 - protein, 8 aa, Influenza virus
WLIHQSGT

SEQ ID NO: 269789 - protein, 8 aa, Influenza virus
LIHQSGTY

SEQ ID NO: 269790 - protein, 8 aa, Influenza virus
IHQSGTYP

SEQ ID NO: 269791 - protein, 8 aa, Influenza virus
HQSGTYPV

SEQ ID NO: 269792 - protein, 8 aa, Influenza virus
QSGTYPVI

SEQ ID NO: 269793 - protein, 8 aa, Influenza virus
RTFNNTKG

SEQ ID NO: 269794 - protein, 8 aa, Influenza virus
FNNTKGRD

SEQ ID NO: 269795 - protein, 8 aa, Influenza virus
NNTKGRDV

SEQ ID NO: 269796 - protein, 8 aa, Influenza virus
NTKGRDVL

SEQ ID NO: 269797 - protein, 8 aa, Influenza virus
DLYKKDSS

SEQ ID NO: 269798 - protein, 8 aa, Influenza virus
LYKKDSSY

SEQ ID NO: 269799 - protein, 8 aa, Influenza virus
YKKDSSYV

SEQ ID NO: 269800 - protein, 8 aa, Influenza virus
VNGQAGRM

SEQ ID NO: 269801 - protein, 8 aa, Influenza virus
NGQAGRMT

SEQ ID NO: 269802 - protein, 8 aa, Influenza virus
GQAGRMTF

SEQ ID NO: 269803 - protein, 8 aa, Influenza virus
QAGRMTFY

SEQ ID NO: 269804 - protein, 8 aa, Influenza virus
AGRMTFYW

SEQ ID NO: 269805 - protein, 8 aa, Influenza virus
GRMTFYWT

SEQ ID NO: 269806 - protein, 8 aa, Influenza virus
RMTFYWTI

SEQ ID NO: 269807 - protein, 8 aa, Influenza virus
MTFYWTIV

SEQ ID NO: 269808 - protein, 8 aa, Influenza virus
ITFESNGA

SEQ ID NO: 269809 - protein, 8 aa, Influenza virus
TFESNGAF

SEQ ID NO: 269810 - protein, 8 aa, Influenza virus
FESNGAFL

SEQ ID NO: 269811 - protein, 8 aa, Influenza virus
ESNGAFLA

SEQ ID NO: 269812 - protein, 8 aa, Influenza virus
SNGAFLAP

SEQ ID NO: 269813 - protein, 8 aa, Influenza virus
NGAFLAPR

SEQ ID NO: 269814 - protein, 8 aa, Influenza virus
GAFLAPRY

SEQ ID NO: 269815 - protein, 8 aa, Influenza virus
AFLAPRYA

SEQ ID NO: 269816 - protein, 8 aa, Influenza virus
FLAPRYAF

SEQ ID NO: 269817 - protein, 8 aa, Influenza virus
LAPRYAFE

SEQ ID NO: 269818 - protein, 8 aa, Influenza virus
APRYAFEL

SEQ ID NO: 269819 - protein, 8 aa, Influenza virus
PRYAFELV

SEQ ID NO: 269820 - protein, 8 aa, Influenza virus
RYAFELVS

SEQ ID NO: 269821 - protein, 8 aa, Influenza virus
GNGKLFRS

SEQ ID NO: 269822 - protein, 8 aa, Influenza virus
GKLFRSDL

SEQ ID NO: 269823 - protein, 8 aa, Influenza virus
CSTKCQSE

SEQ ID NO: 269824 - protein, 8 aa, Influenza virus
KCQSEIGG

SEQ ID NO: 269825 - protein, 8 aa, Influenza virus
CQSEIGGI

SEQ ID NO: 269826 - protein, 8 aa, Influenza virus
QSEIGGIN

SEQ ID NO: 269827 - protein, 8 aa, Influenza virus
SEIGGINT

SEQ ID NO: 269828 - protein, 8 aa, Influenza virus
EIGGINTN

SEQ ID NO: 269829 - protein, 8 aa, Influenza virus
IGGINTNR

SEQ ID NO: 269830 - protein, 8 aa, Influenza virus
GGINTNRS

SEQ ID NO: 269831 - protein, 8 aa, Influenza virus
SFHNVHRN

SEQ ID NO: 269832 - protein, 8 aa, Influenza virus
FHNVHRNT

SEQ ID NO: 269833 - protein, 8 aa, Influenza virus
HNVHRNTI

SEQ ID NO: 269834 - protein, 8 aa, Influenza virus
NVHRNTIG

SEQ ID NO: 269835 - protein, 8 aa, Influenza virus
VHRNTIGD

SEQ ID NO: 269836 - protein, 8 aa, Influenza virus
HRNTIGDC

SEQ ID NO: 269837 - protein, 8 aa, Influenza virus
RNTIGDCP

SEQ ID NO: 269838 - protein, 8 aa, Influenza virus
NTIGDCPK

SEQ ID NO: 269839 - protein, 8 aa, Influenza virus
TIGDCPKY

SEQ ID NO: 269840 - protein, 8 aa, Influenza virus
IGDCPKYV

SEQ ID NO: 269841 - protein, 8 aa, Influenza virus
GDCPKYVN

SEQ ID NO: 269842 - protein, 8 aa, Influenza virus
DCPKYVNV

SEQ ID NO: 269843 - protein, 8 aa, Influenza virus
CPKYVNVK

SEQ ID NO: 269844 - protein, 8 aa, Influenza virus
PKYVNVKS

SEQ ID NO: 269845 - protein, 8 aa, Influenza virus
KYVNVKSL

SEQ ID NO: 269846 - protein, 8 aa, Influenza virus
YVNVKSLK

SEQ ID NO: 269847 - protein, 8 aa, Influenza virus
VNVKSLKL

SEQ ID NO: 269848 - protein, 8 aa, Influenza virus
NVKSLKLA

SEQ ID NO: 269849 - protein, 8 aa, Influenza virus
VKSLKLAT

SEQ ID NO: 269850 - protein, 8 aa, Influenza virus
KSLKLATG

SEQ ID NO: 269851 - protein, 8 aa, Influenza virus
SLKLATGL

SEQ ID NO: 269852 - protein, 8 aa, Influenza virus
LKLATGLR

SEQ ID NO: 269853 - protein, 8 aa, Influenza virus
KLATGLRN

SEQ ID NO: 269854 - protein, 8 aa, Influenza virus
LATGLRNV

SEQ ID NO: 269855 - protein, 8 aa, Influenza virus
ATGLRNVP

SEQ ID NO: 269856 - protein, 8 aa, Influenza virus
TGLRNVPA

SEQ ID NO: 269857 - protein, 8 aa, Influenza virus
GLRNVPAI

SEQ ID NO: 269858 - protein, 8 aa, Influenza virus
LRNVPAIA

SEQ ID NO: 269859 - protein, 8 aa, Influenza virus
TRGLFGAI

SEQ ID NO: 269860 - protein, 8 aa, Influenza virus
RGLFGAIA

SEQ ID NO: 269861 - protein, 8 aa, Influenza virus
GLFGAIAG

SEQ ID NO: 269862 - protein, 8 aa, Influenza virus
LFGAIAGF

SEQ ID NO: 269863 - protein, 8 aa, Influenza virus
FGAIAGFI

SEQ ID NO: 269864 - protein, 8 aa, Influenza virus
GAIAGFIE

SEQ ID NO: 269865 - protein, 8 aa, Influenza virus
AIAGFIEG

SEQ ID NO: 269866 - protein, 8 aa, Influenza virus
IAGFIEGG

SEQ ID NO: 269867 - protein, 8 aa, Influenza virus
AGFIEGGW

SEQ ID NO: 269868 - protein, 8 aa, Influenza virus
GFIEGGWP

SEQ ID NO: 269869 - protein, 8 aa, Influenza virus
FIEGGWPG

SEQ ID NO: 269870 - protein, 8 aa, Influenza virus
IEGGWPGL

SEQ ID NO: 269871 - protein, 8 aa, Influenza virus
EGGWPGLI

SEQ ID NO: 269872 - protein, 8 aa, Influenza virus
GGWPGLIN

SEQ ID NO: 269873 - protein, 8 aa, Influenza virus
GWPGLING

SEQ ID NO: 269874 - protein, 8 aa, Influenza virus
WPGLINGW

SEQ ID NO: 269875 - protein, 8 aa, Influenza virus
PGLINGWY

SEQ ID NO: 269876 - protein, 8 aa, Influenza virus
GLINGWYG

SEQ ID NO: 269877 - protein, 8 aa, Influenza virus
LINGWYGF

SEQ ID NO: 269878 - protein, 8 aa, Influenza virus
INGWYGFQ

SEQ ID NO: 269879 - protein, 8 aa, Influenza virus
NGWYGFQH

SEQ ID NO: 269880 - protein, 8 aa, Influenza virus
GWYGFQHR

SEQ ID NO: 269881 - protein, 8 aa, Influenza virus
WYGFQHRN

SEQ ID NO: 269882 - protein, 8 aa, Influenza virus
YGFQHRNE

SEQ ID NO: 269883 - protein, 8 aa, Influenza virus
GFQHRNEE

SEQ ID NO: 269884 - protein, 8 aa, Influenza virus
FQHRNEEG

SEQ ID NO: 269885 - protein, 8 aa, Influenza virus
QHRNEEGT

SEQ ID NO: 269886 - protein, 8 aa, Influenza virus
HRNEEGTG

SEQ ID NO: 269887 - protein, 8 aa, Influenza virus
RNEEGTGI

SEQ ID NO: 269888 - protein, 8 aa, Influenza virus
NEEGTGIA

SEQ ID NO: 269889 - protein, 8 aa, Influenza virus
EEGTGIAA

SEQ ID NO: 269890 - protein, 8 aa, Influenza virus
EGTGIAAD

SEQ ID NO: 269891 - protein, 8 aa, Influenza virus
GTGIAADK

SEQ ID NO: 269892 - protein, 8 aa, Influenza virus
TGIAADKE

SEQ ID NO: 269893 - protein, 8 aa, Influenza virus
GIAADKES

SEQ ID NO: 269894 - protein, 8 aa, Influenza virus
IAADKEST

SEQ ID NO: 269895 - protein, 8 aa, Influenza virus
AADKESTQ

SEQ ID NO: 269896 - protein, 8 aa, Influenza virus
ADKESTQK

SEQ ID NO: 269897 - protein, 8 aa, Influenza virus
DKESTQKA

SEQ ID NO: 269898 - protein, 8 aa, Influenza virus
NNIVDRMN

SEQ ID NO: 269899 - protein, 8 aa, Influenza virus
IEERINQL

SEQ ID NO: 269900 - protein, 8 aa, Influenza virus
EERINQLS

SEQ ID NO: 269901 - protein, 8 aa, Influenza virus
IDIWSYNA

SEQ ID NO: 269902 - protein, 8 aa, Influenza virus
DIWSYNAQ

SEQ ID NO: 269903 - protein, 8 aa, Influenza virus
IWSYNAQL

SEQ ID NO: 269904 - protein, 8 aa, Influenza virus
WSYNAQLL

SEQ ID NO: 269905 - protein, 8 aa, Influenza virus
SYNAQLLV

SEQ ID NO: 269906 - protein, 8 aa, Influenza virus
YNAQLLVL

SEQ ID NO: 269907 - protein, 8 aa, Influenza virus
NAQLLVLL

SEQ ID NO: 269908 - protein, 8 aa, Influenza virus
AQLLVLLE

SEQ ID NO: 269909 - protein, 8 aa, Influenza virus
QLLVLLEN

SEQ ID NO: 269910 - protein, 8 aa, Influenza virus
LLVLLENE

SEQ ID NO: 269911 - protein, 8 aa, Influenza virus
LVLLENEK

SEQ ID NO: 269912 - protein, 8 aa, Influenza virus
VLLENEKT

SEQ ID NO: 269913 - protein, 8 aa, Influenza virus
LLENEKTL

SEQ ID NO: 269914 - protein, 8 aa, Influenza virus
LENEKTLD

SEQ ID NO: 269915 - protein, 8 aa, Influenza virus
ENEKTLDL

SEQ ID NO: 269916 - protein, 8 aa, Influenza virus
NEKTLDLH

SEQ ID NO: 269917 - protein, 8 aa, Influenza virus
EKTLDLHD

SEQ ID NO: 269918 - protein, 8 aa, Influenza virus
KTLDLHDS

SEQ ID NO: 269919 - protein, 8 aa, Influenza virus
TLDLHDSN

SEQ ID NO: 269920 - protein, 8 aa, Influenza virus
LDLHDSNV

SEQ ID NO: 269921 - protein, 8 aa, Influenza virus
DLHDSNVR

SEQ ID NO: 269922 - protein, 8 aa, Influenza virus
LHDSNVRN

SEQ ID NO: 269923 - protein, 8 aa, Influenza virus
HDSNVRNL

SEQ ID NO: 269924 - protein, 8 aa, Influenza virus
DSNVRNLH

SEQ ID NO: 269925 - protein, 8 aa, Influenza virus
SNVRNLHE

SEQ ID NO: 269926 - protein, 8 aa, Influenza virus
NVRNLHEK

SEQ ID NO: 269927 - protein, 8 aa, Influenza virus
NLHEKVRR

SEQ ID NO: 269928 - protein, 8 aa, Influenza virus
LHEKVRRM

SEQ ID NO: 269929 - protein, 8 aa, Influenza virus
HEKVRRML

SEQ ID NO: 269930 - protein, 8 aa, Influenza virus
LKDNAKDE

SEQ ID NO: 269931 - protein, 8 aa, Influenza virus
KDNAKDEG

SEQ ID NO: 269932 - protein, 8 aa, Influenza virus
DNAKDEGN

SEQ ID NO: 269933 - protein, 8 aa, Influenza virus
NAKDEGNG

SEQ ID NO: 269934 - protein, 8 aa, Influenza virus
AKDEGNGC

SEQ ID NO: 269935 - protein, 8 aa, Influenza virus
KDEGNGCF

SEQ ID NO: 269936 - protein, 8 aa, Influenza virus
DEGNGCFT

SEQ ID NO: 269937 - protein, 8 aa, Influenza virus
EGNGCFTF

SEQ ID NO: 269938 - protein, 8 aa, Influenza virus
GNGCFTFY

SEQ ID NO: 269939 - protein, 8 aa, Influenza virus
NGCFTFYH

SEQ ID NO: 269940 - protein, 8 aa, Influenza virus
GCFTFYHK

SEQ ID NO: 269941 - protein, 8 aa, Influenza virus
CFTFYHKC

SEQ ID NO: 269942 - protein, 8 aa, Influenza virus
FTFYHKCD

SEQ ID NO: 269943 - protein, 8 aa, Influenza virus
TFYHKCDN

SEQ ID NO: 269944 - protein, 8 aa, Influenza virus
FYHKCDNE

SEQ ID NO: 269945 - protein, 8 aa, Influenza virus
YHKCDNEC

SEQ ID NO: 269946 - protein, 8 aa, Influenza virus
HKCDNECI

SEQ ID NO: 269947 - protein, 8 aa, Influenza virus
KCDNECIE

SEQ ID NO: 269948 - protein, 8 aa, Influenza virus
NECIEKVR

SEQ ID NO: 269949 - protein, 8 aa, Influenza virus
ECIEKVRN

SEQ ID NO: 269950 - protein, 8 aa, Influenza virus
CIEKVRNG

SEQ ID NO: 269951 - protein, 8 aa, Influenza virus
IEKVRNGT

SEQ ID NO: 269952 - protein, 8 aa, Influenza virus
EKVRNGTY

SEQ ID NO: 269953 - protein, 8 aa, Influenza virus
KVRNGTYD

SEQ ID NO: 269954 - protein, 8 aa, Influenza virus
VRNGTYDH

SEQ ID NO: 269955 - protein, 8 aa, Influenza virus
RNGTYDHK

SEQ ID NO: 269956 - protein, 8 aa, Influenza virus
NGTYDHKE

SEQ ID NO: 269957 - protein, 8 aa, Influenza virus
GTYDHKEF

SEQ ID NO: 269958 - protein, 8 aa, Influenza virus
TYDHKEFE

SEQ ID NO: 269959 - protein, 8 aa, Influenza virus
YDHKEFEE

SEQ ID NO: 269960 - protein, 8 aa, Influenza virus
DHKEFEEE

SEQ ID NO: 269961 - protein, 8 aa, Influenza virus
HKEFEEES

SEQ ID NO: 269962 - protein, 8 aa, Influenza virus
KEFEEESK

SEQ ID NO: 269963 - protein, 8 aa, Influenza virus
EESKLNRQ

SEQ ID NO: 269964 - protein, 8 aa, Influenza virus
ESKLNRQE

SEQ ID NO: 269965 - protein, 8 aa, Influenza virus
SKLNRQEI

SEQ ID NO: 269966 - protein, 8 aa, Influenza virus
KLNRQEIE

SEQ ID NO: 269967 - protein, 8 aa, Influenza virus
LNRQEIEG

SEQ ID NO: 269968 - protein, 8 aa, Influenza virus
NRQEIEGV

SEQ ID NO: 269969 - protein, 8 aa, Influenza virus
RQEIEGVK

SEQ ID NO: 269970 - protein, 8 aa, Influenza virus
QEIEGVKL

SEQ ID NO: 269971 - protein, 8 aa, Influenza virus
EIEGVKLD

SEQ ID NO: 269972 - protein, 8 aa, Influenza virus
GNVYKILS

SEQ ID NO: 269973 - protein, 8 aa, Influenza virus
NVYKILSI

SEQ ID NO: 269974 - protein, 8 aa, Influenza virus
VYKILSIY

SEQ ID NO: 269975 - protein, 8 aa, Influenza virus
YKILSIYS

SEQ ID NO: 269976 - protein, 8 aa, Influenza virus
KILSIYSC

SEQ ID NO: 269977 - protein, 8 aa, Influenza virus
ILSIYSCI

SEQ ID NO: 269978 - protein, 8 aa, Influenza virus
LSIYSCIA

SEQ ID NO: 269979 - protein, 8 aa, Influenza virus
SIYSCIAS

SEQ ID NO: 269980 - protein, 8 aa, Influenza virus
IYSCIASS

SEQ ID NO: 269981 - protein, 8 aa, Influenza virus
YSCIASSL

SEQ ID NO: 269982 - protein, 8 aa, Influenza virus
SCIASSLV

SEQ ID NO: 269983 - protein, 8 aa, Influenza virus
CIASSLVL

SEQ ID NO: 269984 - protein, 8 aa, Influenza virus
IASSLVLA

SEQ ID NO: 269985 - protein, 8 aa, Influenza virus
ASSLVLAA

SEQ ID NO: 269986 - protein, 8 aa, Influenza virus
SSLVLAAI

SEQ ID NO: 269987 - protein, 8 aa, Influenza virus
SLVLAAII

SEQ ID NO: 269988 - protein, 8 aa, Influenza virus
LVLAAIIM

SEQ ID NO: 269989 - protein, 8 aa, Influenza virus
VLAAIIMG

SEQ ID NO: 269990 - protein, 8 aa, Influenza virus
LAAIIMGF

SEQ ID NO: 269991 - protein, 8 aa, Influenza virus
WACSNGSC

SEQ ID NO: 269992 - protein, 8 aa, Influenza virus
ACSNGSCR

SEQ ID NO: 269993 - protein, 8 aa, Influenza virus
CSNGSCRC

SEQ ID NO: 269994 - protein, 8 aa, Influenza virus
SNGSCRCT

SEQ ID NO: 269995 - protein, 8 aa, Influenza virus
NGSCRCTI

SEQ ID NO: 269996 - protein, 8 aa, Influenza virus
GSCRCTIC

SEQ ID NO: 269997 - protein, 8 aa, Influenza virus
SCRCTICI

SEQ ID NO: 269998 - protein, 8 aa, Influenza virus
MEKFIILS

SEQ ID NO: 269999 - protein, 8 aa, Influenza virus
EKFIILST

SEQ ID NO: 270000 - protein, 8 aa, Influenza virus
FAYDKICI

SEQ ID NO: 270001 - protein, 8 aa, Influenza virus
AYDKICIG

SEQ ID NO: 270002 - protein, 8 aa, Influenza virus
YDKICIGY

SEQ ID NO: 270003 - protein, 8 aa, Influenza virus
DKICIGYQ

SEQ ID NO: 270004 - protein, 8 aa, Influenza virus
KICIGYQT

SEQ ID NO: 270005 - protein, 8 aa, Influenza virus
ICIGYQTN

SEQ ID NO: 270006 - protein, 8 aa, Influenza virus
CIGYQTNN

SEQ ID NO: 270007 - protein, 8 aa, Influenza virus
IGYQTNNS

SEQ ID NO: 270008 - protein, 8 aa, Influenza virus
GYQTNNST

SEQ ID NO: 270009 - protein, 8 aa, Influenza virus
YQTNNSTE

SEQ ID NO: 270010 - protein, 8 aa, Influenza virus
QTNNSTET

SEQ ID NO: 270011 - protein, 8 aa, Influenza virus
TNNSTETV

SEQ ID NO: 270012 - protein, 8 aa, Influenza virus
NNSTETVN

SEQ ID NO: 270013 - protein, 8 aa, Influenza virus
NSTETVNT

SEQ ID NO: 270014 - protein, 8 aa, Influenza virus
STETVNTL

SEQ ID NO: 270015 - protein, 8 aa, Influenza virus
TETVNTLI

SEQ ID NO: 270016 - protein, 8 aa, Influenza virus
ETVNTLIE

SEQ ID NO: 270017 - protein, 8 aa, Influenza virus
TVNTLIEQ

SEQ ID NO: 270018 - protein, 8 aa, Influenza virus
VNTLIEQN

SEQ ID NO: 270019 - protein, 8 aa, Influenza virus
NTLIEQNV

SEQ ID NO: 270020 - protein, 8 aa, Influenza virus
TLIEQNVP

SEQ ID NO: 270021 - protein, 8 aa, Influenza virus
LIEQNVPV

SEQ ID NO: 270022 - protein, 8 aa, Influenza virus
IEQNVPVT

SEQ ID NO: 270023 - protein, 8 aa, Influenza virus
EQNVPVTQ

SEQ ID NO: 270024 - protein, 8 aa, Influenza virus
QNVPVTQV

SEQ ID NO: 270025 - protein, 8 aa, Influenza virus
NVPVTQVE

SEQ ID NO: 270026 - protein, 8 aa, Influenza virus
VPVTQVEE

SEQ ID NO: 270027 - protein, 8 aa, Influenza virus
PVTQVEEL

SEQ ID NO: 270028 - protein, 8 aa, Influenza virus
VTQVEELV

SEQ ID NO: 270029 - protein, 8 aa, Influenza virus
TQVEELVH

SEQ ID NO: 270030 - protein, 8 aa, Influenza virus
QVEELVHG

SEQ ID NO: 270031 - protein, 8 aa, Influenza virus
VEELVHGG

SEQ ID NO: 270032 - protein, 8 aa, Influenza virus
EELVHGGI

SEQ ID NO: 270033 - protein, 8 aa, Influenza virus
ELVHGGID

SEQ ID NO: 270034 - protein, 8 aa, Influenza virus
LVHGGIDP

SEQ ID NO: 270035 - protein, 8 aa, Influenza virus
TELGSPLV

SEQ ID NO: 270036 - protein, 8 aa, Influenza virus
ELGSPLVL

SEQ ID NO: 270037 - protein, 8 aa, Influenza virus
LGSPLVLD

SEQ ID NO: 270038 - protein, 8 aa, Influenza virus
GSPLVLDD

SEQ ID NO: 270039 - protein, 8 aa, Influenza virus
SPLVLDDC

SEQ ID NO: 270040 - protein, 8 aa, Influenza virus
PLVLDDCS

SEQ ID NO: 270041 - protein, 8 aa, Influenza virus
LVLDDCSL

SEQ ID NO: 270042 - protein, 8 aa, Influenza virus
VLDDCSLE

SEQ ID NO: 270043 - protein, 8 aa, Influenza virus
LDDCSLEG

SEQ ID NO: 270044 - protein, 8 aa, Influenza virus
DDCSLEGL

SEQ ID NO: 270045 - protein, 8 aa, Influenza virus
DCSLEGLI

SEQ ID NO: 270046 - protein, 8 aa, Influenza virus
CSLEGLIL

SEQ ID NO: 270047 - protein, 8 aa, Influenza virus
SLEGLILG

SEQ ID NO: 270048 - protein, 8 aa, Influenza virus
LEGLILGN

SEQ ID NO: 270049 - protein, 8 aa, Influenza virus
EGLILGNP

SEQ ID NO: 270050 - protein, 8 aa, Influenza virus
GLILGNPK

SEQ ID NO: 270051 - protein, 8 aa, Influenza virus
LILGNPKC

SEQ ID NO: 270052 - protein, 8 aa, Influenza virus
ILGNPKCD

SEQ ID NO: 270053 - protein, 8 aa, Influenza virus
LGNPKCDL

SEQ ID NO: 270054 - protein, 8 aa, Influenza virus
GNPKCDLY

SEQ ID NO: 270055 - protein, 8 aa, Influenza virus
NPKCDLYL

SEQ ID NO: 270056 - protein, 8 aa, Influenza virus
PKCDLYLN

SEQ ID NO: 270057 - protein, 8 aa, Influenza virus
KCDLYLNG

SEQ ID NO: 270058 - protein, 8 aa, Influenza virus
CDLYLNGR

SEQ ID NO: 270059 - protein, 8 aa, Influenza virus
DLYLNGRE

SEQ ID NO: 270060 - protein, 8 aa, Influenza virus
LYLNGREW

SEQ ID NO: 270061 - protein, 8 aa, Influenza virus
YLNGREWS

SEQ ID NO: 270062 - protein, 8 aa, Influenza virus
LNGREWSY

SEQ ID NO: 270063 - protein, 8 aa, Influenza virus
NGREWSYI

SEQ ID NO: 270064 - protein, 8 aa, Influenza virus
GREWSYIV

SEQ ID NO: 270065 - protein, 8 aa, Influenza virus
REWSYIVE

SEQ ID NO: 270066 - protein, 8 aa, Influenza virus
EWSYIVER

SEQ ID NO: 270067 - protein, 8 aa, Influenza virus
WSYIVERP

SEQ ID NO: 270068 - protein, 8 aa, Influenza virus
SYIVERPK

SEQ ID NO: 270069 - protein, 8 aa, Influenza virus
YIVERPKE

SEQ ID NO: 270070 - protein, 8 aa, Influenza virus
IVERPKEM

SEQ ID NO: 270071 - protein, 8 aa, Influenza virus
VERPKEME

SEQ ID NO: 270072 - protein, 8 aa, Influenza virus
ERPKEMEG

SEQ ID NO: 270073 - protein, 8 aa, Influenza virus
RPKEMEGI

SEQ ID NO: 270074 - protein, 8 aa, Influenza virus
PKEMEGIC

SEQ ID NO: 270075 - protein, 8 aa, Influenza virus
KEMEGICY

SEQ ID NO: 270076 - protein, 8 aa, Influenza virus
EMEGICYP

SEQ ID NO: 270077 - protein, 8 aa, Influenza virus
MEGICYPG

SEQ ID NO: 270078 - protein, 8 aa, Influenza virus
EGICYPGS

SEQ ID NO: 270079 - protein, 8 aa, Influenza virus
GICYPGSI

SEQ ID NO: 270080 - protein, 8 aa, Influenza virus
ICYPGSIE

SEQ ID NO: 270081 - protein, 8 aa, Influenza virus
CYPGSIEN

SEQ ID NO: 270082 - protein, 8 aa, Influenza virus
YPGSIENQ

SEQ ID NO: 270083 - protein, 8 aa, Influenza virus
PGSIENQE

SEQ ID NO: 270084 - protein, 8 aa, Influenza virus
GSIENQEE

SEQ ID NO: 270085 - protein, 8 aa, Influenza virus
SIENQEEL

SEQ ID NO: 270086 - protein, 8 aa, Influenza virus
IENQEELR

SEQ ID NO: 270087 - protein, 8 aa, Influenza virus
ENQEELRS

SEQ ID NO: 270088 - protein, 8 aa, Influenza virus
NQEELRSL

SEQ ID NO: 270089 - protein, 8 aa, Influenza virus
QEELRSLF

SEQ ID NO: 270090 - protein, 8 aa, Influenza virus
EELRSLFS

SEQ ID NO: 270091 - protein, 8 aa, Influenza virus
ELRSLFSS

SEQ ID NO: 270092 - protein, 8 aa, Influenza virus
LRSLFSSI

SEQ ID NO: 270093 - protein, 8 aa, Influenza virus
RSLFSSIK

SEQ ID NO: 270094 - protein, 8 aa, Influenza virus
SLFSSIKK

SEQ ID NO: 270095 - protein, 8 aa, Influenza virus
LFSSIKKY

SEQ ID NO: 270096 - protein, 8 aa, Influenza virus
FSSIKKYE

SEQ ID NO: 270097 - protein, 8 aa, Influenza virus
SSIKKYER

SEQ ID NO: 270098 - protein, 8 aa, Influenza virus
SIKKYERV

SEQ ID NO: 270099 - protein, 8 aa, Influenza virus
IKKYERVK

SEQ ID NO: 270100 - protein, 8 aa, Influenza virus
KKYERVKM

SEQ ID NO: 270101 - protein, 8 aa, Influenza virus
KYERVKMF

SEQ ID NO: 270102 - protein, 8 aa, Influenza virus
YERVKMFD

SEQ ID NO: 270103 - protein, 8 aa, Influenza virus
ERVKMFDF

SEQ ID NO: 270104 - protein, 8 aa, Influenza virus
RVKMFDFT

SEQ ID NO: 270105 - protein, 8 aa, Influenza virus
VKMFDFTK

SEQ ID NO: 270106 - protein, 8 aa, Influenza virus
KMFDFTKW

SEQ ID NO: 270107 - protein, 8 aa, Influenza virus
MFDFTKWN

SEQ ID NO: 270108 - protein, 8 aa, Influenza virus
FDFTKWNV

SEQ ID NO: 270109 - protein, 8 aa, Influenza virus
DFTKWNVT

SEQ ID NO: 270110 - protein, 8 aa, Influenza virus
FTKWNVTY

SEQ ID NO: 270111 - protein, 8 aa, Influenza virus
TKWNVTYT

SEQ ID NO: 270112 - protein, 8 aa, Influenza virus
KWNVTYTG

SEQ ID NO: 270113 - protein, 8 aa, Influenza virus
WNVTYTGT

SEQ ID NO: 270114 - protein, 8 aa, Influenza virus
NVTYTGTS

SEQ ID NO: 270115 - protein, 8 aa, Influenza virus
VTYTGTSK

SEQ ID NO: 270116 - protein, 8 aa, Influenza virus
TYTGTSKA

SEQ ID NO: 270117 - protein, 8 aa, Influenza virus
YTGTSKAC

SEQ ID NO: 270118 - protein, 8 aa, Influenza virus
TGTSKACN

SEQ ID NO: 270119 - protein, 8 aa, Influenza virus
SKACNNTS

SEQ ID NO: 270120 - protein, 8 aa, Influenza virus
KACNNTSN

SEQ ID NO: 270121 - protein, 8 aa, Influenza virus
ACNNTSNQ

SEQ ID NO: 270122 - protein, 8 aa, Influenza virus
TSNQGSFY

SEQ ID NO: 270123 - protein, 8 aa, Influenza virus
SNQGSFYR

SEQ ID NO: 270124 - protein, 8 aa, Influenza virus
NQGSFYRS

SEQ ID NO: 270125 - protein, 8 aa, Influenza virus
QGSFYRSM

SEQ ID NO: 270126 - protein, 8 aa, Influenza virus
GSFYRSMR

SEQ ID NO: 270127 - protein, 8 aa, Influenza virus
SFYRSMRW

SEQ ID NO: 270128 - protein, 8 aa, Influenza virus
FYRSMRWL

SEQ ID NO: 270129 - protein, 8 aa, Influenza virus
YRSMRWLT

SEQ ID NO: 270130 - protein, 8 aa, Influenza virus
RSMRWLTL

SEQ ID NO: 270131 - protein, 8 aa, Influenza virus
SMRWLTLK

SEQ ID NO: 270132 - protein, 8 aa, Influenza virus
MRWLTLKS

SEQ ID NO: 270133 - protein, 8 aa, Influenza virus
RWLTLKSG

SEQ ID NO: 270134 - protein, 8 aa, Influenza virus
WLTLKSGQ

SEQ ID NO: 270135 - protein, 8 aa, Influenza virus
LTLKSGQF

SEQ ID NO: 270136 - protein, 8 aa, Influenza virus
TLKSGQFP

SEQ ID NO: 270137 - protein, 8 aa, Influenza virus
LKSGQFPV

SEQ ID NO: 270138 - protein, 8 aa, Influenza virus
KSGQFPVQ

SEQ ID NO: 270139 - protein, 8 aa, Influenza virus
SGQFPVQT

SEQ ID NO: 270140 - protein, 8 aa, Influenza virus
GQFPVQTD

SEQ ID NO: 270141 - protein, 8 aa, Influenza virus
QFPVQTDE

SEQ ID NO: 270142 - protein, 8 aa, Influenza virus
FPVQTDEY

SEQ ID NO: 270143 - protein, 8 aa, Influenza virus
PVQTDEYK

SEQ ID NO: 270144 - protein, 8 aa, Influenza virus
VQTDEYKN

SEQ ID NO: 270145 - protein, 8 aa, Influenza virus
QTDEYKNT

SEQ ID NO: 270146 - protein, 8 aa, Influenza virus
TDEYKNTR

SEQ ID NO: 270147 - protein, 8 aa, Influenza virus
DEYKNTRD

SEQ ID NO: 270148 - protein, 8 aa, Influenza virus
EYKNTRDS

SEQ ID NO: 270149 - protein, 8 aa, Influenza virus
YKNTRDSD

SEQ ID NO: 270150 - protein, 8 aa, Influenza virus
KNTRDSDI

SEQ ID NO: 270151 - protein, 8 aa, Influenza virus
FTWAIHHP

SEQ ID NO: 270152 - protein, 8 aa, Influenza virus
TWAIHHPP

SEQ ID NO: 270153 - protein, 8 aa, Influenza virus
WAIHHPPT

SEQ ID NO: 270154 - protein, 8 aa, Influenza virus
AIHHPPTS

SEQ ID NO: 270155 - protein, 8 aa, Influenza virus
IHHPPTSD

SEQ ID NO: 270156 - protein, 8 aa, Influenza virus
HHPPTSDE

SEQ ID NO: 270157 - protein, 8 aa, Influenza virus
HPPTSDEQ

SEQ ID NO: 270158 - protein, 8 aa, Influenza virus
PPTSDEQV

SEQ ID NO: 270159 - protein, 8 aa, Influenza virus
EINRSFKP

SEQ ID NO: 270160 - protein, 8 aa, Influenza virus
INRSFKPN

SEQ ID NO: 270161 - protein, 8 aa, Influenza virus
NRSFKPNI

SEQ ID NO: 270162 - protein, 8 aa, Influenza virus
RSFKPNIG

SEQ ID NO: 270163 - protein, 8 aa, Influenza virus
SFKPNIGP

SEQ ID NO: 270164 - protein, 8 aa, Influenza virus
FKPNIGPR

SEQ ID NO: 270165 - protein, 8 aa, Influenza virus
KPNIGPRP

SEQ ID NO: 270166 - protein, 8 aa, Influenza virus
PNIGPRPL

SEQ ID NO: 270167 - protein, 8 aa, Influenza virus
NIGPRPLV

SEQ ID NO: 270168 - protein, 8 aa, Influenza virus
IGPRPLVR

SEQ ID NO: 270169 - protein, 8 aa, Influenza virus
GPRPLVRG

SEQ ID NO: 270170 - protein, 8 aa, Influenza virus
PRPLVRGQ

SEQ ID NO: 270171 - protein, 8 aa, Influenza virus
RPLVRGQQ

SEQ ID NO: 270172 - protein, 8 aa, Influenza virus
PLVRGQQG

SEQ ID NO: 270173 - protein, 8 aa, Influenza virus
LVRGQQGR

SEQ ID NO: 270174 - protein, 8 aa, Influenza virus
VRGQQGRM

SEQ ID NO: 270175 - protein, 8 aa, Influenza virus
RGQQGRMD

SEQ ID NO: 270176 - protein, 8 aa, Influenza virus
GQQGRMDY

SEQ ID NO: 270177 - protein, 8 aa, Influenza virus
QQGRMDYY

SEQ ID NO: 270178 - protein, 8 aa, Influenza virus
QGRMDYYW

SEQ ID NO: 270179 - protein, 8 aa, Influenza virus
GRMDYYWA

SEQ ID NO: 270180 - protein, 8 aa, Influenza virus
RMDYYWAV

SEQ ID NO: 270181 - protein, 8 aa, Influenza virus
MDYYWAVL

SEQ ID NO: 270182 - protein, 8 aa, Influenza virus
DYYWAVLK

SEQ ID NO: 270183 - protein, 8 aa, Influenza virus
YYWAVLKP

SEQ ID NO: 270184 - protein, 8 aa, Influenza virus
YWAVLKPG

SEQ ID NO: 270185 - protein, 8 aa, Influenza virus
WAVLKPGQ

SEQ ID NO: 270186 - protein, 8 aa, Influenza virus
AVLKPGQT

SEQ ID NO: 270187 - protein, 8 aa, Influenza virus
VLKPGQTV

SEQ ID NO: 270188 - protein, 8 aa, Influenza virus
LKPGQTVK

SEQ ID NO: 270189 - protein, 8 aa, Influenza virus
KPGQTVKI

SEQ ID NO: 270190 - protein, 8 aa, Influenza virus
PGQTVKIQ

SEQ ID NO: 270191 - protein, 8 aa, Influenza virus
GQTVKIQT

SEQ ID NO: 270192 - protein, 8 aa, Influenza virus
QTVKIQTN

SEQ ID NO: 270193 - protein, 8 aa, Influenza virus
TVKIQTNG

SEQ ID NO: 270194 - protein, 8 aa, Influenza virus
VKIQTNGN

SEQ ID NO: 270195 - protein, 8 aa, Influenza virus
KIQTNGNL

SEQ ID NO: 270196 - protein, 8 aa, Influenza virus
IQTNGNLI

SEQ ID NO: 270197 - protein, 8 aa, Influenza virus
QTNGNLIA

SEQ ID NO: 270198 - protein, 8 aa, Influenza virus
TNGNLIAP

SEQ ID NO: 270199 - protein, 8 aa, Influenza virus
NGNLIAPE

SEQ ID NO: 270200 - protein, 8 aa, Influenza virus
GNLIAPEY

SEQ ID NO: 270201 - protein, 8 aa, Influenza virus
NLIAPEYG

SEQ ID NO: 270202 - protein, 8 aa, Influenza virus
LIAPEYGH

SEQ ID NO: 270203 - protein, 8 aa, Influenza virus
IAPEYGHL

SEQ ID NO: 270204 - protein, 8 aa, Influenza virus
APEYGHLI

SEQ ID NO: 270205 - protein, 8 aa, Influenza virus
PEYGHLIT

SEQ ID NO: 270206 - protein, 8 aa, Influenza virus
EYGHLITG

SEQ ID NO: 270207 - protein, 8 aa, Influenza virus
YGHLITGK

SEQ ID NO: 270208 - protein, 8 aa, Influenza virus
GHLITGKS

SEQ ID NO: 270209 - protein, 8 aa, Influenza virus
HLITGKSH

SEQ ID NO: 270210 - protein, 8 aa, Influenza virus
LITGKSHG

SEQ ID NO: 270211 - protein, 8 aa, Influenza virus
ITGKSHGR

SEQ ID NO: 270212 - protein, 8 aa, Influenza virus
TGKSHGRI

SEQ ID NO: 270213 - protein, 8 aa, Influenza virus
GKSHGRIL

SEQ ID NO: 270214 - protein, 8 aa, Influenza virus
KSHGRILK

SEQ ID NO: 270215 - protein, 8 aa, Influenza virus
SHGRILKN

SEQ ID NO: 270216 - protein, 8 aa, Influenza virus
HGRILKNN

SEQ ID NO: 270217 - protein, 8 aa, Influenza virus
GRILKNNL

SEQ ID NO: 270218 - protein, 8 aa, Influenza virus
RILKNNLP

SEQ ID NO: 270219 - protein, 8 aa, Influenza virus
LKNNLPIG

SEQ ID NO: 270220 - protein, 8 aa, Influenza virus
TECQLNEG

SEQ ID NO: 270221 - protein, 8 aa, Influenza virus
ECQLNEGV

SEQ ID NO: 270222 - protein, 8 aa, Influenza virus
CQLNEGVM

SEQ ID NO: 270223 - protein, 8 aa, Influenza virus
QLNEGVMN

SEQ ID NO: 270224 - protein, 8 aa, Influenza virus
LNEGVMNT

SEQ ID NO: 270225 - protein, 8 aa, Influenza virus
NEGVMNTS

SEQ ID NO: 270226 - protein, 8 aa, Influenza virus
EGVMNTSK

SEQ ID NO: 270227 - protein, 8 aa, Influenza virus
GVMNTSKP

SEQ ID NO: 270228 - protein, 8 aa, Influenza virus
VMNTSKPF

SEQ ID NO: 270229 - protein, 8 aa, Influenza virus
MNTSKPFQ

SEQ ID NO: 270230 - protein, 8 aa, Influenza virus
NTSKPFQN

SEQ ID NO: 270231 - protein, 8 aa, Influenza virus
TSKPFQNT

SEQ ID NO: 270232 - protein, 8 aa, Influenza virus
SKPFQNTS

SEQ ID NO: 270233 - protein, 8 aa, Influenza virus
KPFQNTSK

SEQ ID NO: 270234 - protein, 8 aa, Influenza virus
PFQNTSKH

SEQ ID NO: 270235 - protein, 8 aa, Influenza virus
FQNTSKHY

SEQ ID NO: 270236 - protein, 8 aa, Influenza virus
QNTSKHYI

SEQ ID NO: 270237 - protein, 8 aa, Influenza virus
NTSKHYIG

SEQ ID NO: 270238 - protein, 8 aa, Influenza virus
TSKHYIGK

SEQ ID NO: 270239 - protein, 8 aa, Influenza virus
SKHYIGKC

SEQ ID NO: 270240 - protein, 8 aa, Influenza virus
KHYIGKCP

SEQ ID NO: 270241 - protein, 8 aa, Influenza virus
HYIGKCPK

SEQ ID NO: 270242 - protein, 8 aa, Influenza virus
YIGKCPKY

SEQ ID NO: 270243 - protein, 8 aa, Influenza virus
IGKCPKYI

SEQ ID NO: 270244 - protein, 8 aa, Influenza virus
GKCPKYIP

SEQ ID NO: 270245 - protein, 8 aa, Influenza virus
KCPKYIPS

SEQ ID NO: 270246 - protein, 8 aa, Influenza virus
CPKYIPSG

SEQ ID NO: 270247 - protein, 8 aa, Influenza virus
PKYIPSGS

SEQ ID NO: 270248 - protein, 8 aa, Influenza virus
KYIPSGSL

SEQ ID NO: 270249 - protein, 8 aa, Influenza virus
YIPSGSLK

SEQ ID NO: 270250 - protein, 8 aa, Influenza virus
IPSGSLKL

SEQ ID NO: 270251 - protein, 8 aa, Influenza virus
PSGSLKLA

SEQ ID NO: 270252 - protein, 8 aa, Influenza virus
SGSLKLAI

SEQ ID NO: 270253 - protein, 8 aa, Influenza virus
GSLKLAIG

SEQ ID NO: 270254 - protein, 8 aa, Influenza virus
SLKLAIGL

SEQ ID NO: 270255 - protein, 8 aa, Influenza virus
LKLAIGLR

SEQ ID NO: 270256 - protein, 8 aa, Influenza virus
KLAIGLRN

SEQ ID NO: 270257 - protein, 8 aa, Influenza virus
LAIGLRNV

SEQ ID NO: 270258 - protein, 8 aa, Influenza virus
AIGLRNVP

SEQ ID NO: 270259 - protein, 8 aa, Influenza virus
IGLRNVPQ

SEQ ID NO: 270260 - protein, 8 aa, Influenza virus
GLRNVPQA

SEQ ID NO: 270261 - protein, 8 aa, Influenza virus
LRNVPQAQ

SEQ ID NO: 270262 - protein, 8 aa, Influenza virus
RNVPQAQD

SEQ ID NO: 270263 - protein, 8 aa, Influenza virus
NVPQAQDR

SEQ ID NO: 270264 - protein, 8 aa, Influenza virus
VPQAQDRG

SEQ ID NO: 270265 - protein, 8 aa, Influenza virus
PQAQDRGL

SEQ ID NO: 270266 - protein, 8 aa, Influenza virus
QAQDRGLF

SEQ ID NO: 270267 - protein, 8 aa, Influenza virus
AQDRGLFG

SEQ ID NO: 270268 - protein, 8 aa, Influenza virus
QNRGLFGA

SEQ ID NO: 270269 - protein, 8 aa, Influenza virus
NRGLFGAI

SEQ ID NO: 270270 - protein, 8 aa, Influenza virus
RGLFGAIA

SEQ ID NO: 270271 - protein, 8 aa, Influenza virus
GLFGAIAG

SEQ ID NO: 270272 - protein, 8 aa, Influenza virus
LFGAIAGF

SEQ ID NO: 270273 - protein, 8 aa, Influenza virus
FGAIAGFI

SEQ ID NO: 270274 - protein, 8 aa, Influenza virus
GAIAGFIE

SEQ ID NO: 270275 - protein, 8 aa, Influenza virus
AIAGFIEG

SEQ ID NO: 270276 - protein, 8 aa, Influenza virus
IAGFIEGG

SEQ ID NO: 270277 - protein, 8 aa, Influenza virus
AGFIEGGW

SEQ ID NO: 270278 - protein, 8 aa, Influenza virus
GFIEGGWP

SEQ ID NO: 270279 - protein, 8 aa, Influenza virus
FIEGGWPG

SEQ ID NO: 270280 - protein, 8 aa, Influenza virus
IEGGWPGL

SEQ ID NO: 270281 - protein, 8 aa, Influenza virus
EGGWPGLV

SEQ ID NO: 270282 - protein, 8 aa, Influenza virus
GGWPGLVA

SEQ ID NO: 270283 - protein, 8 aa, Influenza virus
GWPGLVAG

SEQ ID NO: 270284 - protein, 8 aa, Influenza virus
WPGLVAGW

SEQ ID NO: 270285 - protein, 8 aa, Influenza virus
PGLVAGWY

SEQ ID NO: 270286 - protein, 8 aa, Influenza virus
GLVAGWYG

SEQ ID NO: 270287 - protein, 8 aa, Influenza virus
LVAGWYGF

SEQ ID NO: 270288 - protein, 8 aa, Influenza virus
VAGWYGFQ

SEQ ID NO: 270289 - protein, 8 aa, Influenza virus
AGWYGFQH

SEQ ID NO: 270290 - protein, 8 aa, Influenza virus
GWYGFQHQ

SEQ ID NO: 270291 - protein, 8 aa, Influenza virus
WYGFQHQN

SEQ ID NO: 270292 - protein, 8 aa, Influenza virus
YGFQHQNA

SEQ ID NO: 270293 - protein, 8 aa, Influenza virus
GFQHQNAE

SEQ ID NO: 270294 - protein, 8 aa, Influenza virus
FQHQNAEG

SEQ ID NO: 270295 - protein, 8 aa, Influenza virus
QHQNAEGT

SEQ ID NO: 270296 - protein, 8 aa, Influenza virus
HQNAEGTG

SEQ ID NO: 270297 - protein, 8 aa, Influenza virus
QNAEGTGI

SEQ ID NO: 270298 - protein, 8 aa, Influenza virus
NAEGTGIA

SEQ ID NO: 270299 - protein, 8 aa, Influenza virus
AEGTGIAA

SEQ ID NO: 270300 - protein, 8 aa, Influenza virus
EGTGIAAD

SEQ ID NO: 270301 - protein, 8 aa, Influenza virus
GTGIAADR

SEQ ID NO: 270302 - protein, 8 aa, Influenza virus
TGIAADRD

SEQ ID NO: 270303 - protein, 8 aa, Influenza virus
GIAADRDS

SEQ ID NO: 270304 - protein, 8 aa, Influenza virus
IAADRDST

SEQ ID NO: 270305 - protein, 8 aa, Influenza virus
AADRDSTQ

SEQ ID NO: 270306 - protein, 8 aa, Influenza virus
ADRDSTQK

SEQ ID NO: 270307 - protein, 8 aa, Influenza virus
DRDSTQKA

SEQ ID NO: 270308 - protein, 8 aa, Influenza virus
RDSTQKAI

SEQ ID NO: 270309 - protein, 8 aa, Influenza virus
DSTQKAID

SEQ ID NO: 270310 - protein, 8 aa, Influenza virus
STQKAIDN

SEQ ID NO: 270311 - protein, 8 aa, Influenza virus
TQKAIDNM

SEQ ID NO: 270312 - protein, 8 aa, Influenza virus
QKAIDNMQ

SEQ ID NO: 270313 - protein, 8 aa, Influenza virus
KAIDNMQN

SEQ ID NO: 270314 - protein, 8 aa, Influenza virus
AIDNMQNK

SEQ ID NO: 270315 - protein, 8 aa, Influenza virus
IDNMQNKL

SEQ ID NO: 270316 - protein, 8 aa, Influenza virus
DNMQNKLN

SEQ ID NO: 270317 - protein, 8 aa, Influenza virus
NMQNKLNN

SEQ ID NO: 270318 - protein, 8 aa, Influenza virus
MQNKLNNV

SEQ ID NO: 270319 - protein, 8 aa, Influenza virus
QNKLNNVI

SEQ ID NO: 270320 - protein, 8 aa, Influenza virus
NKLNNVID

SEQ ID NO: 270321 - protein, 8 aa, Influenza virus
KLNNVIDK

SEQ ID NO: 270322 - protein, 8 aa, Influenza virus
LNNVIDKM

SEQ ID NO: 270323 - protein, 8 aa, Influenza virus
NNVIDKMN

SEQ ID NO: 270324 - protein, 8 aa, Influenza virus
NVIDKMNK

SEQ ID NO: 270325 - protein, 8 aa, Influenza virus
VIDKMNKQ

SEQ ID NO: 270326 - protein, 8 aa, Influenza virus
IDKMNKQF

SEQ ID NO: 270327 - protein, 8 aa, Influenza virus
EFSEVESR

SEQ ID NO: 270328 - protein, 8 aa, Influenza virus
FSEVESRI

SEQ ID NO: 270329 - protein, 8 aa, Influenza virus
SEVESRIN

SEQ ID NO: 270330 - protein, 8 aa, Influenza virus
VESRINMI

SEQ ID NO: 270331 - protein, 8 aa, Influenza virus
ESRINMIN

SEQ ID NO: 270332 - protein, 8 aa, Influenza virus
SRINMINS

SEQ ID NO: 270333 - protein, 8 aa, Influenza virus
RINMINSK

SEQ ID NO: 270334 - protein, 8 aa, Influenza virus
INMINSKI

SEQ ID NO: 270335 - protein, 8 aa, Influenza virus
NMINSKID

SEQ ID NO: 270336 - protein, 8 aa, Influenza virus
MINSKIDD

SEQ ID NO: 270337 - protein, 8 aa, Influenza virus
INSKIDDQ

SEQ ID NO: 270338 - protein, 8 aa, Influenza virus
NSKIDDQI

SEQ ID NO: 270339 - protein, 8 aa, Influenza virus
IDDQITDI

SEQ ID NO: 270340 - protein, 8 aa, Influenza virus
DDQITDIW

SEQ ID NO: 270341 - protein, 8 aa, Influenza virus
DQITDIWA

SEQ ID NO: 270342 - protein, 8 aa, Influenza virus
QITDIWAY

SEQ ID NO: 270343 - protein, 8 aa, Influenza virus
ITDIWAYN

SEQ ID NO: 270344 - protein, 8 aa, Influenza virus
TDIWAYNA

SEQ ID NO: 270345 - protein, 8 aa, Influenza virus
DIWAYNAE

SEQ ID NO: 270346 - protein, 8 aa, Influenza virus
IWAYNAEL

SEQ ID NO: 270347 - protein, 8 aa, Influenza virus
WAYNAELL

SEQ ID NO: 270348 - protein, 8 aa, Influenza virus
AYNAELLV

SEQ ID NO: 270349 - protein, 8 aa, Influenza virus
YNAELLVL

SEQ ID NO: 270350 - protein, 8 aa, Influenza virus
NAELLVLL

SEQ ID NO: 270351 - protein, 8 aa, Influenza virus
AELLVLLE

SEQ ID NO: 270352 - protein, 8 aa, Influenza virus
ELLVLLEN

SEQ ID NO: 270353 - protein, 8 aa, Influenza virus
LLVLLENQ

SEQ ID NO: 270354 - protein, 8 aa, Influenza virus
LVLLENQK

SEQ ID NO: 270355 - protein, 8 aa, Influenza virus
VLLENQKT

SEQ ID NO: 270356 - protein, 8 aa, Influenza virus
LLENQKTL

SEQ ID NO: 270357 - protein, 8 aa, Influenza virus
LENQKTLD

SEQ ID NO: 270358 - protein, 8 aa, Influenza virus
ENQKTLDE

SEQ ID NO: 270359 - protein, 8 aa, Influenza virus
NQKTLDEH

SEQ ID NO: 270360 - protein, 8 aa, Influenza virus
QKTLDEHD

SEQ ID NO: 270361 - protein, 8 aa, Influenza virus
KTLDEHDA

SEQ ID NO: 270362 - protein, 8 aa, Influenza virus
TLDEHDAN

SEQ ID NO: 270363 - protein, 8 aa, Influenza virus
LDEHDANV

SEQ ID NO: 270364 - protein, 8 aa, Influenza virus
DEHDANVR

SEQ ID NO: 270365 - protein, 8 aa, Influenza virus
EHDANVRN

SEQ ID NO: 270366 - protein, 8 aa, Influenza virus
HDANVRNL

SEQ ID NO: 270367 - protein, 8 aa, Influenza virus
DANVRNLH

SEQ ID NO: 270368 - protein, 8 aa, Influenza virus
ANVRNLHD

SEQ ID NO: 270369 - protein, 8 aa, Influenza virus
NVRNLHDR

SEQ ID NO: 270370 - protein, 8 aa, Influenza virus
VRNLHDRV

SEQ ID NO: 270371 - protein, 8 aa, Influenza virus
RNLHDRVR

SEQ ID NO: 270372 - protein, 8 aa, Influenza virus
NLHDRVRR

SEQ ID NO: 270373 - protein, 8 aa, Influenza virus
RRVLRENA

SEQ ID NO: 270374 - protein, 8 aa, Influenza virus
RVLRENAI

SEQ ID NO: 270375 - protein, 8 aa, Influenza virus
VLRENAID

SEQ ID NO: 270376 - protein, 8 aa, Influenza virus
ENAIDTGD

SEQ ID NO: 270377 - protein, 8 aa, Influenza virus
NAIDTGDG

SEQ ID NO: 270378 - protein, 8 aa, Influenza virus
AIDTGDGC

SEQ ID NO: 270379 - protein, 8 aa, Influenza virus
IDTGDGCF

SEQ ID NO: 270380 - protein, 8 aa, Influenza virus
DTGDGCFE

SEQ ID NO: 270381 - protein, 8 aa, Influenza virus
TGDGCFEI

SEQ ID NO: 270382 - protein, 8 aa, Influenza virus
GDGCFEIL

SEQ ID NO: 270383 - protein, 8 aa, Influenza virus
DGCFEILH

SEQ ID NO: 270384 - protein, 8 aa, Influenza virus
GCFEILHK

SEQ ID NO: 270385 - protein, 8 aa, Influenza virus
CFEILHKC

SEQ ID NO: 270386 - protein, 8 aa, Influenza virus
FEILHKCD

SEQ ID NO: 270387 - protein, 8 aa, Influenza virus
EILHKCDN

SEQ ID NO: 270388 - protein, 8 aa, Influenza virus
TIRNGTYN

SEQ ID NO: 270389 - protein, 8 aa, Influenza virus
IRNGTYNH

SEQ ID NO: 270390 - protein, 8 aa, Influenza virus
RNGTYNHK

SEQ ID NO: 270391 - protein, 8 aa, Influenza virus
GTYNHKEY

SEQ ID NO: 270392 - protein, 8 aa, Influenza virus
TYNHKEYE

SEQ ID NO: 270393 - protein, 8 aa, Influenza virus
YEEESKIE

SEQ ID NO: 270394 - protein, 8 aa, Influenza virus
EEESKIER

SEQ ID NO: 270395 - protein, 8 aa, Influenza virus
EESKIERQ

SEQ ID NO: 270396 - protein, 8 aa, Influenza virus
ESKIERQK

SEQ ID NO: 270397 - protein, 8 aa, Influenza virus
SKIERQKI

SEQ ID NO: 270398 - protein, 8 aa, Influenza virus
ERQKINGV

SEQ ID NO: 270399 - protein, 8 aa, Influenza virus
RQKINGVK

SEQ ID NO: 270400 - protein, 8 aa, Influenza virus
QKINGVKL

SEQ ID NO: 270401 - protein, 8 aa, Influenza virus
KINGVKLE

SEQ ID NO: 270402 - protein, 8 aa, Influenza virus
INGVKLEE

SEQ ID NO: 270403 - protein, 8 aa, Influenza virus
NGVKLEEN

SEQ ID NO: 270404 - protein, 8 aa, Influenza virus
GVKLEENS

SEQ ID NO: 270405 - protein, 8 aa, Influenza virus
VKLEENST

SEQ ID NO: 270406 - protein, 8 aa, Influenza virus
KLEENSTY

SEQ ID NO: 270407 - protein, 8 aa, Influenza virus
LEENSTYK

SEQ ID NO: 270408 - protein, 8 aa, Influenza virus
EENSTYKI

SEQ ID NO: 270409 - protein, 8 aa, Influenza virus
ENSTYKIL

SEQ ID NO: 270410 - protein, 8 aa, Influenza virus
NSTYKILS

SEQ ID NO: 270411 - protein, 8 aa, Influenza virus
STYKILSI

SEQ ID NO: 270412 - protein, 8 aa, Influenza virus
TYKILSIY

SEQ ID NO: 270413 - protein, 8 aa, Influenza virus
YKILSIYS

SEQ ID NO: 270414 - protein, 8 aa, Influenza virus
KILSIYSS

SEQ ID NO: 270415 - protein, 8 aa, Influenza virus
ILSIYSSV

SEQ ID NO: 270416 - protein, 8 aa, Influenza virus
LSIYSSVA

SEQ ID NO: 270417 - protein, 8 aa, Influenza virus
SIYSSVAS

SEQ ID NO: 270418 - protein, 8 aa, Influenza virus
IYSSVASS

SEQ ID NO: 270419 - protein, 8 aa, Influenza virus
YSSVASSL

SEQ ID NO: 270420 - protein, 8 aa, Influenza virus
SSVASSLV

SEQ ID NO: 270421 - protein, 8 aa, Influenza virus
SVASSLVL

SEQ ID NO: 270422 - protein, 8 aa, Influenza virus
VASSLVLL

SEQ ID NO: 270423 - protein, 8 aa, Influenza virus
ASSLVLLL

SEQ ID NO: 270424 - protein, 8 aa, Influenza virus
SSLVLLLM

SEQ ID NO: 270425 - protein, 8 aa, Influenza virus
SLVLLLMI

SEQ ID NO: 270426 - protein, 8 aa, Influenza virus
LVLLLMII

SEQ ID NO: 270427 - protein, 8 aa, Influenza virus
VLLLMIIG

SEQ ID NO: 270428 - protein, 8 aa, Influenza virus
LLLMIIGG

SEQ ID NO: 270429 - protein, 8 aa, Influenza virus
LLMIIGGF

SEQ ID NO: 270430 - protein, 8 aa, Influenza virus
LMIIGGFI

SEQ ID NO: 270431 - protein, 8 aa, Influenza virus
MIIGGFIF

SEQ ID NO: 270432 - protein, 8 aa, Influenza virus
IIGGFIFG

SEQ ID NO: 270433 - protein, 8 aa, Influenza virus
IGGFIFGC

SEQ ID NO: 270434 - protein, 8 aa, Influenza virus
GGFIFGCQ

SEQ ID NO: 270435 - protein, 8 aa, Influenza virus
GFIFGCQN

SEQ ID NO: 270436 - protein, 8 aa, Influenza virus
FIFGCQNG

SEQ ID NO: 270437 - protein, 8 aa, Influenza virus
IFGCQNGN

SEQ ID NO: 270438 - protein, 8 aa, Influenza virus
FGCQNGNV

SEQ ID NO: 270439 - protein, 8 aa, Influenza virus
GCQNGNVR

SEQ ID NO: 270440 - protein, 8 aa, Influenza virus
CQNGNVRC

SEQ ID NO: 270441 - protein, 8 aa, Influenza virus
QNGNVRCT

SEQ ID NO: 270442 - protein, 8 aa, Influenza virus
NGNVRCTF

SEQ ID NO: 270443 - protein, 8 aa, Influenza virus
GNVRCTFC

SEQ ID NO: 270444 - protein, 8 aa, Influenza virus
NVRCTFCI

SEQ ID NO: 270445 - protein, 8 aa, Influenza virus
ADRICVGY

SEQ ID NO: 270446 - protein, 8 aa, Influenza virus
DRICVGYL

SEQ ID NO: 270447 - protein, 8 aa, Influenza virus
RICVGYLS

SEQ ID NO: 270448 - protein, 8 aa, Influenza virus
ICVGYLST

SEQ ID NO: 270449 - protein, 8 aa, Influenza virus
CVGYLSTN

SEQ ID NO: 270450 - protein, 8 aa, Influenza virus
VGYLSTNS

SEQ ID NO: 270451 - protein, 8 aa, Influenza virus
GYLSTNSS

SEQ ID NO: 270452 - protein, 8 aa, Influenza virus
YLSTNSSE

SEQ ID NO: 270453 - protein, 8 aa, Influenza virus
LSTNSSER

SEQ ID NO: 270454 - protein, 8 aa, Influenza virus
STNSSERV

SEQ ID NO: 270455 - protein, 8 aa, Influenza virus
TNSSERVD

SEQ ID NO: 270456 - protein, 8 aa, Influenza virus
NSSERVDT

SEQ ID NO: 270457 - protein, 8 aa, Influenza virus
SSERVDTL

SEQ ID NO: 270458 - protein, 8 aa, Influenza virus
SERVDTLL

SEQ ID NO: 270459 - protein, 8 aa, Influenza virus
EKVDTLLE

SEQ ID NO: 270460 - protein, 8 aa, Influenza virus
KVDTLLEN

SEQ ID NO: 270461 - protein, 8 aa, Influenza virus
VDTLLENG

SEQ ID NO: 270462 - protein, 8 aa, Influenza virus
DTLLENGV

SEQ ID NO: 270463 - protein, 8 aa, Influenza virus
TLLENGVP

SEQ ID NO: 270464 - protein, 8 aa, Influenza virus
LLENGVPV

SEQ ID NO: 270465 - protein, 8 aa, Influenza virus
LENGVPVT

SEQ ID NO: 270466 - protein, 8 aa, Influenza virus
ENGVPVTS

SEQ ID NO: 270467 - protein, 8 aa, Influenza virus
NGVPVTSS

SEQ ID NO: 270468 - protein, 8 aa, Influenza virus
VPVTSSVD

SEQ ID NO: 270469 - protein, 8 aa, Influenza virus
PVTSSVDL

SEQ ID NO: 270470 - protein, 8 aa, Influenza virus
VTSSVDLV

SEQ ID NO: 270471 - protein, 8 aa, Influenza virus
TSSVDLVE

SEQ ID NO: 270472 - protein, 8 aa, Influenza virus
SSVDLVET

SEQ ID NO: 270473 - protein, 8 aa, Influenza virus
DLVETNHT

SEQ ID NO: 270474 - protein, 8 aa, Influenza virus
LVETNHTG

SEQ ID NO: 270475 - protein, 8 aa, Influenza virus
VETNHTGT

SEQ ID NO: 270476 - protein, 8 aa, Influenza virus
ETNHTGTY

SEQ ID NO: 270477 - protein, 8 aa, Influenza virus
TNHTGTYC

SEQ ID NO: 270478 - protein, 8 aa, Influenza virus
NHTGTYCS

SEQ ID NO: 270479 - protein, 8 aa, Influenza virus
HTGTYCSL

SEQ ID NO: 270480 - protein, 8 aa, Influenza virus
TGTYCSLN

SEQ ID NO: 270481 - protein, 8 aa, Influenza virus
GTYCSLNG

SEQ ID NO: 270482 - protein, 8 aa, Influenza virus
GISPVHLG

SEQ ID NO: 270483 - protein, 8 aa, Influenza virus
ISPVHLGD

SEQ ID NO: 270484 - protein, 8 aa, Influenza virus
SPVHLGDC

SEQ ID NO: 270485 - protein, 8 aa, Influenza virus
PVHLGDCS

SEQ ID NO: 270486 - protein, 8 aa, Influenza virus
VHLGDCSF

SEQ ID NO: 270487 - protein, 8 aa, Influenza virus
HLGDCSFE

SEQ ID NO: 270488 - protein, 8 aa, Influenza virus
LGDCSFEG

SEQ ID NO: 270489 - protein, 8 aa, Influenza virus
GDCSFEGW

SEQ ID NO: 270490 - protein, 8 aa, Influenza virus
DCSFEGWI

SEQ ID NO: 270491 - protein, 8 aa, Influenza virus
CSFEGWIV

SEQ ID NO: 270492 - protein, 8 aa, Influenza virus
SFEGWIVG

SEQ ID NO: 270493 - protein, 8 aa, Influenza virus
FEGWIVGN

SEQ ID NO: 270494 - protein, 8 aa, Influenza virus
EGWIVGNP

SEQ ID NO: 270495 - protein, 8 aa, Influenza virus
GWIVGNPA

SEQ ID NO: 270496 - protein, 8 aa, Influenza virus
WIVGNPAC

SEQ ID NO: 270497 - protein, 8 aa, Influenza virus
GIREWSYL

SEQ ID NO: 270498 - protein, 8 aa, Influenza virus
IREWSYLI

SEQ ID NO: 270499 - protein, 8 aa, Influenza virus
REWSYLIE

SEQ ID NO: 270500 - protein, 8 aa, Influenza virus
EWSYLIED

SEQ ID NO: 270501 - protein, 8 aa, Influenza virus
WSYLIEDP

SEQ ID NO: 270502 - protein, 8 aa, Influenza virus
SYLIEDPS

SEQ ID NO: 270503 - protein, 8 aa, Influenza virus
YLIEDPSA

SEQ ID NO: 270504 - protein, 8 aa, Influenza virus
LIEDPSAP

SEQ ID NO: 270505 - protein, 8 aa, Influenza virus
IEDPSAPH

SEQ ID NO: 270506 - protein, 8 aa, Influenza virus
EDPSAPHG

SEQ ID NO: 270507 - protein, 8 aa, Influenza virus
DPSAPHGL

SEQ ID NO: 270508 - protein, 8 aa, Influenza virus
PSAPHGLC

SEQ ID NO: 270509 - protein, 8 aa, Influenza virus
SAPHGLCY

SEQ ID NO: 270510 - protein, 8 aa, Influenza virus
APHGLCYP

SEQ ID NO: 270511 - protein, 8 aa, Influenza virus
PHGLCYPG

SEQ ID NO: 270512 - protein, 8 aa, Influenza virus
HGLCYPGE

SEQ ID NO: 270513 - protein, 8 aa, Influenza virus
GLCYPGEL

SEQ ID NO: 270514 - protein, 8 aa, Influenza virus
LCYPGELD

SEQ ID NO: 270515 - protein, 8 aa, Influenza virus
CYPGELDN

SEQ ID NO: 270516 - protein, 8 aa, Influenza virus
YPGELDNN

SEQ ID NO: 270517 - protein, 8 aa, Influenza virus
PGELDNNG

SEQ ID NO: 270518 - protein, 8 aa, Influenza virus
GELDNNGE

SEQ ID NO: 270519 - protein, 8 aa, Influenza virus
ELDNNGEL

SEQ ID NO: 270520 - protein, 8 aa, Influenza virus
LDNNGELR

SEQ ID NO: 270521 - protein, 8 aa, Influenza virus
DNNGELRH

SEQ ID NO: 270522 - protein, 8 aa, Influenza virus
NNGELRHL

SEQ ID NO: 270523 - protein, 8 aa, Influenza virus
NGELRHLF

SEQ ID NO: 270524 - protein, 8 aa, Influenza virus
GELRHLFS

SEQ ID NO: 270525 - protein, 8 aa, Influenza virus
ELRHLFSG

SEQ ID NO: 270526 - protein, 8 aa, Influenza virus
LRHLFSGI

SEQ ID NO: 270527 - protein, 8 aa, Influenza virus
RHLFSGIR

SEQ ID NO: 270528 - protein, 8 aa, Influenza virus
HLFSGIRS

SEQ ID NO: 270529 - protein, 8 aa, Influenza virus
LFSGIRSF

SEQ ID NO: 270530 - protein, 8 aa, Influenza virus
FSGIRSFS

SEQ ID NO: 270531 - protein, 8 aa, Influenza virus
SGIRSFSR

SEQ ID NO: 270532 - protein, 8 aa, Influenza virus
GIRSFSRT

SEQ ID NO: 270533 - protein, 8 aa, Influenza virus
IRSFSRTE

SEQ ID NO: 270534 - protein, 8 aa, Influenza virus
RSFSRTEL

SEQ ID NO: 270535 - protein, 8 aa, Influenza virus
SFSRTELI

SEQ ID NO: 270536 - protein, 8 aa, Influenza virus
FSRTELIA

SEQ ID NO: 270537 - protein, 8 aa, Influenza virus
SRTELIAP

SEQ ID NO: 270538 - protein, 8 aa, Influenza virus
LIAPTSWG

SEQ ID NO: 270539 - protein, 8 aa, Influenza virus
SWGEVLDG

SEQ ID NO: 270540 - protein, 8 aa, Influenza virus
KGTNSFYR

SEQ ID NO: 270541 - protein, 8 aa, Influenza virus
SFYRNLVW

SEQ ID NO: 270542 - protein, 8 aa, Influenza virus
FYRNLVWF

SEQ ID NO: 270543 - protein, 8 aa, Influenza virus
YRNLVWFV

SEQ ID NO: 270544 - protein, 8 aa, Influenza virus
GGYPVIKK

SEQ ID NO: 270545 - protein, 8 aa, Influenza virus
KTYNNTTG

SEQ ID NO: 270546 - protein, 8 aa, Influenza virus
TYNNTTGR

SEQ ID NO: 270547 - protein, 8 aa, Influenza virus
YNNTTGRD

SEQ ID NO: 270548 - protein, 8 aa, Influenza virus
NNTTGRDV

SEQ ID NO: 270549 - protein, 8 aa, Influenza virus
NTTGRDVL

SEQ ID NO: 270550 - protein, 8 aa, Influenza virus
TTGRDVLV

SEQ ID NO: 270551 - protein, 8 aa, Influenza virus
TGRDVLVL

SEQ ID NO: 270552 - protein, 8 aa, Influenza virus
GRDVLVLW

SEQ ID NO: 270553 - protein, 8 aa, Influenza virus
RDVLVLWG

SEQ ID NO: 270554 - protein, 8 aa, Influenza virus
DVLVLWGI

SEQ ID NO: 270555 - protein, 8 aa, Influenza virus
VLVLWGIH

SEQ ID NO: 270556 - protein, 8 aa, Influenza virus
LVLWGIHH

SEQ ID NO: 270557 - protein, 8 aa, Influenza virus
VLWGIHHP

SEQ ID NO: 270558 - protein, 8 aa, Influenza virus
WGIHHPVS

SEQ ID NO: 270559 - protein, 8 aa, Influenza virus
DPYTLVST

SEQ ID NO: 270560 - protein, 8 aa, Influenza virus
PYTLVSTS

SEQ ID NO: 270561 - protein, 8 aa, Influenza virus
YTLVSTSS

SEQ ID NO: 270562 - protein, 8 aa, Influenza virus
TLVSTSSW

SEQ ID NO: 270563 - protein, 8 aa, Influenza virus
LVSTSSWS

SEQ ID NO: 270564 - protein, 8 aa, Influenza virus
GVRPGYNG

SEQ ID NO: 270565 - protein, 8 aa, Influenza virus
VRPGYNGQ

SEQ ID NO: 270566 - protein, 8 aa, Influenza virus
RPGYNGQK

SEQ ID NO: 270567 - protein, 8 aa, Influenza virus
PGYNGQRS

SEQ ID NO: 270568 - protein, 8 aa, Influenza virus
GYNGQKSW

SEQ ID NO: 270569 - protein, 8 aa, Influenza virus
YNGQRSWM

SEQ ID NO: 270570 - protein, 8 aa, Influenza virus
NGQRSWMK

SEQ ID NO: 270571 - protein, 8 aa, Influenza virus
GQRSWMKI

SEQ ID NO: 270572 - protein, 8 aa, Influenza virus
QRSWMKIY

SEQ ID NO: 270573 - protein, 8 aa, Influenza virus
RSWMKIYW

SEQ ID NO: 270574 - protein, 8 aa, Influenza virus
SWMKIYWS

SEQ ID NO: 270575 - protein, 8 aa, Influenza virus
WMKIYWSL

SEQ ID NO: 270576 - protein, 8 aa, Influenza virus
ITFESNGG

SEQ ID NO: 270577 - protein, 8 aa, Influenza virus
SFESNGGL

SEQ ID NO: 270578 - protein, 8 aa, Influenza virus
FESNGGLL

SEQ ID NO: 270579 - protein, 8 aa, Influenza virus
ESNGGLLA

SEQ ID NO: 270580 - protein, 8 aa, Influenza virus
SNGGLLAP

SEQ ID NO: 270581 - protein, 8 aa, Influenza virus
NGGLLAPR

SEQ ID NO: 270582 - protein, 8 aa, Influenza virus
GGLLAPRY

SEQ ID NO: 270583 - protein, 8 aa, Influenza virus
GLLAPRYG

SEQ ID NO: 270584 - protein, 8 aa, Influenza virus
LLAPRYGY

SEQ ID NO: 270585 - protein, 8 aa, Influenza virus
LAPRYGYI

SEQ ID NO: 270586 - protein, 8 aa, Influenza virus
APRYGYII

SEQ ID NO: 270587 - protein, 8 aa, Influenza virus
PRYGYIIE

SEQ ID NO: 270588 - protein, 8 aa, Influenza virus
RYGYIIEE

SEQ ID NO: 270589 - protein, 8 aa, Influenza virus
YGYIIEEY

SEQ ID NO: 270590 - protein, 8 aa, Influenza virus
GYIIEEYG

SEQ ID NO: 270591 - protein, 8 aa, Influenza virus
YIIEEYGK

SEQ ID NO: 270592 - protein, 8 aa, Influenza virus
IIEEYGKG

SEQ ID NO: 270593 - protein, 8 aa, Influenza virus
IEEYGKGR

SEQ ID NO: 270594 - protein, 8 aa, Influenza virus
EEYGKGRI

SEQ ID NO: 270595 - protein, 8 aa, Influenza virus
EYGKGRIF

SEQ ID NO: 270596 - protein, 8 aa, Influenza virus
YGKGRIFQ

SEQ ID NO: 270597 - protein, 8 aa, Influenza virus
GKGRIFQS

SEQ ID NO: 270598 - protein, 8 aa, Influenza virus
KGRIFQSR

SEQ ID NO: 270599 - protein, 8 aa, Influenza virus
GRIFQSRI

SEQ ID NO: 270600 - protein, 8 aa, Influenza virus
RIFQSRIR

SEQ ID NO: 270601 - protein, 8 aa, Influenza virus
KCNTKCQT

SEQ ID NO: 270602 - protein, 8 aa, Influenza virus
CNTKCQTS

SEQ ID NO: 270603 - protein, 8 aa, Influenza virus
NTKCQTSV

SEQ ID NO: 270604 - protein, 8 aa, Influenza virus
TKCQTSVG

SEQ ID NO: 270605 - protein, 8 aa, Influenza virus
KCQTSVGG

SEQ ID NO: 270606 - protein, 8 aa, Influenza virus
CQTSVGGI

SEQ ID NO: 270607 - protein, 8 aa, Influenza virus
QTSVGGIN

SEQ ID NO: 270608 - protein, 8 aa, Influenza virus
TSVGGINT

SEQ ID NO: 270609 - protein, 8 aa, Influenza virus
SVGGINTN

SEQ ID NO: 270610 - protein, 8 aa, Influenza virus
VGGINTNK

SEQ ID NO: 270611 - protein, 8 aa, Influenza virus
GGINTNKT

SEQ ID NO: 270612 - protein, 8 aa, Influenza virus
GINTNKTF

SEQ ID NO: 270613 - protein, 8 aa, Influenza virus
INTNKTFQ

SEQ ID NO: 270614 - protein, 8 aa, Influenza virus
NTNKTFQN

SEQ ID NO: 270615 - protein, 8 aa, Influenza virus
TNKTFQNI

SEQ ID NO: 270616 - protein, 8 aa, Influenza virus
NKTFQNIE

SEQ ID NO: 270617 - protein, 8 aa, Influenza virus
KTFQNIER

SEQ ID NO: 270618 - protein, 8 aa, Influenza virus
TFQNIERN

SEQ ID NO: 270619 - protein, 8 aa, Influenza virus
FQNIERNA

SEQ ID NO: 270620 - protein, 8 aa, Influenza virus
QNIERNAL

SEQ ID NO: 270621 - protein, 8 aa, Influenza virus
NIERNALG

SEQ ID NO: 270622 - protein, 8 aa, Influenza virus
IERNALGD

SEQ ID NO: 270623 - protein, 8 aa, Influenza virus
ERNALGDC

SEQ ID NO: 270624 - protein, 8 aa, Influenza virus
RNALGDCP

SEQ ID NO: 270625 - protein, 8 aa, Influenza virus
NALGDCPK

SEQ ID NO: 270626 - protein, 8 aa, Influenza virus
ALGDCPKY

SEQ ID NO: 270627 - protein, 8 aa, Influenza virus
LGDCPKYI

SEQ ID NO: 270628 - protein, 8 aa, Influenza virus
GDCPKYIK

SEQ ID NO: 270629 - protein, 8 aa, Influenza virus
DCPKYIKS

SEQ ID NO: 270630 - protein, 8 aa, Influenza virus
CPKYIKSG

SEQ ID NO: 270631 - protein, 8 aa, Influenza virus
PKYIKSGQ

SEQ ID NO: 270632 - protein, 8 aa, Influenza virus
KYIKSGQL

SEQ ID NO: 270633 - protein, 8 aa, Influenza virus
YIKSGQLK

SEQ ID NO: 270634 - protein, 8 aa, Influenza virus
IKSGQLKL

SEQ ID NO: 270635 - protein, 8 aa, Influenza virus
KSGQLKLA

SEQ ID NO: 270636 - protein, 8 aa, Influenza virus
SGQLKLAT

SEQ ID NO: 270637 - protein, 8 aa, Influenza virus
GQLKLATG

SEQ ID NO: 270638 - protein, 8 aa, Influenza virus
QLKLATGL

SEQ ID NO: 270639 - protein, 8 aa, Influenza virus
LKLATGLR

SEQ ID NO: 270640 - protein, 8 aa, Influenza virus
KLATGLRN

SEQ ID NO: 270641 - protein, 8 aa, Influenza virus
LATGLRNV

SEQ ID NO: 270642 - protein, 8 aa, Influenza virus
ATGLRNVP

SEQ ID NO: 270643 - protein, 8 aa, Influenza virus
TGLRNVPA

SEQ ID NO: 270644 - protein, 8 aa, Influenza virus
RGLFGAIA

SEQ ID NO: 270645 - protein, 8 aa, Influenza virus
GLFGAIAG

SEQ ID NO: 270646 - protein, 8 aa, Influenza virus
LFGAIAGF

SEQ ID NO: 270647 - protein, 8 aa, Influenza virus
FGAIAGFI

SEQ ID NO: 270648 - protein, 8 aa, Influenza virus
GAIAGFIE

SEQ ID NO: 270649 - protein, 8 aa, Influenza virus
AIAGFIEG

SEQ ID NO: 270650 - protein, 8 aa, Influenza virus
IAGFIEGG

SEQ ID NO: 270651 - protein, 8 aa, Influenza virus
AGFIEGGW

SEQ ID NO: 270652 - protein, 8 aa, Influenza virus
GFIEGGWP

SEQ ID NO: 270653 - protein, 8 aa, Influenza virus
FIEGGWPG

SEQ ID NO: 270654 - protein, 8 aa, Influenza virus
IEGGWPGL

SEQ ID NO: 270655 - protein, 8 aa, Influenza virus
EGGWPGLI

SEQ ID NO: 270656 - protein, 8 aa, Influenza virus
GGWPGLIN

SEQ ID NO: 270657 - protein, 8 aa, Influenza virus
GWPGLING

SEQ ID NO: 270658 - protein, 8 aa, Influenza virus
WPGLINGW

SEQ ID NO: 270659 - protein, 8 aa, Influenza virus
PGLINGWY

SEQ ID NO: 270660 - protein, 8 aa, Influenza virus
GLINGWYG

SEQ ID NO: 270661 - protein, 8 aa, Influenza virus
LINGWYGF

SEQ ID NO: 270662 - protein, 8 aa, Influenza virus
INGWYGFQ

SEQ ID NO: 270663 - protein, 8 aa, Influenza virus
NGWYGFQH

SEQ ID NO: 270664 - protein, 8 aa, Influenza virus
GWYGFQHQ

SEQ ID NO: 270665 - protein, 8 aa, Influenza virus
WYGFQHQN

SEQ ID NO: 270666 - protein, 8 aa, Influenza virus
YGFQHQNE

SEQ ID NO: 270667 - protein, 8 aa, Influenza virus
GFQHQNEQ

SEQ ID NO: 270668 - protein, 8 aa, Influenza virus
FQHQNEQG

SEQ ID NO: 270669 - protein, 8 aa, Influenza virus
QHQNEQGV

SEQ ID NO: 270670 - protein, 8 aa, Influenza virus
HQNEQGVG

SEQ ID NO: 270671 - protein, 8 aa, Influenza virus
QNEQGTGI

SEQ ID NO: 270672 - protein, 8 aa, Influenza virus
NEQGTGIA

SEQ ID NO: 270673 - protein, 8 aa, Influenza virus
EQGTGIAA

SEQ ID NO: 270674 - protein, 8 aa, Influenza virus
QGTGIAAD

SEQ ID NO: 270675 - protein, 8 aa, Influenza virus
GTGIAADK

SEQ ID NO: 270676 - protein, 8 aa, Influenza virus
TGIAADKE

SEQ ID NO: 270677 - protein, 8 aa, Influenza virus
GIAADKES

SEQ ID NO: 270678 - protein, 8 aa, Influenza virus
IAADKEST

SEQ ID NO: 270679 - protein, 8 aa, Influenza virus
AADKESTQ

SEQ ID NO: 270680 - protein, 8 aa, Influenza virus
ADKESTQK

SEQ ID NO: 270681 - protein, 8 aa, Influenza virus
DKESTQKA

SEQ ID NO: 270682 - protein, 8 aa, Influenza virus
KESTQKAI

SEQ ID NO: 270683 - protein, 8 aa, Influenza virus
ESTQKAID

SEQ ID NO: 270684 - protein, 8 aa, Influenza virus
STQKAIDQ

SEQ ID NO: 270685 - protein, 8 aa, Influenza virus
TQKAIDQI

SEQ ID NO: 270686 - protein, 8 aa, Influenza virus
QKAIDQIT

SEQ ID NO: 270687 - protein, 8 aa, Influenza virus
KAIDQITT

SEQ ID NO: 270688 - protein, 8 aa, Influenza virus
AIDQITTK

SEQ ID NO: 270689 - protein, 8 aa, Influenza virus
IDQITTKI

SEQ ID NO: 270690 - protein, 8 aa, Influenza virus
DQITTKIN

SEQ ID NO: 270691 - protein, 8 aa, Influenza virus
QITTKINN

SEQ ID NO: 270692 - protein, 8 aa, Influenza virus
ITTKINNI

SEQ ID NO: 270693 - protein, 8 aa, Influenza virus
TTKINNII

SEQ ID NO: 270694 - protein, 8 aa, Influenza virus
TKINNIID

SEQ ID NO: 270695 - protein, 8 aa, Influenza virus
KINNIIDK

SEQ ID NO: 270696 - protein, 8 aa, Influenza virus
INNIIDKM

SEQ ID NO: 270697 - protein, 8 aa, Influenza virus
NNIIDKMN

SEQ ID NO: 270698 - protein, 8 aa, Influenza virus
NIIDKMNG

SEQ ID NO: 270699 - protein, 8 aa, Influenza virus
IIDKMNGN

SEQ ID NO: 270700 - protein, 8 aa, Influenza virus
IDKMNGNY

SEQ ID NO: 270701 - protein, 8 aa, Influenza virus
DKMNGNYD

SEQ ID NO: 270702 - protein, 8 aa, Influenza virus
KMNGNYDS

SEQ ID NO: 270703 - protein, 8 aa, Influenza virus
MNGNYDSI

SEQ ID NO: 270704 - protein, 8 aa, Influenza virus
NGNYDSIR

SEQ ID NO: 270705 - protein, 8 aa, Influenza virus
GNYDSIRG

SEQ ID NO: 270706 - protein, 8 aa, Influenza virus
NYDSIRGE

SEQ ID NO: 270707 - protein, 8 aa, Influenza virus
YDSIRGEF

SEQ ID NO: 270708 - protein, 8 aa, Influenza virus
DSIRGEFN

SEQ ID NO: 270709 - protein, 8 aa, Influenza virus
SIRGEFNQ

SEQ ID NO: 270710 - protein, 8 aa, Influenza virus
IRGEFNQV

SEQ ID NO: 270711 - protein, 8 aa, Influenza virus
RGEFNQVE

SEQ ID NO: 270712 - protein, 8 aa, Influenza virus
GEFNQVEK

SEQ ID NO: 270713 - protein, 8 aa, Influenza virus
EFNQVEKR

SEQ ID NO: 270714 - protein, 8 aa, Influenza virus
FNQVEKRI

SEQ ID NO: 270715 - protein, 8 aa, Influenza virus
NQVEKRIN

SEQ ID NO: 270716 - protein, 8 aa, Influenza virus
QVEQRINM

SEQ ID NO: 270717 - protein, 8 aa, Influenza virus
VEQRINML

SEQ ID NO: 270718 - protein, 8 aa, Influenza virus
EQRINMLA

SEQ ID NO: 270719 - protein, 8 aa, Influenza virus
QRINMLAD

SEQ ID NO: 270720 - protein, 8 aa, Influenza virus
RINMLADR

SEQ ID NO: 270721 - protein, 8 aa, Influenza virus
INMLADRI

SEQ ID NO: 270722 - protein, 8 aa, Influenza virus
NMLADRID

SEQ ID NO: 270723 - protein, 8 aa, Influenza virus
MLADRIDD

SEQ ID NO: 270724 - protein, 8 aa, Influenza virus
LADRIDDA

SEQ ID NO: 270725 - protein, 8 aa, Influenza virus
ADRIDDAV

SEQ ID NO: 270726 - protein, 8 aa, Influenza virus
DRIDDAVT

SEQ ID NO: 270727 - protein, 8 aa, Influenza virus
RIDDAVTD

SEQ ID NO: 270728 - protein, 8 aa, Influenza virus
IDDAVTDV

SEQ ID NO: 270729 - protein, 8 aa, Influenza virus
DDAVTDVW

SEQ ID NO: 270730 - protein, 8 aa, Influenza virus
DAVTDVWS

SEQ ID NO: 270731 - protein, 8 aa, Influenza virus
AVTDVWSY

SEQ ID NO: 270732 - protein, 8 aa, Influenza virus
VTDVWSYN

SEQ ID NO: 270733 - protein, 8 aa, Influenza virus
TDVWSYNA

SEQ ID NO: 270734 - protein, 8 aa, Influenza virus
DVWSYNAK

SEQ ID NO: 270735 - protein, 8 aa, Influenza virus
VWSYNAKL

SEQ ID NO: 270736 - protein, 8 aa, Influenza virus
WSYNAKLL

SEQ ID NO: 270737 - protein, 8 aa, Influenza virus
SYNAKLLV

SEQ ID NO: 270738 - protein, 8 aa, Influenza virus
YNAKLLVL

SEQ ID NO: 270739 - protein, 8 aa, Influenza virus
NAKLLVLL

SEQ ID NO: 270740 - protein, 8 aa, Influenza virus
AKLLVLLE

SEQ ID NO: 270741 - protein, 8 aa, Influenza virus
KLLVLLEN

SEQ ID NO: 270742 - protein, 8 aa, Influenza virus
LLVLLEND

SEQ ID NO: 270743 - protein, 8 aa, Influenza virus
LVLLENDK

SEQ ID NO: 270744 - protein, 8 aa, Influenza virus
VLLENDKT

SEQ ID NO: 270745 - protein, 8 aa, Influenza virus
LLENDKTL

SEQ ID NO: 270746 - protein, 8 aa, Influenza virus
LENDKTLD

SEQ ID NO: 270747 - protein, 8 aa, Influenza virus
ENDKTLDM

SEQ ID NO: 270748 - protein, 8 aa, Influenza virus
NDKTLDMH

SEQ ID NO: 270749 - protein, 8 aa, Influenza virus
DKTLDMHD

SEQ ID NO: 270750 - protein, 8 aa, Influenza virus
KTLDMHDA

SEQ ID NO: 270751 - protein, 8 aa, Influenza virus
TLDMHDAN

SEQ ID NO: 270752 - protein, 8 aa, Influenza virus
LDMHDANV

SEQ ID NO: 270753 - protein, 8 aa, Influenza virus
DMHDANVR

SEQ ID NO: 270754 - protein, 8 aa, Influenza virus
MHDANVRN

SEQ ID NO: 270755 - protein, 8 aa, Influenza virus
HDANVRNL

SEQ ID NO: 270756 - protein, 8 aa, Influenza virus
DANVRNLH

SEQ ID NO: 270757 - protein, 8 aa, Influenza virus
ANVRNLHD

SEQ ID NO: 270758 - protein, 8 aa, Influenza virus
NVRNLHDQ

SEQ ID NO: 270759 - protein, 8 aa, Influenza virus
VRNLHDQV

SEQ ID NO: 270760 - protein, 8 aa, Influenza virus
RNLHDQVR

SEQ ID NO: 270761 - protein, 8 aa, Influenza virus
NLHEQVRR

SEQ ID NO: 270762 - protein, 8 aa, Influenza virus
NAIDEGNG

SEQ ID NO: 270763 - protein, 8 aa, Influenza virus
AIDEGNGC

SEQ ID NO: 270764 - protein, 8 aa, Influenza virus
IDEGNGCF

SEQ ID NO: 270765 - protein, 8 aa, Influenza virus
DEGNGCFE

SEQ ID NO: 270766 - protein, 8 aa, Influenza virus
EGNGCFEL

SEQ ID NO: 270767 - protein, 8 aa, Influenza virus
GNGCFELL

SEQ ID NO: 270768 - protein, 8 aa, Influenza virus
NGCFELLH

SEQ ID NO: 270769 - protein, 8 aa, Influenza virus
GCFELLHK

SEQ ID NO: 270770 - protein, 8 aa, Influenza virus
CFELLHKC

SEQ ID NO: 270771 - protein, 8 aa, Influenza virus
FELLHKCN

SEQ ID NO: 270772 - protein, 8 aa, Influenza virus
ELLHKCND

SEQ ID NO: 270773 - protein, 8 aa, Influenza virus
LLHKCNDS

SEQ ID NO: 270774 - protein, 8 aa, Influenza virus
LHKCNDSC

SEQ ID NO: 270775 - protein, 8 aa, Influenza virus
HKCNDSCM

SEQ ID NO: 270776 - protein, 8 aa, Influenza virus
KCNDSCME

SEQ ID NO: 270777 - protein, 8 aa, Influenza virus
CNDSCMET

SEQ ID NO: 270778 - protein, 8 aa, Influenza virus
NDSCMETI

SEQ ID NO: 270779 - protein, 8 aa, Influenza virus
DSCMETIR

SEQ ID NO: 270780 - protein, 8 aa, Influenza virus
SCMETIRN

SEQ ID NO: 270781 - protein, 8 aa, Influenza virus
CMETIRNG

SEQ ID NO: 270782 - protein, 8 aa, Influenza virus
METIRNGT

SEQ ID NO: 270783 - protein, 8 aa, Influenza virus
ETIRNGTY

SEQ ID NO: 270784 - protein, 8 aa, Influenza virus
TIRNGTYN

SEQ ID NO: 270785 - protein, 8 aa, Influenza virus
IRNGTYNH

SEQ ID NO: 270786 - protein, 8 aa, Influenza virus
RNGTYNHT

SEQ ID NO: 270787 - protein, 8 aa, Influenza virus
EYAEESKL

SEQ ID NO: 270788 - protein, 8 aa, Influenza virus
YAEESKLK

SEQ ID NO: 270789 - protein, 8 aa, Influenza virus
AEESKLKR

SEQ ID NO: 270790 - protein, 8 aa, Influenza virus
EESKLKRQ

SEQ ID NO: 270791 - protein, 8 aa, Influenza virus
ESKLKRQE

SEQ ID NO: 270792 - protein, 8 aa, Influenza virus
SKLKRQEI

SEQ ID NO: 270793 - protein, 8 aa, Influenza virus
KLKRQEIE

SEQ ID NO: 270794 - protein, 8 aa, Influenza virus
LKRQEIEG

SEQ ID NO: 270795 - protein, 8 aa, Influenza virus
KRQEIEGI

SEQ ID NO: 270796 - protein, 8 aa, Influenza virus
RQEIEGIK

SEQ ID NO: 270797 - protein, 8 aa, Influenza virus
QEIEGIKL

SEQ ID NO: 270798 - protein, 8 aa, Influenza virus
EIEGIKLK

SEQ ID NO: 270799 - protein, 8 aa, Influenza virus
IEGIKLKS

SEQ ID NO: 270800 - protein, 8 aa, Influenza virus
GIKLKSED

SEQ ID NO: 270801 - protein, 8 aa, Influenza virus
LKSEDNVY

SEQ ID NO: 270802 - protein, 8 aa, Influenza virus
SEDNVYKA

SEQ ID NO: 270803 - protein, 8 aa, Influenza virus
EDNVYKAL

SEQ ID NO: 270804 - protein, 8 aa, Influenza virus
DNVYKALS

SEQ ID NO: 270805 - protein, 8 aa, Influenza virus
NVYKALSI

SEQ ID NO: 270806 - protein, 8 aa, Influenza virus
VYKALSIY

SEQ ID NO: 270807 - protein, 8 aa, Influenza virus
YKALSIYS

SEQ ID NO: 270808 - protein, 8 aa, Influenza virus
KALSIYSC

SEQ ID NO: 270809 - protein, 8 aa, Influenza virus
ALSIYSCI

SEQ ID NO: 270810 - protein, 8 aa, Influenza virus
LSIYSCIA

SEQ ID NO: 270811 - protein, 8 aa, Influenza virus
SIYSCIAS

SEQ ID NO: 270812 - protein, 8 aa, Influenza virus
IYSCIASS

SEQ ID NO: 270813 - protein, 8 aa, Influenza virus
YSCIASSV

SEQ ID NO: 270814 - protein, 8 aa, Influenza virus
SCIASSVV

SEQ ID NO: 270815 - protein, 8 aa, Influenza virus
CIASSVVL

SEQ ID NO: 270816 - protein, 8 aa, Influenza virus
IASSVVLV

SEQ ID NO: 270817 - protein, 8 aa, Influenza virus
ASSVVLVG

SEQ ID NO: 270818 - protein, 8 aa, Influenza virus
SSVVLVGL

SEQ ID NO: 270819 - protein, 8 aa, Influenza virus
SVVLVGLI

SEQ ID NO: 270820 - protein, 8 aa, Influenza virus
VVLVGLIL

SEQ ID NO: 270821 - protein, 8 aa, Influenza virus
VLVGLILA

SEQ ID NO: 270822 - protein, 8 aa, Influenza virus
LVGLILAF

SEQ ID NO: 270823 - protein, 8 aa, Influenza virus
VGLILAFI

SEQ ID NO: 270824 - protein, 8 aa, Influenza virus
GLILAFIM

SEQ ID NO: 270825 - protein, 8 aa, Influenza virus
LILAFIMW

SEQ ID NO: 270826 - protein, 8 aa, Influenza virus
ILAFIMWA

SEQ ID NO: 270827 - protein, 8 aa, Influenza virus
LAFIMWAC

SEQ ID NO: 270828 - protein, 8 aa, Influenza virus
FIMWACSS

SEQ ID NO: 270829 - protein, 8 aa, Influenza virus
IMWACSSG

SEQ ID NO: 270830 - protein, 8 aa, Influenza virus
MWACSSGN

SEQ ID NO: 270831 - protein, 8 aa, Influenza virus
WACSSGNC

SEQ ID NO: 270832 - protein, 8 aa, Influenza virus
ACSSGNCR

SEQ ID NO: 270833 - protein, 8 aa, Influenza virus
CSSGNCRF

SEQ ID NO: 270834 - protein, 8 aa, Influenza virus
SSGNCRFN

SEQ ID NO: 270835 - protein, 8 aa, Influenza virus
MIALILVA

SEQ ID NO: 270836 - protein, 8 aa, Influenza virus
IALILVAL

SEQ ID NO: 270837 - protein, 8 aa, Influenza virus
ALILVALA

SEQ ID NO: 270838 - protein, 8 aa, Influenza virus
LILVALAL

SEQ ID NO: 270839 - protein, 8 aa, Influenza virus
ILVALALS

SEQ ID NO: 270840 - protein, 8 aa, Influenza virus
LVALALSH

SEQ ID NO: 270841 - protein, 8 aa, Influenza virus
VALALSHT

SEQ ID NO: 270842 - protein, 8 aa, Influenza virus
ALALSHTA

SEQ ID NO: 270843 - protein, 8 aa, Influenza virus
LALSHTAY

SEQ ID NO: 270844 - protein, 8 aa, Influenza virus
ALSHTAYS

SEQ ID NO: 270845 - protein, 8 aa, Influenza virus
LSHTAYSQ

SEQ ID NO: 270846 - protein, 8 aa, Influenza virus
SHTAYSQI

SEQ ID NO: 270847 - protein, 8 aa, Influenza virus
HTAYSQIT

SEQ ID NO: 270848 - protein, 8 aa, Influenza virus
TAYSQITN

SEQ ID NO: 270849 - protein, 8 aa, Influenza virus
AYSQITNG

SEQ ID NO: 270850 - protein, 8 aa, Influenza virus
YSQITNGT

SEQ ID NO: 270851 - protein, 8 aa, Influenza virus
SQITNGTT

SEQ ID NO: 270852 - protein, 8 aa, Influenza virus
QITNGTTG

SEQ ID NO: 270853 - protein, 8 aa, Influenza virus
ITNGTTGN

SEQ ID NO: 270854 - protein, 8 aa, Influenza virus
TNGTTGNP

SEQ ID NO: 270855 - protein, 8 aa, Influenza virus
NGTTGNPI

SEQ ID NO: 270856 - protein, 8 aa, Influenza virus
GTTGNPII

SEQ ID NO: 270857 - protein, 8 aa, Influenza virus
TTGNPIIC

SEQ ID NO: 270858 - protein, 8 aa, Influenza virus
TGNPIICL

SEQ ID NO: 270859 - protein, 8 aa, Influenza virus
GNPIICLG

SEQ ID NO: 270860 - protein, 8 aa, Influenza virus
NPIICLGH

SEQ ID NO: 270861 - protein, 8 aa, Influenza virus
PIICLGHH

SEQ ID NO: 270862 - protein, 8 aa, Influenza virus
IICLGHHA

SEQ ID NO: 270863 - protein, 8 aa, Influenza virus
ICLGHHAV

SEQ ID NO: 270864 - protein, 8 aa, Influenza virus
CLGHHAVE

SEQ ID NO: 270865 - protein, 8 aa, Influenza virus
LGHHAVEN

SEQ ID NO: 270866 - protein, 8 aa, Influenza virus
GHHAVENG

SEQ ID NO: 270867 - protein, 8 aa, Influenza virus
HHAVENGT

SEQ ID NO: 270868 - protein, 8 aa, Influenza virus
HAVENGTS

SEQ ID NO: 270869 - protein, 8 aa, Influenza virus
AVENGTSV

SEQ ID NO: 270870 - protein, 8 aa, Influenza virus
VENGTSVK

SEQ ID NO: 270871 - protein, 8 aa, Influenza virus
ENGTSVKT

SEQ ID NO: 270872 - protein, 8 aa, Influenza virus
NGTSVKTL

SEQ ID NO: 270873 - protein, 8 aa, Influenza virus
GTSVKTLT

SEQ ID NO: 270874 - protein, 8 aa, Influenza virus
TSVKTLTD

SEQ ID NO: 270875 - protein, 8 aa, Influenza virus
SVKTLTDN

SEQ ID NO: 270876 - protein, 8 aa, Influenza virus
VKTLTDNH

SEQ ID NO: 270877 - protein, 8 aa, Influenza virus
KTLTDNHV

SEQ ID NO: 270878 - protein, 8 aa, Influenza virus
TLTDNHVE

SEQ ID NO: 270879 - protein, 8 aa, Influenza virus
LTDNHVEV

SEQ ID NO: 270880 - protein, 8 aa, Influenza virus
TDNHVEVV

SEQ ID NO: 270881 - protein, 8 aa, Influenza virus
DNHVEVVS

SEQ ID NO: 270882 - protein, 8 aa, Influenza virus
NHVEVVSA

SEQ ID NO: 270883 - protein, 8 aa, Influenza virus
HVEVVSAK

SEQ ID NO: 270884 - protein, 8 aa, Influenza virus
VEVVSAKE

SEQ ID NO: 270885 - protein, 8 aa, Influenza virus
EVVSAKEL

SEQ ID NO: 270886 - protein, 8 aa, Influenza virus
VVSAKELV

SEQ ID NO: 270887 - protein, 8 aa, Influenza virus
VSAKELVE

SEQ ID NO: 270888 - protein, 8 aa, Influenza virus
SAKELVET

SEQ ID NO: 270889 - protein, 8 aa, Influenza virus
AKELVETN

SEQ ID NO: 270890 - protein, 8 aa, Influenza virus
KELVETNH

SEQ ID NO: 270891 - protein, 8 aa, Influenza virus
ELVETNHT

SEQ ID NO: 270892 - protein, 8 aa, Influenza virus
LVETNHTD

SEQ ID NO: 270893 - protein, 8 aa, Influenza virus
VETNHTDE

SEQ ID NO: 270894 - protein, 8 aa, Influenza virus
ETNHTDEL

SEQ ID NO: 270895 - protein, 8 aa, Influenza virus
TNHTDELC

SEQ ID NO: 270896 - protein, 8 aa, Influenza virus
NHTDELCP

SEQ ID NO: 270897 - protein, 8 aa, Influenza virus
HTDELCPS

SEQ ID NO: 270898 - protein, 8 aa, Influenza virus
TDELCPSP

SEQ ID NO: 270899 - protein, 8 aa, Influenza virus
DELCPSPL

SEQ ID NO: 270900 - protein, 8 aa, Influenza virus
ELCPSPLK

SEQ ID NO: 270901 - protein, 8 aa, Influenza virus
LCPSPLKL

SEQ ID NO: 270902 - protein, 8 aa, Influenza virus
CPSPLKLV

SEQ ID NO: 270903 - protein, 8 aa, Influenza virus
PSPLKLVD

SEQ ID NO: 270904 - protein, 8 aa, Influenza virus
SPLKLVDG

SEQ ID NO: 270905 - protein, 8 aa, Influenza virus
PLKLVDGQ

SEQ ID NO: 270906 - protein, 8 aa, Influenza virus
LKLVDGQD

SEQ ID NO: 270907 - protein, 8 aa, Influenza virus
KLVDGQDC

SEQ ID NO: 270908 - protein, 8 aa, Influenza virus
LVDGQDCD

SEQ ID NO: 270909 - protein, 8 aa, Influenza virus
VDGQDCDL

SEQ ID NO: 270910 - protein, 8 aa, Influenza virus
DGQDCDLI

SEQ ID NO: 270911 - protein, 8 aa, Influenza virus
GQDCDLIN

SEQ ID NO: 270912 - protein, 8 aa, Influenza virus
QDCDLING

SEQ ID NO: 270913 - protein, 8 aa, Influenza virus
DCDLINGA

SEQ ID NO: 270914 - protein, 8 aa, Influenza virus
CDLINGAL

SEQ ID NO: 270915 - protein, 8 aa, Influenza virus
DLINGALG

SEQ ID NO: 270916 - protein, 8 aa, Influenza virus
LINGALGS

SEQ ID NO: 270917 - protein, 8 aa, Influenza virus
INGALGSP

SEQ ID NO: 270918 - protein, 8 aa, Influenza virus
NGALGSPG

SEQ ID NO: 270919 - protein, 8 aa, Influenza virus
GALGSPGC

SEQ ID NO: 270920 - protein, 8 aa, Influenza virus
ALGSPGCD

SEQ ID NO: 270921 - protein, 8 aa, Influenza virus
LGSPGCDR

SEQ ID NO: 270922 - protein, 8 aa, Influenza virus
GSPGCDRL

SEQ ID NO: 270923 - protein, 8 aa, Influenza virus
SPGCDRLQ

SEQ ID NO: 270924 - protein, 8 aa, Influenza virus
PGCDRLQD

SEQ ID NO: 270925 - protein, 8 aa, Influenza virus
GCDRLQDT

SEQ ID NO: 270926 - protein, 8 aa, Influenza virus
CDRLQDTT

SEQ ID NO: 270927 - protein, 8 aa, Influenza virus
DRLQDTTW

SEQ ID NO: 270928 - protein, 8 aa, Influenza virus
RLQDTTWD

SEQ ID NO: 270929 - protein, 8 aa, Influenza virus
LQDTTWDV

SEQ ID NO: 270930 - protein, 8 aa, Influenza virus
QDTTWDVF

SEQ ID NO: 270931 - protein, 8 aa, Influenza virus
DTTWDVFI

SEQ ID NO: 270932 - protein, 8 aa, Influenza virus
TTWDVFIE

SEQ ID NO: 270933 - protein, 8 aa, Influenza virus
TWDVFIER

SEQ ID NO: 270934 - protein, 8 aa, Influenza virus
WDVFIERP

SEQ ID NO: 270935 - protein, 8 aa, Influenza virus
DVFIERPT

SEQ ID NO: 270936 - protein, 8 aa, Influenza virus
VFIERPTA

SEQ ID NO: 270937 - protein, 8 aa, Influenza virus
FIERPTAV

SEQ ID NO: 270938 - protein, 8 aa, Influenza virus
IERPTAVD

SEQ ID NO: 270939 - protein, 8 aa, Influenza virus
ERPTAVDT

SEQ ID NO: 270940 - protein, 8 aa, Influenza virus
RPTAVDTC

SEQ ID NO: 270941 - protein, 8 aa, Influenza virus
PTAVDTCY

SEQ ID NO: 270942 - protein, 8 aa, Influenza virus
TAVDTCYP

SEQ ID NO: 270943 - protein, 8 aa, Influenza virus
AVDTCYPF

SEQ ID NO: 270944 - protein, 8 aa, Influenza virus
VDTCYPFD

SEQ ID NO: 270945 - protein, 8 aa, Influenza virus
DTCYPFDV

SEQ ID NO: 270946 - protein, 8 aa, Influenza virus
TCYPFDVP

SEQ ID NO: 270947 - protein, 8 aa, Influenza virus
CYPFDVPD

SEQ ID NO: 270948 - protein, 8 aa, Influenza virus
YPFDVPDY

SEQ ID NO: 270949 - protein, 8 aa, Influenza virus
PFDVPDYQ

SEQ ID NO: 270950 - protein, 8 aa, Influenza virus
FDVPDYQS

SEQ ID NO: 270951 - protein, 8 aa, Influenza virus
DVPDYQSL

SEQ ID NO: 270952 - protein, 8 aa, Influenza virus
VPDYQSLR

SEQ ID NO: 270953 - protein, 8 aa, Influenza virus
PDYQSLRS

SEQ ID NO: 270954 - protein, 8 aa, Influenza virus
DYQSLRSI

SEQ ID NO: 270955 - protein, 8 aa, Influenza virus
YQSLRSIL

SEQ ID NO: 270956 - protein, 8 aa, Influenza virus
QSLRSILA

SEQ ID NO: 270957 - protein, 8 aa, Influenza virus
SLRSILAS

SEQ ID NO: 270958 - protein, 8 aa, Influenza virus
LRSILASS

SEQ ID NO: 270959 - protein, 8 aa, Influenza virus
RSILASSG

SEQ ID NO: 270960 - protein, 8 aa, Influenza virus
SILASSGS

SEQ ID NO: 270961 - protein, 8 aa, Influenza virus
ILASSGSL

SEQ ID NO: 270962 - protein, 8 aa, Influenza virus
LASSGSLE

SEQ ID NO: 270963 - protein, 8 aa, Influenza virus
ASSGSLEF

SEQ ID NO: 270964 - protein, 8 aa, Influenza virus
SSGSLEFI

SEQ ID NO: 270965 - protein, 8 aa, Influenza virus
SGSLEFIA

SEQ ID NO: 270966 - protein, 8 aa, Influenza virus
GSLEFIAE

SEQ ID NO: 270967 - protein, 8 aa, Influenza virus
SLEFIAEQ

SEQ ID NO: 270968 - protein, 8 aa, Influenza virus
LEFIAEQF

SEQ ID NO: 270969 - protein, 8 aa, Influenza virus
EFIAEQFT

SEQ ID NO: 270970 - protein, 8 aa, Influenza virus
FIAEQFTW

SEQ ID NO: 270971 - protein, 8 aa, Influenza virus
IAEQFTWN

SEQ ID NO: 270972 - protein, 8 aa, Influenza virus
AEQFTWNG

SEQ ID NO: 270973 - protein, 8 aa, Influenza virus
EQFTWNGV

SEQ ID NO: 270974 - protein, 8 aa, Influenza virus
QFTWNGVK

SEQ ID NO: 270975 - protein, 8 aa, Influenza virus
FTWNGVKV

SEQ ID NO: 270976 - protein, 8 aa, Influenza virus
TWNGVKVD

SEQ ID NO: 270977 - protein, 8 aa, Influenza virus
WNGVKVDG

SEQ ID NO: 270978 - protein, 8 aa, Influenza virus
NGVKVDGS

SEQ ID NO: 270979 - protein, 8 aa, Influenza virus
GVKVDGSS

SEQ ID NO: 270980 - protein, 8 aa, Influenza virus
VKVDGSSS

SEQ ID NO: 270981 - protein, 8 aa, Influenza virus
KVDGSSSA

SEQ ID NO: 270982 - protein, 8 aa, Influenza virus
VDGSSSAC

SEQ ID NO: 270983 - protein, 8 aa, Influenza virus
DGSSSACL

SEQ ID NO: 270984 - protein, 8 aa, Influenza virus
GSSSACLR

SEQ ID NO: 270985 - protein, 8 aa, Influenza virus
SSSACLRG

SEQ ID NO: 270986 - protein, 8 aa, Influenza virus
SSACLRGG

SEQ ID NO: 270987 - protein, 8 aa, Influenza virus
SACLRGGR

SEQ ID NO: 270988 - protein, 8 aa, Influenza virus
ACLRGGRN

SEQ ID NO: 270989 - protein, 8 aa, Influenza virus
CLRGGRNS

SEQ ID NO: 270990 - protein, 8 aa, Influenza virus
LRGGRNSF

SEQ ID NO: 270991 - protein, 8 aa, Influenza virus
RGGRNSFF

SEQ ID NO: 270992 - protein, 8 aa, Influenza virus
GGRNSFFS

SEQ ID NO: 270993 - protein, 8 aa, Influenza virus
GRNSFFSR

SEQ ID NO: 270994 - protein, 8 aa, Influenza virus
RNSFFSRL

SEQ ID NO: 270995 - protein, 8 aa, Influenza virus
NSFFSRLN

SEQ ID NO: 270996 - protein, 8 aa, Influenza virus
SFFSRLNW

SEQ ID NO: 270997 - protein, 8 aa, Influenza virus
FFSRLNWL

SEQ ID NO: 270998 - protein, 8 aa, Influenza virus
FSRLNWLT

SEQ ID NO: 270999 - protein, 8 aa, Influenza virus
SRLNWLTK

SEQ ID NO: 271000 - protein, 8 aa, Influenza virus
RLNWLTKA

SEQ ID NO: 271001 - protein, 8 aa, Influenza virus
LNWLTKAT

SEQ ID NO: 271002 - protein, 8 aa, Influenza virus
NWLTKATN

SEQ ID NO: 271003 - protein, 8 aa, Influenza virus
WLTKATNG

SEQ ID NO: 271004 - protein, 8 aa, Influenza virus
LTKATNGN

SEQ ID NO: 271005 - protein, 8 aa, Influenza virus
TKATNGNY

SEQ ID NO: 271006 - protein, 8 aa, Influenza virus
KATNGNYG

SEQ ID NO: 271007 - protein, 8 aa, Influenza virus
ATNGNYGP

SEQ ID NO: 271008 - protein, 8 aa, Influenza virus
TNGNYGPI

SEQ ID NO: 271009 - protein, 8 aa, Influenza virus
NGNYGPIN

SEQ ID NO: 271010 - protein, 8 aa, Influenza virus
GNYGPINV

SEQ ID NO: 271011 - protein, 8 aa, Influenza virus
NYGPINVT

SEQ ID NO: 271012 - protein, 8 aa, Influenza virus
YGPINVTK

SEQ ID NO: 271013 - protein, 8 aa, Influenza virus
GPINVTKE

SEQ ID NO: 271014 - protein, 8 aa, Influenza virus
PINVTKEN

SEQ ID NO: 271015 - protein, 8 aa, Influenza virus
INVTKENT

SEQ ID NO: 271016 - protein, 8 aa, Influenza virus
NVTKENTG

SEQ ID NO: 271017 - protein, 8 aa, Influenza virus
VTKENTGS

SEQ ID NO: 271018 - protein, 8 aa, Influenza virus
TKENTGSY

SEQ ID NO: 271019 - protein, 8 aa, Influenza virus
KENTGSYV

SEQ ID NO: 271020 - protein, 8 aa, Influenza virus
ENTGSYVR

SEQ ID NO: 271021 - protein, 8 aa, Influenza virus
NTGSYVRL

SEQ ID NO: 271022 - protein, 8 aa, Influenza virus
TGSYVRLY

SEQ ID NO: 271023 - protein, 8 aa, Influenza virus
GSYVRLYL

SEQ ID NO: 271024 - protein, 8 aa, Influenza virus
SYVRLYLW

SEQ ID NO: 271025 - protein, 8 aa, Influenza virus
YVRLYLWG

SEQ ID NO: 271026 - protein, 8 aa, Influenza virus
VRLYLWGV

SEQ ID NO: 271027 - protein, 8 aa, Influenza virus
RLYLWGVH

SEQ ID NO: 271028 - protein, 8 aa, Influenza virus
LYLWGVHH

SEQ ID NO: 271029 - protein, 8 aa, Influenza virus
YLWGVHHP

SEQ ID NO: 271030 - protein, 8 aa, Influenza virus
LWGVHHPS

SEQ ID NO: 271031 - protein, 8 aa, Influenza virus
WGVHHPSS

SEQ ID NO: 271032 - protein, 8 aa, Influenza virus
GVHHPSSD

SEQ ID NO: 271033 - protein, 8 aa, Influenza virus
VHHPSSDN

SEQ ID NO: 271034 - protein, 8 aa, Influenza virus
HHPSSDNE

SEQ ID NO: 271035 - protein, 8 aa, Influenza virus
HPSSDNEQ

SEQ ID NO: 271036 - protein, 8 aa, Influenza virus
PSSDNEQT

SEQ ID NO: 271037 - protein, 8 aa, Influenza virus
SSDNEQTD

SEQ ID NO: 271038 - protein, 8 aa, Influenza virus
SDNEQTDL

SEQ ID NO: 271039 - protein, 8 aa, Influenza virus
DNEQTDLY

SEQ ID NO: 271040 - protein, 8 aa, Influenza virus
NEQTDLYK

SEQ ID NO: 271041 - protein, 8 aa, Influenza virus
EQTDLYKV

SEQ ID NO: 271042 - protein, 8 aa, Influenza virus
QTDLYKVA

SEQ ID NO: 271043 - protein, 8 aa, Influenza virus
TDLYKVAT

SEQ ID NO: 271044 - protein, 8 aa, Influenza virus
DLYKVATG

SEQ ID NO: 271045 - protein, 8 aa, Influenza virus
LYKVATGR

SEQ ID NO: 271046 - protein, 8 aa, Influenza virus
YKVATGRV

SEQ ID NO: 271047 - protein, 8 aa, Influenza virus
KVATGRVT

SEQ ID NO: 271048 - protein, 8 aa, Influenza virus
VATGRVTV

SEQ ID NO: 271049 - protein, 8 aa, Influenza virus
ATGRVTVS

SEQ ID NO: 271050 - protein, 8 aa, Influenza virus
TGRVTVST

SEQ ID NO: 271051 - protein, 8 aa, Influenza virus
GRVTVSTR

SEQ ID NO: 271052 - protein, 8 aa, Influenza virus
RVTVSTRS

SEQ ID NO: 271053 - protein, 8 aa, Influenza virus
VTVSTRSD

SEQ ID NO: 271054 - protein, 8 aa, Influenza virus
TVSTRSDQ

SEQ ID NO: 271055 - protein, 8 aa, Influenza virus
VSTRSDQI

SEQ ID NO: 271056 - protein, 8 aa, Influenza virus
STRSDQIS

SEQ ID NO: 271057 - protein, 8 aa, Influenza virus
TRSDQISI

SEQ ID NO: 271058 - protein, 8 aa, Influenza virus
RSDQISIV

SEQ ID NO: 271059 - protein, 8 aa, Influenza virus
SDQISIVP

SEQ ID NO: 271060 - protein, 8 aa, Influenza virus
DQISIVPN

SEQ ID NO: 271061 - protein, 8 aa, Influenza virus
QISIVPNI

SEQ ID NO: 271062 - protein, 8 aa, Influenza virus
ISIVPNIG

SEQ ID NO: 271063 - protein, 8 aa, Influenza virus
SIVPNIGS

SEQ ID NO: 271064 - protein, 8 aa, Influenza virus
IVPNIGSR

SEQ ID NO: 271065 - protein, 8 aa, Influenza virus
VPNIGSRP

SEQ ID NO: 271066 - protein, 8 aa, Influenza virus
PNIGSRPR

SEQ ID NO: 271067 - protein, 8 aa, Influenza virus
NIGSRPRV

SEQ ID NO: 271068 - protein, 8 aa, Influenza virus
IGSRPRVR

SEQ ID NO: 271069 - protein, 8 aa, Influenza virus
GSRPRVRN

SEQ ID NO: 271070 - protein, 8 aa, Influenza virus
SRPRVRNQ

SEQ ID NO: 271071 - protein, 8 aa, Influenza virus
RPRVRNQS

SEQ ID NO: 271072 - protein, 8 aa, Influenza virus
PRVRNQSG

SEQ ID NO: 271073 - protein, 8 aa, Influenza virus
RVRNQSGR

SEQ ID NO: 271074 - protein, 8 aa, Influenza virus
VRNQSGRI

SEQ ID NO: 271075 - protein, 8 aa, Influenza virus
RNQSGRIS

SEQ ID NO: 271076 - protein, 8 aa, Influenza virus
NQSGRISI

SEQ ID NO: 271077 - protein, 8 aa, Influenza virus
QSGRISIY

SEQ ID NO: 271078 - protein, 8 aa, Influenza virus
SGRISIYW

SEQ ID NO: 271079 - protein, 8 aa, Influenza virus
GRISIYWT

SEQ ID NO: 271080 - protein, 8 aa, Influenza virus
RISIYWTL

SEQ ID NO: 271081 - protein, 8 aa, Influenza virus
ISIYWTLV

SEQ ID NO: 271082 - protein, 8 aa, Influenza virus
SIYWTLVN

SEQ ID NO: 271083 - protein, 8 aa, Influenza virus
IYWTLVNP

SEQ ID NO: 271084 - protein, 8 aa, Influenza virus
YWTLVNPG

SEQ ID NO: 271085 - protein, 8 aa, Influenza virus
WTLVNPGD

SEQ ID NO: 271086 - protein, 8 aa, Influenza virus
TLVNPGDS

SEQ ID NO: 271087 - protein, 8 aa, Influenza virus
LVNPGDSI

SEQ ID NO: 271088 - protein, 8 aa, Influenza virus
VNPGDSII

SEQ ID NO: 271089 - protein, 8 aa, Influenza virus
NPGDSIIF

SEQ ID NO: 271090 - protein, 8 aa, Influenza virus
PGDSIIFN

SEQ ID NO: 271091 - protein, 8 aa, Influenza virus
GDSIIFNS

SEQ ID NO: 271092 - protein, 8 aa, Influenza virus
DSIIFNSI

SEQ ID NO: 271093 - protein, 8 aa, Influenza virus
SIIFNSIG

SEQ ID NO: 271094 - protein, 8 aa, Influenza virus
IIFNSIGN

SEQ ID NO: 271095 - protein, 8 aa, Influenza virus
IFNSIGNL

SEQ ID NO: 271096 - protein, 8 aa, Influenza virus
FNSIGNLI

SEQ ID NO: 271097 - protein, 8 aa, Influenza virus
NSIGNLIA

SEQ ID NO: 271098 - protein, 8 aa, Influenza virus
SIGNLIAP

SEQ ID NO: 271099 - protein, 8 aa, Influenza virus
IGNLIAPR

SEQ ID NO: 271100 - protein, 8 aa, Influenza virus
GNLIAPRG

SEQ ID NO: 271101 - protein, 8 aa, Influenza virus
NLIAPRGH

SEQ ID NO: 271102 - protein, 8 aa, Influenza virus
LIAPRGHY

SEQ ID NO: 271103 - protein, 8 aa, Influenza virus
IAPRGHYK

SEQ ID NO: 271104 - protein, 8 aa, Influenza virus
APRGHYKI

SEQ ID NO: 271105 - protein, 8 aa, Influenza virus
PRGHYKIS

SEQ ID NO: 271106 - protein, 8 aa, Influenza virus
RGHYKISK

SEQ ID NO: 271107 - protein, 8 aa, Influenza virus
GHYKISKS

SEQ ID NO: 271108 - protein, 8 aa, Influenza virus
HYKISKST

SEQ ID NO: 271109 - protein, 8 aa, Influenza virus
YKISKSTK

SEQ ID NO: 271110 - protein, 8 aa, Influenza virus
KISKSTKS

SEQ ID NO: 271111 - protein, 8 aa, Influenza virus
ISKSTKST

SEQ ID NO: 271112 - protein, 8 aa, Influenza virus
SKSTKSTV

SEQ ID NO: 271113 - protein, 8 aa, Influenza virus
KSTKSTVL

SEQ ID NO: 271114 - protein, 8 aa, Influenza virus
STKSTVLK

SEQ ID NO: 271115 - protein, 8 aa, Influenza virus
TKSTVLKS

SEQ ID NO: 271116 - protein, 8 aa, Influenza virus
KSTVLKSD

SEQ ID NO: 271117 - protein, 8 aa, Influenza virus
STVLKSDK

SEQ ID NO: 271118 - protein, 8 aa, Influenza virus
TVLKSDKR

SEQ ID NO: 271119 - protein, 8 aa, Influenza virus
VLKSDKRI

SEQ ID NO: 271120 - protein, 8 aa, Influenza virus
LKSDKRIG

SEQ ID NO: 271121 - protein, 8 aa, Influenza virus
KSDKRIGS

SEQ ID NO: 271122 - protein, 8 aa, Influenza virus
SDKRIGSC

SEQ ID NO: 271123 - protein, 8 aa, Influenza virus
DKRIGSCT

SEQ ID NO: 271124 - protein, 8 aa, Influenza virus
KRIGSCTS

SEQ ID NO: 271125 - protein, 8 aa, Influenza virus
RIGSCTSP

SEQ ID NO: 271126 - protein, 8 aa, Influenza virus
IGSCTSPC

SEQ ID NO: 271127 - protein, 8 aa, Influenza virus
GSCTSPCL

SEQ ID NO: 271128 - protein, 8 aa, Influenza virus
SCTSPCLT

SEQ ID NO: 271129 - protein, 8 aa, Influenza virus
CTSPCLTD

SEQ ID NO: 271130 - protein, 8 aa, Influenza virus
TSPCLTDK

SEQ ID NO: 271131 - protein, 8 aa, Influenza virus
SPCLTDKG

SEQ ID NO: 271132 - protein, 8 aa, Influenza virus
PCLTDKGS

SEQ ID NO: 271133 - protein, 8 aa, Influenza virus
CLTDKGSI

SEQ ID NO: 271134 - protein, 8 aa, Influenza virus
LTDKGSIQ

SEQ ID NO: 271135 - protein, 8 aa, Influenza virus
TDKGSIQS

SEQ ID NO: 271136 - protein, 8 aa, Influenza virus
DKGSIQSD

SEQ ID NO: 271137 - protein, 8 aa, Influenza virus
KGSIQSDK

SEQ ID NO: 271138 - protein, 8 aa, Influenza virus
GSIQSDKP

SEQ ID NO: 271139 - protein, 8 aa, Influenza virus
SIQSDKPF

SEQ ID NO: 271140 - protein, 8 aa, Influenza virus
IQSDKPFQ

SEQ ID NO: 271141 - protein, 8 aa, Influenza virus
QSDKPFQN

SEQ ID NO: 271142 - protein, 8 aa, Influenza virus
SDKPFQNV

SEQ ID NO: 271143 - protein, 8 aa, Influenza virus
DKPFQNVS

SEQ ID NO: 271144 - protein, 8 aa, Influenza virus
KPFQNVSR

SEQ ID NO: 271145 - protein, 8 aa, Influenza virus
PFQNVSRI

SEQ ID NO: 271146 - protein, 8 aa, Influenza virus
FQNVSRIA

SEQ ID NO: 271147 - protein, 8 aa, Influenza virus
QNVSRIAI

SEQ ID NO: 271148 - protein, 8 aa, Influenza virus
NVSRIAIG

SEQ ID NO: 271149 - protein, 8 aa, Influenza virus
VSRIAIGN

SEQ ID NO: 271150 - protein, 8 aa, Influenza virus
SRIAIGNC

SEQ ID NO: 271151 - protein, 8 aa, Influenza virus
RIAIGNCP

SEQ ID NO: 271152 - protein, 8 aa, Influenza virus
IAIGNCPK

SEQ ID NO: 271153 - protein, 8 aa, Influenza virus
AIGNCPKY

SEQ ID NO: 271154 - protein, 8 aa, Influenza virus
IGNCPKYV

SEQ ID NO: 271155 - protein, 8 aa, Influenza virus
GNCPKYVK

SEQ ID NO: 271156 - protein, 8 aa, Influenza virus
NCPKYVKQ

SEQ ID NO: 271157 - protein, 8 aa, Influenza virus
CPKYVKQG

SEQ ID NO: 271158 - protein, 8 aa, Influenza virus
PKYVKQGS

SEQ ID NO: 271159 - protein, 8 aa, Influenza virus
KYVKQGSL

SEQ ID NO: 271160 - protein, 8 aa, Influenza virus
YVKQGSLM

SEQ ID NO: 271161 - protein, 8 aa, Influenza virus
VKQGSLML

SEQ ID NO: 271162 - protein, 8 aa, Influenza virus
KQGSLMLA

SEQ ID NO: 271163 - protein, 8 aa, Influenza virus
QGSLMLAT

SEQ ID NO: 271164 - protein, 8 aa, Influenza virus
GSLMLATG

SEQ ID NO: 271165 - protein, 8 aa, Influenza virus
SLMLATGM

SEQ ID NO: 271166 - protein, 8 aa, Influenza virus
LMLATGMR

SEQ ID NO: 271167 - protein, 8 aa, Influenza virus
MLATGMRN

SEQ ID NO: 271168 - protein, 8 aa, Influenza virus
LATGMRNI

SEQ ID NO: 271169 - protein, 8 aa, Influenza virus
ATGMRNIP

SEQ ID NO: 271170 - protein, 8 aa, Influenza virus
TGMRNIPG

SEQ ID NO: 271171 - protein, 8 aa, Influenza virus
GMRNIPGK

SEQ ID NO: 271172 - protein, 8 aa, Influenza virus
MRNIPGKQ

SEQ ID NO: 271173 - protein, 8 aa, Influenza virus
RNIPGKQA

SEQ ID NO: 271174 - protein, 8 aa, Influenza virus
NIPGKQAK

SEQ ID NO: 271175 - protein, 8 aa, Influenza virus
IPGKQAKG

SEQ ID NO: 271176 - protein, 8 aa, Influenza virus
PGKQAKGL

SEQ ID NO: 271177 - protein, 8 aa, Influenza virus
GKQAKGLF

SEQ ID NO: 271178 - protein, 8 aa, Influenza virus
KQAKGLFG

SEQ ID NO: 271179 - protein, 8 aa, Influenza virus
QAKGLFGA

SEQ ID NO: 271180 - protein, 8 aa, Influenza virus
AKGLFGAI

SEQ ID NO: 271181 - protein, 8 aa, Influenza virus
KGLFGAIA

SEQ ID NO: 271182 - protein, 8 aa, Influenza virus
GLFGAIAG

SEQ ID NO: 271183 - protein, 8 aa, Influenza virus
LFGAIAGF

SEQ ID NO: 271184 - protein, 8 aa, Influenza virus
FGAIAGFI

SEQ ID NO: 271185 - protein, 8 aa, Influenza virus
GAIAGFIE

SEQ ID NO: 271186 - protein, 8 aa, Influenza virus
AIAGFIEN

SEQ ID NO: 271187 - protein, 8 aa, Influenza virus
IAGFIENG

SEQ ID NO: 271188 - protein, 8 aa, Influenza virus
AGFIENGW

SEQ ID NO: 271189 - protein, 8 aa, Influenza virus
GFIENGWQ

SEQ ID NO: 271190 - protein, 8 aa, Influenza virus
FIENGWQG

SEQ ID NO: 271191 - protein, 8 aa, Influenza virus
IENGWQGL

SEQ ID NO: 271192 - protein, 8 aa, Influenza virus
ENGWQGLI

SEQ ID NO: 271193 - protein, 8 aa, Influenza virus
NGWQGLID

SEQ ID NO: 271194 - protein, 8 aa, Influenza virus
GWQGLIDG

SEQ ID NO: 271195 - protein, 8 aa, Influenza virus
WQGLIDGW

SEQ ID NO: 271196 - protein, 8 aa, Influenza virus
QGLIDGWY

SEQ ID NO: 271197 - protein, 8 aa, Influenza virus
GLIDGWYG

SEQ ID NO: 271198 - protein, 8 aa, Influenza virus
LIDGWYGF

SEQ ID NO: 271199 - protein, 8 aa, Influenza virus
IDGWYGFR

SEQ ID NO: 271200 - protein, 8 aa, Influenza virus
DGWYGFRH

SEQ ID NO: 271201 - protein, 8 aa, Influenza virus
GWYGFRHQ

SEQ ID NO: 271202 - protein, 8 aa, Influenza virus
WYGFRHQN

SEQ ID NO: 271203 - protein, 8 aa, Influenza virus
YGFRHQNA

SEQ ID NO: 271204 - protein, 8 aa, Influenza virus
GFRHQNAE

SEQ ID NO: 271205 - protein, 8 aa, Influenza virus
FRHQNAEG

SEQ ID NO: 271206 - protein, 8 aa, Influenza virus
RHQNAEGT

SEQ ID NO: 271207 - protein, 8 aa, Influenza virus
HQNAEGTG

SEQ ID NO: 271208 - protein, 8 aa, Influenza virus
QNAEGTGT

SEQ ID NO: 271209 - protein, 8 aa, Influenza virus
NAEGTGTA

SEQ ID NO: 271210 - protein, 8 aa, Influenza virus
AEGTGTAA

SEQ ID NO: 271211 - protein, 8 aa, Influenza virus
EGTGTAAD

SEQ ID NO: 271212 - protein, 8 aa, Influenza virus
GTGTAADL

SEQ ID NO: 271213 - protein, 8 aa, Influenza virus
TGTAADLK

SEQ ID NO: 271214 - protein, 8 aa, Influenza virus
GTAADLKS

SEQ ID NO: 271215 - protein, 8 aa, Influenza virus
TAADLKST

SEQ ID NO: 271216 - protein, 8 aa, Influenza virus
AADLKSTQ

SEQ ID NO: 271217 - protein, 8 aa, Influenza virus
ADLKSTQA

SEQ ID NO: 271218 - protein, 8 aa, Influenza virus
DLKSTQAA

SEQ ID NO: 271219 - protein, 8 aa, Influenza virus
LKSTQAAI

SEQ ID NO: 271220 - protein, 8 aa, Influenza virus
KSTQAAID

SEQ ID NO: 271221 - protein, 8 aa, Influenza virus
STQAAIDQ

SEQ ID NO: 271222 - protein, 8 aa, Influenza virus
TQAAIDQI

SEQ ID NO: 271223 - protein, 8 aa, Influenza virus
QAAIDQIN

SEQ ID NO: 271224 - protein, 8 aa, Influenza virus
AAIDQING

SEQ ID NO: 271225 - protein, 8 aa, Influenza virus
AIDQINGK

SEQ ID NO: 271226 - protein, 8 aa, Influenza virus
IDQINGKL

SEQ ID NO: 271227 - protein, 8 aa, Influenza virus
DQINGKLN

SEQ ID NO: 271228 - protein, 8 aa, Influenza virus
QINGKLNR

SEQ ID NO: 271229 - protein, 8 aa, Influenza virus
INGKLNRL

SEQ ID NO: 271230 - protein, 8 aa, Influenza virus
NGKLNRLI

SEQ ID NO: 271231 - protein, 8 aa, Influenza virus
GKLNRLIE

SEQ ID NO: 271232 - protein, 8 aa, Influenza virus
KLNRLIEK

SEQ ID NO: 271233 - protein, 8 aa, Influenza virus
LNRLIEKT

SEQ ID NO: 271234 - protein, 8 aa, Influenza virus
NRLIEKTN

SEQ ID NO: 271235 - protein, 8 aa, Influenza virus
RLIEKTNE

SEQ ID NO: 271236 - protein, 8 aa, Influenza virus
LIEKTNEK

SEQ ID NO: 271237 - protein, 8 aa, Influenza virus
IEKTNEKY

SEQ ID NO: 271238 - protein, 8 aa, Influenza virus
EKTNEKYH

SEQ ID NO: 271239 - protein, 8 aa, Influenza virus
KTNEKYHQ

SEQ ID NO: 271240 - protein, 8 aa, Influenza virus
TNEKYHQI

SEQ ID NO: 271241 - protein, 8 aa, Influenza virus
NEKYHQIE

SEQ ID NO: 271242 - protein, 8 aa, Influenza virus
EKYHQIEK

SEQ ID NO: 271243 - protein, 8 aa, Influenza virus
KYHQIEKE

SEQ ID NO: 271244 - protein, 8 aa, Influenza virus
YHQIEKEF

SEQ ID NO: 271245 - protein, 8 aa, Influenza virus
HQIEKEFE

SEQ ID NO: 271246 - protein, 8 aa, Influenza virus
QIEKEFEQ

SEQ ID NO: 271247 - protein, 8 aa, Influenza virus
IEKEFEQV

SEQ ID NO: 271248 - protein, 8 aa, Influenza virus
EKEFEQVE

SEQ ID NO: 271249 - protein, 8 aa, Influenza virus
KEFEQVEG

SEQ ID NO: 271250 - protein, 8 aa, Influenza virus
EFEQVEGR

SEQ ID NO: 271251 - protein, 8 aa, Influenza virus
FEQVEGRI

SEQ ID NO: 271252 - protein, 8 aa, Influenza virus
EQVEGRIQ

SEQ ID NO: 271253 - protein, 8 aa, Influenza virus
QVEGRIQD

SEQ ID NO: 271254 - protein, 8 aa, Influenza virus
VEGRIQDL

SEQ ID NO: 271255 - protein, 8 aa, Influenza virus
EGRIQDLE

SEQ ID NO: 271256 - protein, 8 aa, Influenza virus
GRIQDLEK

SEQ ID NO: 271257 - protein, 8 aa, Influenza virus
RIQDLEKY

SEQ ID NO: 271258 - protein, 8 aa, Influenza virus
IQDLEKYV

SEQ ID NO: 271259 - protein, 8 aa, Influenza virus
QDLEKYVE

SEQ ID NO: 271260 - protein, 8 aa, Influenza virus
DLEKYVED

SEQ ID NO: 271261 - protein, 8 aa, Influenza virus
LEKYVEDT

SEQ ID NO: 271262 - protein, 8 aa, Influenza virus
EKYVEDTK

SEQ ID NO: 271263 - protein, 8 aa, Influenza virus
KYVEDTKI

SEQ ID NO: 271264 - protein, 8 aa, Influenza virus
YVEDTKID

SEQ ID NO: 271265 - protein, 8 aa, Influenza virus
VEDTKIDL

SEQ ID NO: 271266 - protein, 8 aa, Influenza virus
EDTKIDLW

SEQ ID NO: 271267 - protein, 8 aa, Influenza virus
DTKIDLWS

SEQ ID NO: 271268 - protein, 8 aa, Influenza virus
TKIDLWSY

SEQ ID NO: 271269 - protein, 8 aa, Influenza virus
KIDLWSYN

SEQ ID NO: 271270 - protein, 8 aa, Influenza virus
IDLWSYNA

SEQ ID NO: 271271 - protein, 8 aa, Influenza virus
DLWSYNAE

SEQ ID NO: 271272 - protein, 8 aa, Influenza virus
LWSYNAEL

SEQ ID NO: 271273 - protein, 8 aa, Influenza virus
WSYNAELL

SEQ ID NO: 271274 - protein, 8 aa, Influenza virus
SYNAELLV

SEQ ID NO: 271275 - protein, 8 aa, Influenza virus
YNAELLVA

SEQ ID NO: 271276 - protein, 8 aa, Influenza virus
NAELLVAL

SEQ ID NO: 271277 - protein, 8 aa, Influenza virus
AELLVALE

SEQ ID NO: 271278 - protein, 8 aa, Influenza virus
ELLVALEN

SEQ ID NO: 271279 - protein, 8 aa, Influenza virus
LLVALENQ

SEQ ID NO: 271280 - protein, 8 aa, Influenza virus
LVALENQH

SEQ ID NO: 271281 - protein, 8 aa, Influenza virus
VALENQHT

SEQ ID NO: 271282 - protein, 8 aa, Influenza virus
ALENQHTI

SEQ ID NO: 271283 - protein, 8 aa, Influenza virus
LENQHTID

SEQ ID NO: 271284 - protein, 8 aa, Influenza virus
ENQHTIDV

SEQ ID NO: 271285 - protein, 8 aa, Influenza virus
NQHTIDVT

SEQ ID NO: 271286 - protein, 8 aa, Influenza virus
QHTIDVTD

SEQ ID NO: 271287 - protein, 8 aa, Influenza virus
HTIDVTDS

SEQ ID NO: 271288 - protein, 8 aa, Influenza virus
TIDVTDSE

SEQ ID NO: 271289 - protein, 8 aa, Influenza virus
IDVTDSEM

SEQ ID NO: 271290 - protein, 8 aa, Influenza virus
DVTDSEMN

SEQ ID NO: 271291 - protein, 8 aa, Influenza virus
VTDSEMNK

SEQ ID NO: 271292 - protein, 8 aa, Influenza virus
TDSEMNKL

SEQ ID NO: 271293 - protein, 8 aa, Influenza virus
DSEMNKLF

SEQ ID NO: 271294 - protein, 8 aa, Influenza virus
SEMNKLFE

SEQ ID NO: 271295 - protein, 8 aa, Influenza virus
EMNKLFER

SEQ ID NO: 271296 - protein, 8 aa, Influenza virus
MNKLFERV

SEQ ID NO: 271297 - protein, 8 aa, Influenza virus
NKLFERVR

SEQ ID NO: 271298 - protein, 8 aa, Influenza virus
KLFERVRR

SEQ ID NO: 271299 - protein, 8 aa, Influenza virus
LFERVRRQ

SEQ ID NO: 271300 - protein, 8 aa, Influenza virus
FERVRRQL

SEQ ID NO: 271301 - protein, 8 aa, Influenza virus
ERVRRQLR

SEQ ID NO: 271302 - protein, 8 aa, Influenza virus
RVRRQLRE

SEQ ID NO: 271303 - protein, 8 aa, Influenza virus
VRRQLREN

SEQ ID NO: 271304 - protein, 8 aa, Influenza virus
RRQLRENA

SEQ ID NO: 271305 - protein, 8 aa, Influenza virus
RQLRENAE

SEQ ID NO: 271306 - protein, 8 aa, Influenza virus
QLRENAED

SEQ ID NO: 271307 - protein, 8 aa, Influenza virus
LRENAEDQ

SEQ ID NO: 271308 - protein, 8 aa, Influenza virus
RENAEDQG

SEQ ID NO: 271309 - protein, 8 aa, Influenza virus
ENAEDQGN

SEQ ID NO: 271310 - protein, 8 aa, Influenza virus
NAEDQGNG

SEQ ID NO: 271311 - protein, 8 aa, Influenza virus
AEDQGNGC

SEQ ID NO: 271312 - protein, 8 aa, Influenza virus
EDQGNGCF

SEQ ID NO: 271313 - protein, 8 aa, Influenza virus
DQGNGCFE

SEQ ID NO: 271314 - protein, 8 aa, Influenza virus
QGNGCFEI

SEQ ID NO: 271315 - protein, 8 aa, Influenza virus
GNGCFEIF

SEQ ID NO: 271316 - protein, 8 aa, Influenza virus
NGCFEIFH

SEQ ID NO: 271317 - protein, 8 aa, Influenza virus
GCFEIFHQ

SEQ ID NO: 271318 - protein, 8 aa, Influenza virus
CFEIFHQC

SEQ ID NO: 271319 - protein, 8 aa, Influenza virus
FEIFHQCD

SEQ ID NO: 271320 - protein, 8 aa, Influenza virus
EIFHQCDN

SEQ ID NO: 271321 - protein, 8 aa, Influenza virus
IFHQCDNN

SEQ ID NO: 271322 - protein, 8 aa, Influenza virus
FHQCDNNC

SEQ ID NO: 271323 - protein, 8 aa, Influenza virus
HQCDNNCI

SEQ ID NO: 271324 - protein, 8 aa, Influenza virus
QCDNNCIE

SEQ ID NO: 271325 - protein, 8 aa, Influenza virus
CDNNCIES

SEQ ID NO: 271326 - protein, 8 aa, Influenza virus
DNNCIESI

SEQ ID NO: 271327 - protein, 8 aa, Influenza virus
NNCIESIR

SEQ ID NO: 271328 - protein, 8 aa, Influenza virus
NCIESIRN

SEQ ID NO: 271329 - protein, 8 aa, Influenza virus
CIESIRNG

SEQ ID NO: 271330 - protein, 8 aa, Influenza virus
IESIRNGT

SEQ ID NO: 271331 - protein, 8 aa, Influenza virus
ESIRNGTY

SEQ ID NO: 271332 - protein, 8 aa, Influenza virus
SIRNGTYD

SEQ ID NO: 271333 - protein, 8 aa, Influenza virus
IRNGTYDH

SEQ ID NO: 271334 - protein, 8 aa, Influenza virus
RNGTYDHN

SEQ ID NO: 271335 - protein, 8 aa, Influenza virus
NGTYDHNI

SEQ ID NO: 271336 - protein, 8 aa, Influenza virus
GTYDHNIY

SEQ ID NO: 271337 - protein, 8 aa, Influenza virus
TYDHNIYR

SEQ ID NO: 271338 - protein, 8 aa, Influenza virus
YDHNIYRD

SEQ ID NO: 271339 - protein, 8 aa, Influenza virus
DHNIYRDE

SEQ ID NO: 271340 - protein, 8 aa, Influenza virus
HNIYRDEA

SEQ ID NO: 271341 - protein, 8 aa, Influenza virus
NIYRDEAI

SEQ ID NO: 271342 - protein, 8 aa, Influenza virus
IYRDEAIN

SEQ ID NO: 271343 - protein, 8 aa, Influenza virus
YRDEAINN

SEQ ID NO: 271344 - protein, 8 aa, Influenza virus
RDEAINNR

SEQ ID NO: 271345 - protein, 8 aa, Influenza virus
DEAINNRI

SEQ ID NO: 271346 - protein, 8 aa, Influenza virus
EAINNRIK

SEQ ID NO: 271347 - protein, 8 aa, Influenza virus
AINNRIKI

SEQ ID NO: 271348 - protein, 8 aa, Influenza virus
INNRIKIN

SEQ ID NO: 271349 - protein, 8 aa, Influenza virus
NNRIKINP

SEQ ID NO: 271350 - protein, 8 aa, Influenza virus
NRIKINPV

SEQ ID NO: 271351 - protein, 8 aa, Influenza virus
RIKINPVT

SEQ ID NO: 271352 - protein, 8 aa, Influenza virus
IKINPVTL

SEQ ID NO: 271353 - protein, 8 aa, Influenza virus
KINPVTLT

SEQ ID NO: 271354 - protein, 8 aa, Influenza virus
INPVTLTM

SEQ ID NO: 271355 - protein, 8 aa, Influenza virus
NPVTLTMG

SEQ ID NO: 271356 - protein, 8 aa, Influenza virus
PVTLTMGY

SEQ ID NO: 271357 - protein, 8 aa, Influenza virus
VTLTMGYK

SEQ ID NO: 271358 - protein, 8 aa, Influenza virus
TLTMGYKD

SEQ ID NO: 271359 - protein, 8 aa, Influenza virus
LTMGYKDI

SEQ ID NO: 271360 - protein, 8 aa, Influenza virus
TMGYKDII

SEQ ID NO: 271361 - protein, 8 aa, Influenza virus
MGYKDIIL

SEQ ID NO: 271362 - protein, 8 aa, Influenza virus
GYKDIILW

SEQ ID NO: 271363 - protein, 8 aa, Influenza virus
YKDIILWI

SEQ ID NO: 271364 - protein, 8 aa, Influenza virus
KDIILWIS

SEQ ID NO: 271365 - protein, 8 aa, Influenza virus
DIILWISF

SEQ ID NO: 271366 - protein, 8 aa, Influenza virus
IILWISFS

SEQ ID NO: 271367 - protein, 8 aa, Influenza virus
ILWISFSM

SEQ ID NO: 271368 - protein, 8 aa, Influenza virus
LWISFSMS

SEQ ID NO: 271369 - protein, 8 aa, Influenza virus
WISFSMSC

SEQ ID NO: 271370 - protein, 8 aa, Influenza virus
ISFSMSCF

SEQ ID NO: 271371 - protein, 8 aa, Influenza virus
SFSMSCFV

SEQ ID NO: 271372 - protein, 8 aa, Influenza virus
FSMSCFVF

SEQ ID NO: 271373 - protein, 8 aa, Influenza virus
SMSCFVFV

SEQ ID NO: 271374 - protein, 8 aa, Influenza virus
MSCFVFVA

SEQ ID NO: 271375 - protein, 8 aa, Influenza virus
SCFVFVAL

SEQ ID NO: 271376 - protein, 8 aa, Influenza virus
CFVFVALI

SEQ ID NO: 271377 - protein, 8 aa, Influenza virus
FVFVALIL

SEQ ID NO: 271378 - protein, 8 aa, Influenza virus
VFVALILG

SEQ ID NO: 271379 - protein, 8 aa, Influenza virus
FVALILGF

SEQ ID NO: 271380 - protein, 8 aa, Influenza virus
VALILGFV

SEQ ID NO: 271381 - protein, 8 aa, Influenza virus
ALILGFVL

SEQ ID NO: 271382 - protein, 8 aa, Influenza virus
LILGFVLW

SEQ ID NO: 271383 - protein, 8 aa, Influenza virus
ILGFVLWA

SEQ ID NO: 271384 - protein, 8 aa, Influenza virus
LGFVLWAC

SEQ ID NO: 271385 - protein, 8 aa, Influenza virus
GFVLWACQ

SEQ ID NO: 271386 - protein, 8 aa, Influenza virus
FVLWACQN

SEQ ID NO: 271387 - protein, 8 aa, Influenza virus
VLWACQNG

SEQ ID NO: 271388 - protein, 8 aa, Influenza virus
LWACQNGN

SEQ ID NO: 271389 - protein, 8 aa, Influenza virus
WACQNGNI

SEQ ID NO: 271390 - protein, 8 aa, Influenza virus
ACQNGNIR

SEQ ID NO: 271391 - protein, 8 aa, Influenza virus
CQNGNIRC

SEQ ID NO: 271392 - protein, 8 aa, Influenza virus
QNGNIRCQ

SEQ ID NO: 271393 - protein, 8 aa, Influenza virus
NGNIRCQI

SEQ ID NO: 271394 - protein, 8 aa, Influenza virus
GNIRCQIC

SEQ ID NO: 271395 - protein, 8 aa, Influenza virus
NIRCQICI

SEQ ID NO: 271396 - protein, 8 aa, Influenza virus
MNTQIIVI

SEQ ID NO: 271397 - protein, 8 aa, Influenza virus
NTQIIVIL

SEQ ID NO: 271398 - protein, 8 aa, Influenza virus
TQIIVILV

SEQ ID NO: 271399 - protein, 8 aa, Influenza virus
QIIVILVL

SEQ ID NO: 271400 - protein, 8 aa, Influenza virus
IIVILVLG

SEQ ID NO: 271401 - protein, 8 aa, Influenza virus
IVILVLGL

SEQ ID NO: 271402 - protein, 8 aa, Influenza virus
VILVLGLS

SEQ ID NO: 271403 - protein, 8 aa, Influenza virus
ILVLGLSM

SEQ ID NO: 271404 - protein, 8 aa, Influenza virus
LVLGLSMV

SEQ ID NO: 271405 - protein, 8 aa, Influenza virus
VLGLSMVK

SEQ ID NO: 271406 - protein, 8 aa, Influenza virus
LGLSMVKS

SEQ ID NO: 271407 - protein, 8 aa, Influenza virus
GLSMVKSD

SEQ ID NO: 271408 - protein, 8 aa, Influenza virus
LSMVKSDK

SEQ ID NO: 271409 - protein, 8 aa, Influenza virus
SMVKSDKI

SEQ ID NO: 271410 - protein, 8 aa, Influenza virus
MVKSDKIC

SEQ ID NO: 271411 - protein, 8 aa, Influenza virus
VKSDKICL

SEQ ID NO: 271412 - protein, 8 aa, Influenza virus
KSDKICLG

SEQ ID NO: 271413 - protein, 8 aa, Influenza virus
SDKICLGH

SEQ ID NO: 271414 - protein, 8 aa, Influenza virus
DKICLGHH

SEQ ID NO: 271415 - protein, 8 aa, Influenza virus
KICLGHHA

SEQ ID NO: 271416 - protein, 8 aa, Influenza virus
ICLGHHAV

SEQ ID NO: 271417 - protein, 8 aa, Influenza virus
CLGHHAVA

SEQ ID NO: 271418 - protein, 8 aa, Influenza virus
LGHHAVAN

SEQ ID NO: 271419 - protein, 8 aa, Influenza virus
GHHAVANG

SEQ ID NO: 271420 - protein, 8 aa, Influenza virus
HHAVANGT

SEQ ID NO: 271421 - protein, 8 aa, Influenza virus
HAVANGTK

SEQ ID NO: 271422 - protein, 8 aa, Influenza virus
AVANGTKV

SEQ ID NO: 271423 - protein, 8 aa, Influenza virus
VANGTKVN

SEQ ID NO: 271424 - protein, 8 aa, Influenza virus
ANGTKVNT

SEQ ID NO: 271425 - protein, 8 aa, Influenza virus
NGTKVNTL

SEQ ID NO: 271426 - protein, 8 aa, Influenza virus
GTKVNTLT

SEQ ID NO: 271427 - protein, 8 aa, Influenza virus
TKVNTLTE

SEQ ID NO: 271428 - protein, 8 aa, Influenza virus
KVNTLTER

SEQ ID NO: 271429 - protein, 8 aa, Influenza virus
VNTLTERG

SEQ ID NO: 271430 - protein, 8 aa, Influenza virus
NTLTERGV

SEQ ID NO: 271431 - protein, 8 aa, Influenza virus
TLTERGVE

SEQ ID NO: 271432 - protein, 8 aa, Influenza virus
LTERGVEV

SEQ ID NO: 271433 - protein, 8 aa, Influenza virus
TERGVEVV

SEQ ID NO: 271434 - protein, 8 aa, Influenza virus
ERGVEVVN

SEQ ID NO: 271435 - protein, 8 aa, Influenza virus
RGVEVVNA

SEQ ID NO: 271436 - protein, 8 aa, Influenza virus
GVEVVNAT

SEQ ID NO: 271437 - protein, 8 aa, Influenza virus
VEVVNATE

SEQ ID NO: 271438 - protein, 8 aa, Influenza virus
EVVNATET

SEQ ID NO: 271439 - protein, 8 aa, Influenza virus
VVNATETV

SEQ ID NO: 271440 - protein, 8 aa, Influenza virus
VNATETVE

SEQ ID NO: 271441 - protein, 8 aa, Influenza virus
NATETVEI

SEQ ID NO: 271442 - protein, 8 aa, Influenza virus
ATETVEIT

SEQ ID NO: 271443 - protein, 8 aa, Influenza virus
TETVEITG

SEQ ID NO: 271444 - protein, 8 aa, Influenza virus
ETVEITGI

SEQ ID NO: 271445 - protein, 8 aa, Influenza virus
TVEITGID

SEQ ID NO: 271446 - protein, 8 aa, Influenza virus
VEITGIDK

SEQ ID NO: 271447 - protein, 8 aa, Influenza virus
EITGIDKV

SEQ ID NO: 271448 - protein, 8 aa, Influenza virus
ITGIDKVC

SEQ ID NO: 271449 - protein, 8 aa, Influenza virus
TGIDKVCT

SEQ ID NO: 271450 - protein, 8 aa, Influenza virus
GIDKVCTK

SEQ ID NO: 271451 - protein, 8 aa, Influenza virus
IDKVCTKG

SEQ ID NO: 271452 - protein, 8 aa, Influenza virus
DKVCTKGK

SEQ ID NO: 271453 - protein, 8 aa, Influenza virus
KVCTKGKK

SEQ ID NO: 271454 - protein, 8 aa, Influenza virus
VCTKGKKA

SEQ ID NO: 271455 - protein, 8 aa, Influenza virus
CTKGKKAV

SEQ ID NO: 271456 - protein, 8 aa, Influenza virus
TKGKKAVD

SEQ ID NO: 271457 - protein, 8 aa, Influenza virus
KGKKAVDL

SEQ ID NO: 271458 - protein, 8 aa, Influenza virus
GKKAVDLG

SEQ ID NO: 271459 - protein, 8 aa, Influenza virus
KKAVDLGS

SEQ ID NO: 271460 - protein, 8 aa, Influenza virus
KAVDLGSC

SEQ ID NO: 271461 - protein, 8 aa, Influenza virus
AVDLGSCG

SEQ ID NO: 271462 - protein, 8 aa, Influenza virus
VDLGSCGI

SEQ ID NO: 271463 - protein, 8 aa, Influenza virus
DLGSCGIL

SEQ ID NO: 271464 - protein, 8 aa, Influenza virus
LGSCGILG

SEQ ID NO: 271465 - protein, 8 aa, Influenza virus
GSCGILGT

SEQ ID NO: 271466 - protein, 8 aa, Influenza virus
SCGILGTI

SEQ ID NO: 271467 - protein, 8 aa, Influenza virus
CGILGTII

SEQ ID NO: 271468 - protein, 8 aa, Influenza virus
GILGTIIG

SEQ ID NO: 271469 - protein, 8 aa, Influenza virus
ILGTIIGP

SEQ ID NO: 271470 - protein, 8 aa, Influenza virus
LGTIIGPP

SEQ ID NO: 271471 - protein, 8 aa, Influenza virus
GTIIGPPQ

SEQ ID NO: 271472 - protein, 8 aa, Influenza virus
TIIGPPQC

SEQ ID NO: 271473 - protein, 8 aa, Influenza virus
IIGPPQCD

SEQ ID NO: 271474 - protein, 8 aa, Influenza virus
IGPPQCDL

SEQ ID NO: 271475 - protein, 8 aa, Influenza virus
GPPQCDLH

SEQ ID NO: 271476 - protein, 8 aa, Influenza virus
PPQCDLHL

SEQ ID NO: 271477 - protein, 8 aa, Influenza virus
PQCDLHLE

SEQ ID NO: 271478 - protein, 8 aa, Influenza virus
QCDLHLEF

SEQ ID NO: 271479 - protein, 8 aa, Influenza virus
CDLHLEFK

SEQ ID NO: 271480 - protein, 8 aa, Influenza virus
DLHLEFKA

SEQ ID NO: 271481 - protein, 8 aa, Influenza virus
LHLEFKAD

SEQ ID NO: 271482 - protein, 8 aa, Influenza virus
HLEFKADL

SEQ ID NO: 271483 - protein, 8 aa, Influenza virus
LEFKADLI

SEQ ID NO: 271484 - protein, 8 aa, Influenza virus
EFKADLII

SEQ ID NO: 271485 - protein, 8 aa, Influenza virus
FKADLIIE

SEQ ID NO: 271486 - protein, 8 aa, Influenza virus
KADLIIER

SEQ ID NO: 271487 - protein, 8 aa, Influenza virus
ADLIIERR

SEQ ID NO: 271488 - protein, 8 aa, Influenza virus
DLIIERRN

SEQ ID NO: 271489 - protein, 8 aa, Influenza virus
LIIERRNS

SEQ ID NO: 271490 - protein, 8 aa, Influenza virus
IIERRNSS

SEQ ID NO: 271491 - protein, 8 aa, Influenza virus
IERRNSSD

SEQ ID NO: 271492 - protein, 8 aa, Influenza virus
ERRNSSDI

SEQ ID NO: 271493 - protein, 8 aa, Influenza virus
RRNSSDIC

SEQ ID NO: 271494 - protein, 8 aa, Influenza virus
RNSSDICY

SEQ ID NO: 271495 - protein, 8 aa, Influenza virus
NSSDICYP

SEQ ID NO: 271496 - protein, 8 aa, Influenza virus
SSDICYPG

SEQ ID NO: 271497 - protein, 8 aa, Influenza virus
SDICYPGR

SEQ ID NO: 271498 - protein, 8 aa, Influenza virus
DICYPGRF

SEQ ID NO: 271499 - protein, 8 aa, Influenza virus
ICYPGRFT

SEQ ID NO: 271500 - protein, 8 aa, Influenza virus
CYPGRFTN

SEQ ID NO: 271501 - protein, 8 aa, Influenza virus
YPGRFTNE

SEQ ID NO: 271502 - protein, 8 aa, Influenza virus
PGRFTNEE

SEQ ID NO: 271503 - protein, 8 aa, Influenza virus
GRFTNEEA

SEQ ID NO: 271504 - protein, 8 aa, Influenza virus
RFTNEEAL

SEQ ID NO: 271505 - protein, 8 aa, Influenza virus
FTNEEALR

SEQ ID NO: 271506 - protein, 8 aa, Influenza virus
TNEEALRQ

SEQ ID NO: 271507 - protein, 8 aa, Influenza virus
NEEALRQI

SEQ ID NO: 271508 - protein, 8 aa, Influenza virus
EEALRQII

SEQ ID NO: 271509 - protein, 8 aa, Influenza virus
EALRQIIR

SEQ ID NO: 271510 - protein, 8 aa, Influenza virus
ALRQIIRE

SEQ ID NO: 271511 - protein, 8 aa, Influenza virus
LRQIIRES

SEQ ID NO: 271512 - protein, 8 aa, Influenza virus
RQIIRESG

SEQ ID NO: 271513 - protein, 8 aa, Influenza virus
QIIRESGG

SEQ ID NO: 271514 - protein, 8 aa, Influenza virus
IIRESGGI

SEQ ID NO: 271515 - protein, 8 aa, Influenza virus
IRESGGID

SEQ ID NO: 271516 - protein, 8 aa, Influenza virus
RESGGIDK

SEQ ID NO: 271517 - protein, 8 aa, Influenza virus
ESGGIDKE

SEQ ID NO: 271518 - protein, 8 aa, Influenza virus
SGGIDKES

SEQ ID NO: 271519 - protein, 8 aa, Influenza virus
GGIDKESM

SEQ ID NO: 271520 - protein, 8 aa, Influenza virus
GIDKESMG

SEQ ID NO: 271521 - protein, 8 aa, Influenza virus
IDKESMGF

SEQ ID NO: 271522 - protein, 8 aa, Influenza virus
DKESMGFR

SEQ ID NO: 271523 - protein, 8 aa, Influenza virus
KESMGFRY

SEQ ID NO: 271524 - protein, 8 aa, Influenza virus
ESMGFRYS

SEQ ID NO: 271525 - protein, 8 aa, Influenza virus
SMGFRYSG

SEQ ID NO: 271526 - protein, 8 aa, Influenza virus
MGFRYSGI

SEQ ID NO: 271527 - protein, 8 aa, Influenza virus
GFRYSGIR

SEQ ID NO: 271528 - protein, 8 aa, Influenza virus
FRYSGIRT

SEQ ID NO: 271529 - protein, 8 aa, Influenza virus
RYSGIRTD

SEQ ID NO: 271530 - protein, 8 aa, Influenza virus
YSGIRTDG

SEQ ID NO: 271531 - protein, 8 aa, Influenza virus
SGIRTDGA

SEQ ID NO: 271532 - protein, 8 aa, Influenza virus
GIRTDGAT

SEQ ID NO: 271533 - protein, 8 aa, Influenza virus
IRTDGATS

SEQ ID NO: 271534 - protein, 8 aa, Influenza virus
RTDGATSA

SEQ ID NO: 271535 - protein, 8 aa, Influenza virus
TDGATSAC

SEQ ID NO: 271536 - protein, 8 aa, Influenza virus
DGATSACK

SEQ ID NO: 271537 - protein, 8 aa, Influenza virus
GATSACKR

SEQ ID NO: 271538 - protein, 8 aa, Influenza virus
ATSACKRT

SEQ ID NO: 271539 - protein, 8 aa, Influenza virus
TSACKRTV

SEQ ID NO: 271540 - protein, 8 aa, Influenza virus
SACKRTVS

SEQ ID NO: 271541 - protein, 8 aa, Influenza virus
ACKRTVSS

SEQ ID NO: 271542 - protein, 8 aa, Influenza virus
CKRTVSSF

SEQ ID NO: 271543 - protein, 8 aa, Influenza virus
KRTVSSFY

SEQ ID NO: 271544 - protein, 8 aa, Influenza virus
RTVSSFYS

SEQ ID NO: 271545 - protein, 8 aa, Influenza virus
TVSSFYSE

SEQ ID NO: 271546 - protein, 8 aa, Influenza virus
VSSFYSEM

SEQ ID NO: 271547 - protein, 8 aa, Influenza virus
SSFYSEMK

SEQ ID NO: 271548 - protein, 8 aa, Influenza virus
SFYSEMKW

SEQ ID NO: 271549 - protein, 8 aa, Influenza virus
FYSEMKWL

SEQ ID NO: 271550 - protein, 8 aa, Influenza virus
YSEMKWLS

SEQ ID NO: 271551 - protein, 8 aa, Influenza virus
SEMKWLSS

SEQ ID NO: 271552 - protein, 8 aa, Influenza virus
EMKWLSSS

SEQ ID NO: 271553 - protein, 8 aa, Influenza virus
MKWLSSSM

SEQ ID NO: 271554 - protein, 8 aa, Influenza virus
KWLSSSMN

SEQ ID NO: 271555 - protein, 8 aa, Influenza virus
WLSSSMNN

SEQ ID NO: 271556 - protein, 8 aa, Influenza virus
LSSSMNNQ

SEQ ID NO: 271557 - protein, 8 aa, Influenza virus
SSSMNNQV

SEQ ID NO: 271558 - protein, 8 aa, Influenza virus
SSMNNQVF

SEQ ID NO: 271559 - protein, 8 aa, Influenza virus
SMNNQVFP

SEQ ID NO: 271560 - protein, 8 aa, Influenza virus
MNNQVFPQ

SEQ ID NO: 271561 - protein, 8 aa, Influenza virus
NNQVFPQL

SEQ ID NO: 271562 - protein, 8 aa, Influenza virus
NQVFPQLN

SEQ ID NO: 271563 - protein, 8 aa, Influenza virus
QVFPQLNQ

SEQ ID NO: 271564 - protein, 8 aa, Influenza virus
VFPQLNQT

SEQ ID NO: 271565 - protein, 8 aa, Influenza virus
FPQLNQTY

SEQ ID NO: 271566 - protein, 8 aa, Influenza virus
PQLNQTYR

SEQ ID NO: 271567 - protein, 8 aa, Influenza virus
QLNQTYRN

SEQ ID NO: 271568 - protein, 8 aa, Influenza virus
LNQTYRNT

SEQ ID NO: 271569 - protein, 8 aa, Influenza virus
NQTYRNTR

SEQ ID NO: 271570 - protein, 8 aa, Influenza virus
QTYRNTRK

SEQ ID NO: 271571 - protein, 8 aa, Influenza virus
TYRNTRKE

SEQ ID NO: 271572 - protein, 8 aa, Influenza virus
YRNTRKEP

SEQ ID NO: 271573 - protein, 8 aa, Influenza virus
RNTRKEPA

SEQ ID NO: 271574 - protein, 8 aa, Influenza virus
NTRKEPAL

SEQ ID NO: 271575 - protein, 8 aa, Influenza virus
TRKEPALI

SEQ ID NO: 271576 - protein, 8 aa, Influenza virus
RKEPALIV

SEQ ID NO: 271577 - protein, 8 aa, Influenza virus
KEPALIVW

SEQ ID NO: 271578 - protein, 8 aa, Influenza virus
EPALIVWG

SEQ ID NO: 271579 - protein, 8 aa, Influenza virus
PALIVWGV

SEQ ID NO: 271580 - protein, 8 aa, Influenza virus
ALIVWGVH

SEQ ID NO: 271581 - protein, 8 aa, Influenza virus
LIVWGVHH

SEQ ID NO: 271582 - protein, 8 aa, Influenza virus
IVWGVHHS

SEQ ID NO: 271583 - protein, 8 aa, Influenza virus
VWGVHHSS

SEQ ID NO: 271584 - protein, 8 aa, Influenza virus
WGVHHSSS

SEQ ID NO: 271585 - protein, 8 aa, Influenza virus
GVHHSSSL

SEQ ID NO: 271586 - protein, 8 aa, Influenza virus
VHHSSSLD

SEQ ID NO: 271587 - protein, 8 aa, Influenza virus
HHSSSLDE

SEQ ID NO: 271588 - protein, 8 aa, Influenza virus
HSSSLDEQ

SEQ ID NO: 271589 - protein, 8 aa, Influenza virus
SSSLDEQN

SEQ ID NO: 271590 - protein, 8 aa, Influenza virus
SSLDEQNK

SEQ ID NO: 271591 - protein, 8 aa, Influenza virus
SLDEQNKL

SEQ ID NO: 271592 - protein, 8 aa, Influenza virus
LDEQNKLY

SEQ ID NO: 271593 - protein, 8 aa, Influenza virus
DEQNKLYG

SEQ ID NO: 271594 - protein, 8 aa, Influenza virus
EQNKLYGT

SEQ ID NO: 271595 - protein, 8 aa, Influenza virus
QNKLYGTG

SEQ ID NO: 271596 - protein, 8 aa, Influenza virus
NKLYGTGN

SEQ ID NO: 271597 - protein, 8 aa, Influenza virus
KLYGTGNK

SEQ ID NO: 271598 - protein, 8 aa, Influenza virus
LYGTGNKL

SEQ ID NO: 271599 - protein, 8 aa, Influenza virus
YGTGNKLI

SEQ ID NO: 271600 - protein, 8 aa, Influenza virus
GTGNKLIT

SEQ ID NO: 271601 - protein, 8 aa, Influenza virus
TGNKLITV

SEQ ID NO: 271602 - protein, 8 aa, Influenza virus
GNKLITVG

SEQ ID NO: 271603 - protein, 8 aa, Influenza virus
NKLITVGS

SEQ ID NO: 271604 - protein, 8 aa, Influenza virus
KLITVGSS

SEQ ID NO: 271605 - protein, 8 aa, Influenza virus
LITVGSSK

SEQ ID NO: 271606 - protein, 8 aa, Influenza virus
ITVGSSKY

SEQ ID NO: 271607 - protein, 8 aa, Influenza virus
TVGSSKYQ

SEQ ID NO: 271608 - protein, 8 aa, Influenza virus
VGSSKYQQ

SEQ ID NO: 271609 - protein, 8 aa, Influenza virus
GSSKYQQS

SEQ ID NO: 271610 - protein, 8 aa, Influenza virus
SSKYQQSF

SEQ ID NO: 271611 - protein, 8 aa, Influenza virus
SKYQQSFS

SEQ ID NO: 271612 - protein, 8 aa, Influenza virus
KYQQSFSP

SEQ ID NO: 271613 - protein, 8 aa, Influenza virus
YQQSFSPS

SEQ ID NO: 271614 - protein, 8 aa, Influenza virus
QQSFSPSP

SEQ ID NO: 271615 - protein, 8 aa, Influenza virus
QSFSPSPG

SEQ ID NO: 271616 - protein, 8 aa, Influenza virus
SFSPSPGA

SEQ ID NO: 271617 - protein, 8 aa, Influenza virus
FSPSPGAR

SEQ ID NO: 271618 - protein, 8 aa, Influenza virus
SPSPGARP

SEQ ID NO: 271619 - protein, 8 aa, Influenza virus
PSPGARPK

SEQ ID NO: 271620 - protein, 8 aa, Influenza virus
SPGARPKV

SEQ ID NO: 271621 - protein, 8 aa, Influenza virus
PGARPKVN

SEQ ID NO: 271622 - protein, 8 aa, Influenza virus
GARPKVNG

SEQ ID NO: 271623 - protein, 8 aa, Influenza virus
ARPKVNGQ

SEQ ID NO: 271624 - protein, 8 aa, Influenza virus
RPKVNGQA

SEQ ID NO: 271625 - protein, 8 aa, Influenza virus
PKVNGQAG

SEQ ID NO: 271626 - protein, 8 aa, Influenza virus
KVNGQAGR

SEQ ID NO: 271627 - protein, 8 aa, Influenza virus
VNGQAGRI

SEQ ID NO: 271628 - protein, 8 aa, Influenza virus
NGQAGRID

SEQ ID NO: 271629 - protein, 8 aa, Influenza virus
GQAGRIDF

SEQ ID NO: 271630 - protein, 8 aa, Influenza virus
QAGRIDFH

SEQ ID NO: 271631 - protein, 8 aa, Influenza virus
AGRIDFHW

SEQ ID NO: 271632 - protein, 8 aa, Influenza virus
GRIDFHWM

SEQ ID NO: 271633 - protein, 8 aa, Influenza virus
RIDFHWML

SEQ ID NO: 271634 - protein, 8 aa, Influenza virus
IDFHWMLL

SEQ ID NO: 271635 - protein, 8 aa, Influenza virus
DFHWMLLD

SEQ ID NO: 271636 - protein, 8 aa, Influenza virus
FHWMLLDP

SEQ ID NO: 271637 - protein, 8 aa, Influenza virus
HWMLLDPG

SEQ ID NO: 271638 - protein, 8 aa, Influenza virus
WMLLDPGD

SEQ ID NO: 271639 - protein, 8 aa, Influenza virus
MLLDPGDT

SEQ ID NO: 271640 - protein, 8 aa, Influenza virus
LLDPGDTV

SEQ ID NO: 271641 - protein, 8 aa, Influenza virus
LDPGDTVT

SEQ ID NO: 271642 - protein, 8 aa, Influenza virus
DPGDTVTF

SEQ ID NO: 271643 - protein, 8 aa, Influenza virus
PGDTVTFT

SEQ ID NO: 271644 - protein, 8 aa, Influenza virus
GDTVTFTF

SEQ ID NO: 271645 - protein, 8 aa, Influenza virus
DTVTFTFN

SEQ ID NO: 271646 - protein, 8 aa, Influenza virus
TVTFTFNG

SEQ ID NO: 271647 - protein, 8 aa, Influenza virus
VTFTFNGA

SEQ ID NO: 271648 - protein, 8 aa, Influenza virus
TFTFNGAF

SEQ ID NO: 271649 - protein, 8 aa, Influenza virus
FTFNGAFI

SEQ ID NO: 271650 - protein, 8 aa, Influenza virus
TFNGAFIA

SEQ ID NO: 271651 - protein, 8 aa, Influenza virus
FNGAFIAP

SEQ ID NO: 271652 - protein, 8 aa, Influenza virus
NGAFIAPD

SEQ ID NO: 271653 - protein, 8 aa, Influenza virus
GAFIAPDR

SEQ ID NO: 271654 - protein, 8 aa, Influenza virus
AFIAPDRA

SEQ ID NO: 271655 - protein, 8 aa, Influenza virus
FIAPDRAT

SEQ ID NO: 271656 - protein, 8 aa, Influenza virus
IAPDRATF

SEQ ID NO: 271657 - protein, 8 aa, Influenza virus
APDRATFL

SEQ ID NO: 271658 - protein, 8 aa, Influenza virus
PDRATFLR

SEQ ID NO: 271659 - protein, 8 aa, Influenza virus
DRATFLRS

SEQ ID NO: 271660 - protein, 8 aa, Influenza virus
RATFLRSN

SEQ ID NO: 271661 - protein, 8 aa, Influenza virus
ATFLRSNA

SEQ ID NO: 271662 - protein, 8 aa, Influenza virus
TFLRSNAP

SEQ ID NO: 271663 - protein, 8 aa, Influenza virus
FLRSNAPS

SEQ ID NO: 271664 - protein, 8 aa, Influenza virus
LRSNAPSG

SEQ ID NO: 271665 - protein, 8 aa, Influenza virus
RSNAPSGI

SEQ ID NO: 271666 - protein, 8 aa, Influenza virus
SNAPSGIE

SEQ ID NO: 271667 - protein, 8 aa, Influenza virus
NAPSGIEY

SEQ ID NO: 271668 - protein, 8 aa, Influenza virus
APSGIEYN

SEQ ID NO: 271669 - protein, 8 aa, Influenza virus
PSGIEYNG

SEQ ID NO: 271670 - protein, 8 aa, Influenza virus
SGIEYNGK

SEQ ID NO: 271671 - protein, 8 aa, Influenza virus
GIEYNGKS

SEQ ID NO: 271672 - protein, 8 aa, Influenza virus
IEYNGKSL

SEQ ID NO: 271673 - protein, 8 aa, Influenza virus
EYNGKSLG

SEQ ID NO: 271674 - protein, 8 aa, Influenza virus
YNGKSLGI

SEQ ID NO: 271675 - protein, 8 aa, Influenza virus
NGKSLGIQ

SEQ ID NO: 271676 - protein, 8 aa, Influenza virus
GKSLGIQS

SEQ ID NO: 271677 - protein, 8 aa, Influenza virus
KSLGIQSD

SEQ ID NO: 271678 - protein, 8 aa, Influenza virus
SLGIQSDA

SEQ ID NO: 271679 - protein, 8 aa, Influenza virus
LGIQSDAQ

SEQ ID NO: 271680 - protein, 8 aa, Influenza virus
GIQSDAQI

SEQ ID NO: 271681 - protein, 8 aa, Influenza virus
IQSDAQID

SEQ ID NO: 271682 - protein, 8 aa, Influenza virus
QSDAQIDE

SEQ ID NO: 271683 - protein, 8 aa, Influenza virus
SDAQIDES

SEQ ID NO: 271684 - protein, 8 aa, Influenza virus
DAQIDESC

SEQ ID NO: 271685 - protein, 8 aa, Influenza virus
AQIDESCE

SEQ ID NO: 271686 - protein, 8 aa, Influenza virus
QIDESCEG

SEQ ID NO: 271687 - protein, 8 aa, Influenza virus
IDESCEGE

SEQ ID NO: 271688 - protein, 8 aa, Influenza virus
DESCEGEC

SEQ ID NO: 271689 - protein, 8 aa, Influenza virus
ESCEGECF

SEQ ID NO: 271690 - protein, 8 aa, Influenza virus
SCEGECFY

SEQ ID NO: 271691 - protein, 8 aa, Influenza virus
CEGECFYS

SEQ ID NO: 271692 - protein, 8 aa, Influenza virus
EGECFYSG

SEQ ID NO: 271693 - protein, 8 aa, Influenza virus
GECFYSGG

SEQ ID NO: 271694 - protein, 8 aa, Influenza virus
ECFYSGGT

SEQ ID NO: 271695 - protein, 8 aa, Influenza virus
CFYSGGTI

SEQ ID NO: 271696 - protein, 8 aa, Influenza virus
FYSGGTIN

SEQ ID NO: 271697 - protein, 8 aa, Influenza virus
YSGGTINS

SEQ ID NO: 271698 - protein, 8 aa, Influenza virus
SGGTINSP

SEQ ID NO: 271699 - protein, 8 aa, Influenza virus
GGTINSPL

SEQ ID NO: 271700 - protein, 8 aa, Influenza virus
GTINSPLP

SEQ ID NO: 271701 - protein, 8 aa, Influenza virus
TINSPLPF

SEQ ID NO: 271702 - protein, 8 aa, Influenza virus
INSPLPFQ

SEQ ID NO: 271703 - protein, 8 aa, Influenza virus
NSPLPFQN

SEQ ID NO: 271704 - protein, 8 aa, Influenza virus
SPLPFQNI

SEQ ID NO: 271705 - protein, 8 aa, Influenza virus
PLPFQNID

SEQ ID NO: 271706 - protein, 8 aa, Influenza virus
LPFQNIDS

SEQ ID NO: 271707 - protein, 8 aa, Influenza virus
PFQNIDSR

SEQ ID NO: 271708 - protein, 8 aa, Influenza virus
FQNIDSRA

SEQ ID NO: 271709 - protein, 8 aa, Influenza virus
QNIDSRAV

SEQ ID NO: 271710 - protein, 8 aa, Influenza virus
NIDSRAVG

SEQ ID NO: 271711 - protein, 8 aa, Influenza virus
IDSRAVGK

SEQ ID NO: 271712 - protein, 8 aa, Influenza virus
DSRAVGKC

SEQ ID NO: 271713 - protein, 8 aa, Influenza virus
SRAVGKCP

SEQ ID NO: 271714 - protein, 8 aa, Influenza virus
RAVGKCPR

SEQ ID NO: 271715 - protein, 8 aa, Influenza virus
AVGKCPRY

SEQ ID NO: 271716 - protein, 8 aa, Influenza virus
VGKCPRYV

SEQ ID NO: 271717 - protein, 8 aa, Influenza virus
GKCPRYVK

SEQ ID NO: 271718 - protein, 8 aa, Influenza virus
KCPRYVKQ

SEQ ID NO: 271719 - protein, 8 aa, Influenza virus
CPRYVKQS

SEQ ID NO: 271720 - protein, 8 aa, Influenza virus
PRYVKQSS

SEQ ID NO: 271721 - protein, 8 aa, Influenza virus
RYVKQSSL

SEQ ID NO: 271722 - protein, 8 aa, Influenza virus
YVKQSSLP

SEQ ID NO: 271723 - protein, 8 aa, Influenza virus
VKQSSLPL

SEQ ID NO: 271724 - protein, 8 aa, Influenza virus
KQSSLPLA

SEQ ID NO: 271725 - protein, 8 aa, Influenza virus
QSSLPLAL

SEQ ID NO: 271726 - protein, 8 aa, Influenza virus
SSLPLALG

SEQ ID NO: 271727 - protein, 8 aa, Influenza virus
SLPLALGM

SEQ ID NO: 271728 - protein, 8 aa, Influenza virus
LPLALGMK

SEQ ID NO: 271729 - protein, 8 aa, Influenza virus
PLALGMKN

SEQ ID NO: 271730 - protein, 8 aa, Influenza virus
LALGMKNV

SEQ ID NO: 271731 - protein, 8 aa, Influenza virus
ALGMKNVP

SEQ ID NO: 271732 - protein, 8 aa, Influenza virus
LGMKNVPE

SEQ ID NO: 271733 - protein, 8 aa, Influenza virus
GMKNVPEK

SEQ ID NO: 271734 - protein, 8 aa, Influenza virus
MKNVPEKI

SEQ ID NO: 271735 - protein, 8 aa, Influenza virus
KNVPEKIR

SEQ ID NO: 271736 - protein, 8 aa, Influenza virus
NVPEKIRT

SEQ ID NO: 271737 - protein, 8 aa, Influenza virus
VPEKIRTR

SEQ ID NO: 271738 - protein, 8 aa, Influenza virus
PEKIRTRG

SEQ ID NO: 271739 - protein, 8 aa, Influenza virus
EKIRTRGL

SEQ ID NO: 271740 - protein, 8 aa, Influenza virus
KIRTRGLF

SEQ ID NO: 271741 - protein, 8 aa, Influenza virus
IRTRGLFG

SEQ ID NO: 271742 - protein, 8 aa, Influenza virus
RTRGLFGA

SEQ ID NO: 271743 - protein, 8 aa, Influenza virus
TRGLFGAI

SEQ ID NO: 271744 - protein, 8 aa, Influenza virus
RGLFGAIA

SEQ ID NO: 271745 - protein, 8 aa, Influenza virus
GLFGAIAG

SEQ ID NO: 271746 - protein, 8 aa, Influenza virus
LFGAIAGF

SEQ ID NO: 271747 - protein, 8 aa, Influenza virus
FGAIAGFI

SEQ ID NO: 271748 - protein, 8 aa, Influenza virus
GAIAGFIE

SEQ ID NO: 271749 - protein, 8 aa, Influenza virus
AIAGFIEN

SEQ ID NO: 271750 - protein, 8 aa, Influenza virus
IAGFIENG

SEQ ID NO: 271751 - protein, 8 aa, Influenza virus
AGFIENGW

SEQ ID NO: 271752 - protein, 8 aa, Influenza virus
GFIENGWE

SEQ ID NO: 271753 - protein, 8 aa, Influenza virus
FIENGWEG

SEQ ID NO: 271754 - protein, 8 aa, Influenza virus
IENGWEGL

SEQ ID NO: 271755 - protein, 8 aa, Influenza virus
ENGWEGLI

SEQ ID NO: 271756 - protein, 8 aa, Influenza virus
NGWEGLID

SEQ ID NO: 271757 - protein, 8 aa, Influenza virus
GWEGLIDG

SEQ ID NO: 271758 - protein, 8 aa, Influenza virus
WEGLIDGW

SEQ ID NO: 271759 - protein, 8 aa, Influenza virus
EGLIDGWY

SEQ ID NO: 271760 - protein, 8 aa, Influenza virus
GLIDGWYG

SEQ ID NO: 271761 - protein, 8 aa, Influenza virus
LIDGWYGF

SEQ ID NO: 271762 - protein, 8 aa, Influenza virus
IDGWYGFR

SEQ ID NO: 271763 - protein, 8 aa, Influenza virus
DGWYGFRH

SEQ ID NO: 271764 - protein, 8 aa, Influenza virus
GWYGFRHQ

SEQ ID NO: 271765 - protein, 8 aa, Influenza virus
WYGFRHQN

SEQ ID NO: 271766 - protein, 8 aa, Influenza virus
YGFRHQNA

SEQ ID NO: 271767 - protein, 8 aa, Influenza virus
GFRHQNAQ

SEQ ID NO: 271768 - protein, 8 aa, Influenza virus
FRHQNAQG

SEQ ID NO: 271769 - protein, 8 aa, Influenza virus
RHQNAQGQ

SEQ ID NO: 271770 - protein, 8 aa, Influenza virus
HQNAQGQG

SEQ ID NO: 271771 - protein, 8 aa, Influenza virus
QNAQGQGT

SEQ ID NO: 271772 - protein, 8 aa, Influenza virus
NAQGQGTA

SEQ ID NO: 271773 - protein, 8 aa, Influenza virus
AQGQGTAA

SEQ ID NO: 271774 - protein, 8 aa, Influenza virus
QGQGTAAD

SEQ ID NO: 271775 - protein, 8 aa, Influenza virus
GQGTAADY

SEQ ID NO: 271776 - protein, 8 aa, Influenza virus
QGTAADYK

SEQ ID NO: 271777 - protein, 8 aa, Influenza virus
GTAADYKS

SEQ ID NO: 271778 - protein, 8 aa, Influenza virus
TAADYKST

SEQ ID NO: 271779 - protein, 8 aa, Influenza virus
AADYKSTQ

SEQ ID NO: 271780 - protein, 8 aa, Influenza virus
ADYKSTQA

SEQ ID NO: 271781 - protein, 8 aa, Influenza virus
DYKSTQAA

SEQ ID NO: 271782 - protein, 8 aa, Influenza virus
YKSTQAAI

SEQ ID NO: 271783 - protein, 8 aa, Influenza virus
KSTQAAID

SEQ ID NO: 271784 - protein, 8 aa, Influenza virus
STQAAIDQ

SEQ ID NO: 271785 - protein, 8 aa, Influenza virus
TQAAIDQI

SEQ ID NO: 271786 - protein, 8 aa, Influenza virus
QAAIDQIT

SEQ ID NO: 271787 - protein, 8 aa, Influenza virus
AAIDQITG

SEQ ID NO: 271788 - protein, 8 aa, Influenza virus
AIDQITGK

SEQ ID NO: 271789 - protein, 8 aa, Influenza virus
IDQITGKL

SEQ ID NO: 271790 - protein, 8 aa, Influenza virus
DQITGKLN

SEQ ID NO: 271791 - protein, 8 aa, Influenza virus
QITGKLNR

SEQ ID NO: 271792 - protein, 8 aa, Influenza virus
ITGKLNRL

SEQ ID NO: 271793 - protein, 8 aa, Influenza virus
TGKLNRLI

SEQ ID NO: 271794 - protein, 8 aa, Influenza virus
GKLNRLIE

SEQ ID NO: 271795 - protein, 8 aa, Influenza virus
KLNRLIEK

SEQ ID NO: 271796 - protein, 8 aa, Influenza virus
LNRLIEKT

SEQ ID NO: 271797 - protein, 8 aa, Influenza virus
NRLIEKTN

SEQ ID NO: 271798 - protein, 8 aa, Influenza virus
RLIEKTNK

SEQ ID NO: 271799 - protein, 8 aa, Influenza virus
LIEKTNKQ

SEQ ID NO: 271800 - protein, 8 aa, Influenza virus
IEKTNKQF

SEQ ID NO: 271801 - protein, 8 aa, Influenza virus
EKTNKQFE

SEQ ID NO: 271802 - protein, 8 aa, Influenza virus
KTNKQFEL

SEQ ID NO: 271803 - protein, 8 aa, Influenza virus
TNKQFELI

SEQ ID NO: 271804 - protein, 8 aa, Influenza virus
NKQFELID

SEQ ID NO: 271805 - protein, 8 aa, Influenza virus
KQFELIDN

SEQ ID NO: 271806 - protein, 8 aa, Influenza virus
QFELIDNE

SEQ ID NO: 271807 - protein, 8 aa, Influenza virus
FELIDNEF

SEQ ID NO: 271808 - protein, 8 aa, Influenza virus
ELIDNEFT

SEQ ID NO: 271809 - protein, 8 aa, Influenza virus
LIDNEFTE

SEQ ID NO: 271810 - protein, 8 aa, Influenza virus
IDNEFTEV

SEQ ID NO: 271811 - protein, 8 aa, Influenza virus
DNEFTEVE

SEQ ID NO: 271812 - protein, 8 aa, Influenza virus
NEFTEVEQ

SEQ ID NO: 271813 - protein, 8 aa, Influenza virus
EFTEVEQQ

SEQ ID NO: 271814 - protein, 8 aa, Influenza virus
FTEVEQQI

SEQ ID NO: 271815 - protein, 8 aa, Influenza virus
TEVEQQIG

SEQ ID NO: 271816 - protein, 8 aa, Influenza virus
EVEQQIGN

SEQ ID NO: 271817 - protein, 8 aa, Influenza virus
VEQQIGNV

SEQ ID NO: 271818 - protein, 8 aa, Influenza virus
EQQIGNVI

SEQ ID NO: 271819 - protein, 8 aa, Influenza virus
QQIGNVIN

SEQ ID NO: 271820 - protein, 8 aa, Influenza virus
QIGNVINW

SEQ ID NO: 271821 - protein, 8 aa, Influenza virus
IGNVINWT

SEQ ID NO: 271822 - protein, 8 aa, Influenza virus
GNVINWTR

SEQ ID NO: 271823 - protein, 8 aa, Influenza virus
NVINWTRD

SEQ ID NO: 271824 - protein, 8 aa, Influenza virus
VINWTRDS

SEQ ID NO: 271825 - protein, 8 aa, Influenza virus
INWTRDSL

SEQ ID NO: 271826 - protein, 8 aa, Influenza virus
NWTRDSLT

SEQ ID NO: 271827 - protein, 8 aa, Influenza virus
WTRDSLTE

SEQ ID NO: 271828 - protein, 8 aa, Influenza virus
TRDSLTEI

SEQ ID NO: 271829 - protein, 8 aa, Influenza virus
RDSLTEIW

SEQ ID NO: 271830 - protein, 8 aa, Influenza virus
DSLTEIWS

SEQ ID NO: 271831 - protein, 8 aa, Influenza virus
SLTEIWSY

SEQ ID NO: 271832 - protein, 8 aa, Influenza virus
LTEIWSYN

SEQ ID NO: 271833 - protein, 8 aa, Influenza virus
TEIWSYNA

SEQ ID NO: 271834 - protein, 8 aa, Influenza virus
EIWSYNAE

SEQ ID NO: 271835 - protein, 8 aa, Influenza virus
IWSYNAEL

SEQ ID NO: 271836 - protein, 8 aa, Influenza virus
WSYNAELL

SEQ ID NO: 271837 - protein, 8 aa, Influenza virus
SYNAELLV

SEQ ID NO: 271838 - protein, 8 aa, Influenza virus
YNAELLVA

SEQ ID NO: 271839 - protein, 8 aa, Influenza virus
NAELLVAM

SEQ ID NO: 271840 - protein, 8 aa, Influenza virus
AELLVAME

SEQ ID NO: 271841 - protein, 8 aa, Influenza virus
ELLVAMEN

SEQ ID NO: 271842 - protein, 8 aa, Influenza virus
LLVAMENQ

SEQ ID NO: 271843 - protein, 8 aa, Influenza virus
LVAMENQH

SEQ ID NO: 271844 - protein, 8 aa, Influenza virus
VAMENQHT

SEQ ID NO: 271845 - protein, 8 aa, Influenza virus
AMENQHTI

SEQ ID NO: 271846 - protein, 8 aa, Influenza virus
MENQHTID

SEQ ID NO: 271847 - protein, 8 aa, Influenza virus
ENQHTIDL

SEQ ID NO: 271848 - protein, 8 aa, Influenza virus
NQHTIDLA

SEQ ID NO: 271849 - protein, 8 aa, Influenza virus
QHTIDLAD

SEQ ID NO: 271850 - protein, 8 aa, Influenza virus
HTIDLADS

SEQ ID NO: 271851 - protein, 8 aa, Influenza virus
TIDLADSE

SEQ ID NO: 271852 - protein, 8 aa, Influenza virus
IDLADSEM

SEQ ID NO: 271853 - protein, 8 aa, Influenza virus
DLADSEMN

SEQ ID NO: 271854 - protein, 8 aa, Influenza virus
LADSEMNK

SEQ ID NO: 271855 - protein, 8 aa, Influenza virus
ADSEMNKL

SEQ ID NO: 271856 - protein, 8 aa, Influenza virus
DSEMNKLY

SEQ ID NO: 271857 - protein, 8 aa, Influenza virus
SEMNKLYE

SEQ ID NO: 271858 - protein, 8 aa, Influenza virus
EMNKLYER

SEQ ID NO: 271859 - protein, 8 aa, Influenza virus
MNKLYERV

SEQ ID NO: 271860 - protein, 8 aa, Influenza virus
NKLYERVR

SEQ ID NO: 271861 - protein, 8 aa, Influenza virus
KLYERVRR

SEQ ID NO: 271862 - protein, 8 aa, Influenza virus
LYERVRRQ

SEQ ID NO: 271863 - protein, 8 aa, Influenza virus
YERVRRQL

SEQ ID NO: 271864 - protein, 8 aa, Influenza virus
ERVRRQLR

SEQ ID NO: 271865 - protein, 8 aa, Influenza virus
RVRRQLRE

SEQ ID NO: 271866 - protein, 8 aa, Influenza virus
VRRQLREN

SEQ ID NO: 271867 - protein, 8 aa, Influenza virus
RRQLRENA

SEQ ID NO: 271868 - protein, 8 aa, Influenza virus
RQLRENAE

SEQ ID NO: 271869 - protein, 8 aa, Influenza virus
QLRENAEE

SEQ ID NO: 271870 - protein, 8 aa, Influenza virus
LRENAEED

SEQ ID NO: 271871 - protein, 8 aa, Influenza virus
RENAEEDG

SEQ ID NO: 271872 - protein, 8 aa, Influenza virus
ENAEEDGT

SEQ ID NO: 271873 - protein, 8 aa, Influenza virus
NAEEDGTG

SEQ ID NO: 271874 - protein, 8 aa, Influenza virus
AEEDGTGC

SEQ ID NO: 271875 - protein, 8 aa, Influenza virus
EEDGTGCF

SEQ ID NO: 271876 - protein, 8 aa, Influenza virus
EDGTGCFE

SEQ ID NO: 271877 - protein, 8 aa, Influenza virus
DGTGCFEI

SEQ ID NO: 271878 - protein, 8 aa, Influenza virus
GTGCFEIF

SEQ ID NO: 271879 - protein, 8 aa, Influenza virus
TGCFEIFH

SEQ ID NO: 271880 - protein, 8 aa, Influenza virus
GCFEIFHR

SEQ ID NO: 271881 - protein, 8 aa, Influenza virus
CFEIFHRC

SEQ ID NO: 271882 - protein, 8 aa, Influenza virus
FEIFHRCD

SEQ ID NO: 271883 - protein, 8 aa, Influenza virus
EIFHRCDD

SEQ ID NO: 271884 - protein, 8 aa, Influenza virus
IFHRCDDQ

SEQ ID NO: 271885 - protein, 8 aa, Influenza virus
FHRCDDQC

SEQ ID NO: 271886 - protein, 8 aa, Influenza virus
HRCDDQCM

SEQ ID NO: 271887 - protein, 8 aa, Influenza virus
RCDDQCME

SEQ ID NO: 271888 - protein, 8 aa, Influenza virus
CDDQCMES

SEQ ID NO: 271889 - protein, 8 aa, Influenza virus
DDQCMESI

SEQ ID NO: 271890 - protein, 8 aa, Influenza virus
DQCMESIR

SEQ ID NO: 271891 - protein, 8 aa, Influenza virus
QCMESIRN

SEQ ID NO: 271892 - protein, 8 aa, Influenza virus
CMESIRNN

SEQ ID NO: 271893 - protein, 8 aa, Influenza virus
MESIRNNT

SEQ ID NO: 271894 - protein, 8 aa, Influenza virus
ESIRNNTY

SEQ ID NO: 271895 - protein, 8 aa, Influenza virus
SIRNNTYN

SEQ ID NO: 271896 - protein, 8 aa, Influenza virus
IRNNTYNH

SEQ ID NO: 271897 - protein, 8 aa, Influenza virus
RNNTYNHT

SEQ ID NO: 271898 - protein, 8 aa, Influenza virus
NNTYNHTE

SEQ ID NO: 271899 - protein, 8 aa, Influenza virus
NTYNHTEY

SEQ ID NO: 271900 - protein, 8 aa, Influenza virus
TYNHTEYR

SEQ ID NO: 271901 - protein, 8 aa, Influenza virus
YNHTEYRQ

SEQ ID NO: 271902 - protein, 8 aa, Influenza virus
NHTEYRQE

SEQ ID NO: 271903 - protein, 8 aa, Influenza virus
HTEYRQEA

SEQ ID NO: 271904 - protein, 8 aa, Influenza virus
TEYRQEAL

SEQ ID NO: 271905 - protein, 8 aa, Influenza virus
EYRQEALQ

SEQ ID NO: 271906 - protein, 8 aa, Influenza virus
YRQEALQN

SEQ ID NO: 271907 - protein, 8 aa, Influenza virus
RQEALQNR

SEQ ID NO: 271908 - protein, 8 aa, Influenza virus
QEALQNRI

SEQ ID NO: 271909 - protein, 8 aa, Influenza virus
EALQNRIM

SEQ ID NO: 271910 - protein, 8 aa, Influenza virus
ALQNRIMI

SEQ ID NO: 271911 - protein, 8 aa, Influenza virus
LQNRIMIN

SEQ ID NO: 271912 - protein, 8 aa, Influenza virus
QNRIMINP

SEQ ID NO: 271913 - protein, 8 aa, Influenza virus
NRIMINPV

SEQ ID NO: 271914 - protein, 8 aa, Influenza virus
RIMINPVK

SEQ ID NO: 271915 - protein, 8 aa, Influenza virus
IMINPVKL

SEQ ID NO: 271916 - protein, 8 aa, Influenza virus
MINPVKLS

SEQ ID NO: 271917 - protein, 8 aa, Influenza virus
INPVKLSS

SEQ ID NO: 271918 - protein, 8 aa, Influenza virus
NPVKLSSG

SEQ ID NO: 271919 - protein, 8 aa, Influenza virus
PVKLSSGY

SEQ ID NO: 271920 - protein, 8 aa, Influenza virus
VKLSSGYK

SEQ ID NO: 271921 - protein, 8 aa, Influenza virus
KLSSGYKD

SEQ ID NO: 271922 - protein, 8 aa, Influenza virus
LSSGYKDV

SEQ ID NO: 271923 - protein, 8 aa, Influenza virus
SSGYKDVI

SEQ ID NO: 271924 - protein, 8 aa, Influenza virus
SGYKDVIL

SEQ ID NO: 271925 - protein, 8 aa, Influenza virus
GYKDVILW

SEQ ID NO: 271926 - protein, 8 aa, Influenza virus
YKDVILWF

SEQ ID NO: 271927 - protein, 8 aa, Influenza virus
KDVILWFS

SEQ ID NO: 271928 - protein, 8 aa, Influenza virus
DVILWFSF

SEQ ID NO: 271929 - protein, 8 aa, Influenza virus
VILWFSFG

SEQ ID NO: 271930 - protein, 8 aa, Influenza virus
ILWFSFGA

SEQ ID NO: 271931 - protein, 8 aa, Influenza virus
LWFSFGAS

SEQ ID NO: 271932 - protein, 8 aa, Influenza virus
WFSFGASC

SEQ ID NO: 271933 - protein, 8 aa, Influenza virus
FSFGASCV

SEQ ID NO: 271934 - protein, 8 aa, Influenza virus
SFGASCVM

SEQ ID NO: 271935 - protein, 8 aa, Influenza virus
FGASCVML

SEQ ID NO: 271936 - protein, 8 aa, Influenza virus
GASCVMLL

SEQ ID NO: 271937 - protein, 8 aa, Influenza virus
ASCVMLLA

SEQ ID NO: 271938 - protein, 8 aa, Influenza virus
SCVMLLAI

SEQ ID NO: 271939 - protein, 8 aa, Influenza virus
CVMLLAIA

SEQ ID NO: 271940 - protein, 8 aa, Influenza virus
VMLLAIAM

SEQ ID NO: 271941 - protein, 8 aa, Influenza virus
MLLAIAMG

SEQ ID NO: 271942 - protein, 8 aa, Influenza virus
LLAIAMGL

SEQ ID NO: 271943 - protein, 8 aa, Influenza virus
LAIAMGLI

SEQ ID NO: 271944 - protein, 8 aa, Influenza virus
AIAMGLIF

SEQ ID NO: 271945 - protein, 8 aa, Influenza virus
IAMGLIFM

SEQ ID NO: 271946 - protein, 8 aa, Influenza virus
AMGLIFMC

SEQ ID NO: 271947 - protein, 8 aa, Influenza virus
MGLIFMCV

SEQ ID NO: 271948 - protein, 8 aa, Influenza virus
GLIFMCVK

SEQ ID NO: 271949 - protein, 8 aa, Influenza virus
LIFMCVKN

SEQ ID NO: 271950 - protein, 8 aa, Influenza virus
IFMCVKNG

SEQ ID NO: 271951 - protein, 8 aa, Influenza virus
FMCVKNGN

SEQ ID NO: 271952 - protein, 8 aa, Influenza virus
MCVKNGNL

SEQ ID NO: 271953 - protein, 8 aa, Influenza virus
CVKNGNLR

SEQ ID NO: 271954 - protein, 8 aa, Influenza virus
VKNGNLRC

SEQ ID NO: 271955 - protein, 8 aa, Influenza virus
KNGNLRCT

SEQ ID NO: 271956 - protein, 8 aa, Influenza virus
NGNLRCTI

SEQ ID NO: 271957 - protein, 8 aa, Influenza virus
GNLRCTIC

SEQ ID NO: 271958 - protein, 8 aa, Influenza virus
NLRCTICI

SEQ ID NO: 271959 - protein, 8 aa, Influenza virus
QPNDGQVL

SEQ ID NO: 271960 - protein, 8 aa, Influenza virus
PNDGQVLY

SEQ ID NO: 271961 - protein, 8 aa, Influenza virus
GRYSKADK

SEQ ID NO: 271962 - protein, 8 aa, Influenza virus
RYSKADKI

SEQ ID NO: 271963 - protein, 8 aa, Influenza virus
YSKADKIC

SEQ ID NO: 271964 - protein, 8 aa, Influenza virus
SKADKICI

SEQ ID NO: 271965 - protein, 8 aa, Influenza virus
KADKICIG

SEQ ID NO: 271966 - protein, 8 aa, Influenza virus
ADKICIGY

SEQ ID NO: 271967 - protein, 8 aa, Influenza virus
DKICIGYL

SEQ ID NO: 271968 - protein, 8 aa, Influenza virus
KICIGYLS

SEQ ID NO: 271969 - protein, 8 aa, Influenza virus
ICIGYLSN

SEQ ID NO: 271970 - protein, 8 aa, Influenza virus
CIGYLSNN

SEQ ID NO: 271971 - protein, 8 aa, Influenza virus
IGYLSNNS

SEQ ID NO: 271972 - protein, 8 aa, Influenza virus
GYLSNNSS

SEQ ID NO: 271973 - protein, 8 aa, Influenza virus
YLSNNSSD

SEQ ID NO: 271974 - protein, 8 aa, Influenza virus
LSNNSSDT

SEQ ID NO: 271975 - protein, 8 aa, Influenza virus
SNNSSDTV

SEQ ID NO: 271976 - protein, 8 aa, Influenza virus
NNSSDTVD

SEQ ID NO: 271977 - protein, 8 aa, Influenza virus
NSSDTVDT

SEQ ID NO: 271978 - protein, 8 aa, Influenza virus
SSDTVDTL

SEQ ID NO: 271979 - protein, 8 aa, Influenza virus
SDTVDTLT

SEQ ID NO: 271980 - protein, 8 aa, Influenza virus
DTVDTLTE

SEQ ID NO: 271981 - protein, 8 aa, Influenza virus
TVDTLTEN

SEQ ID NO: 271982 - protein, 8 aa, Influenza virus
VDTLTENG

SEQ ID NO: 271983 - protein, 8 aa, Influenza virus
DTLTENGV

SEQ ID NO: 271984 - protein, 8 aa, Influenza virus
TLTENGVP

SEQ ID NO: 271985 - protein, 8 aa, Influenza virus
LTENGVPV

SEQ ID NO: 271986 - protein, 8 aa, Influenza virus
TENGVPVT

SEQ ID NO: 271987 - protein, 8 aa, Influenza virus
ENGVPVTS

SEQ ID NO: 271988 - protein, 8 aa, Influenza virus
NGVPVTSS

SEQ ID NO: 271989 - protein, 8 aa, Influenza virus
GVPVTSSV

SEQ ID NO: 271990 - protein, 8 aa, Influenza virus
VPVTSSVD

SEQ ID NO: 271991 - protein, 8 aa, Influenza virus
PVTSSVDL

SEQ ID NO: 271992 - protein, 8 aa, Influenza virus
VTSSVDLV

SEQ ID NO: 271993 - protein, 8 aa, Influenza virus
TSSVDLVE

SEQ ID NO: 271994 - protein, 8 aa, Influenza virus
SSVDLVET

SEQ ID NO: 271995 - protein, 8 aa, Influenza virus
SVDLVETN

SEQ ID NO: 271996 - protein, 8 aa, Influenza virus
VDLVETNH

SEQ ID NO: 271997 - protein, 8 aa, Influenza virus
DLVETNHT

SEQ ID NO: 271998 - protein, 8 aa, Influenza virus
LVETNHTG

SEQ ID NO: 271999 - protein, 8 aa, Influenza virus
VETNHTGT

SEQ ID NO: 272000 - protein, 8 aa, Influenza virus
ETNHTGTY

SEQ ID NO: 272001 - protein, 8 aa, Influenza virus
TNHTGTYC

SEQ ID NO: 272002 - protein, 8 aa, Influenza virus
NHTGTYCS

SEQ ID NO: 272003 - protein, 8 aa, Influenza virus
HTGTYCSL

SEQ ID NO: 272004 - protein, 8 aa, Influenza virus
TGTYCSLN

SEQ ID NO: 272005 - protein, 8 aa, Influenza virus
GTYCSLNG

SEQ ID NO: 272006 - protein, 8 aa, Influenza virus
TYCSLNGV

SEQ ID NO: 272007 - protein, 8 aa, Influenza virus
YCSLNGVS

SEQ ID NO: 272008 - protein, 8 aa, Influenza virus
CSLNGVSP

SEQ ID NO: 272009 - protein, 8 aa, Influenza virus
SLNGVSPI

SEQ ID NO: 272010 - protein, 8 aa, Influenza virus
LNGVSPIH

SEQ ID NO: 272011 - protein, 8 aa, Influenza virus
NGVSPIHL

SEQ ID NO: 272012 - protein, 8 aa, Influenza virus
GVSPIHLG

SEQ ID NO: 272013 - protein, 8 aa, Influenza virus
VSPIHLGD

SEQ ID NO: 272014 - protein, 8 aa, Influenza virus
SPIHLGDC

SEQ ID NO: 272015 - protein, 8 aa, Influenza virus
PIHLGDCS

SEQ ID NO: 272016 - protein, 8 aa, Influenza virus
IHLGDCSF

SEQ ID NO: 272017 - protein, 8 aa, Influenza virus
HLGDCSFE

SEQ ID NO: 272018 - protein, 8 aa, Influenza virus
LGDCSFEG

SEQ ID NO: 272019 - protein, 8 aa, Influenza virus
GDCSFEGW

SEQ ID NO: 272020 - protein, 8 aa, Influenza virus
DCSFEGWI

SEQ ID NO: 272021 - protein, 8 aa, Influenza virus
CSFEGWIV

SEQ ID NO: 272022 - protein, 8 aa, Influenza virus
SFEGWIVG

SEQ ID NO: 272023 - protein, 8 aa, Influenza virus
FEGWIVGN

SEQ ID NO: 272024 - protein, 8 aa, Influenza virus
EGWIVGNP

SEQ ID NO: 272025 - protein, 8 aa, Influenza virus
GWIVGNPS

SEQ ID NO: 272026 - protein, 8 aa, Influenza virus
WIVGNPSC

SEQ ID NO: 272027 - protein, 8 aa, Influenza virus
IVGNPSCA

SEQ ID NO: 272028 - protein, 8 aa, Influenza virus
VGNPSCAT

SEQ ID NO: 272029 - protein, 8 aa, Influenza virus
GNPSCATN

SEQ ID NO: 272030 - protein, 8 aa, Influenza virus
NPSCATNI

SEQ ID NO: 272031 - protein, 8 aa, Influenza virus
PSCATNIN

SEQ ID NO: 272032 - protein, 8 aa, Influenza virus
SCATNINI

SEQ ID NO: 272033 - protein, 8 aa, Influenza virus
CATNINIR

SEQ ID NO: 272034 - protein, 8 aa, Influenza virus
ATNINIRE

SEQ ID NO: 272035 - protein, 8 aa, Influenza virus
TNINIREW

SEQ ID NO: 272036 - protein, 8 aa, Influenza virus
NINIREWS

SEQ ID NO: 272037 - protein, 8 aa, Influenza virus
INIREWSY

SEQ ID NO: 272038 - protein, 8 aa, Influenza virus
NIREWSYL

SEQ ID NO: 272039 - protein, 8 aa, Influenza virus
IREWSYLI

SEQ ID NO: 272040 - protein, 8 aa, Influenza virus
REWSYLIE

SEQ ID NO: 272041 - protein, 8 aa, Influenza virus
EWSYLIED

SEQ ID NO: 272042 - protein, 8 aa, Influenza virus
WSYLIEDP

SEQ ID NO: 272043 - protein, 8 aa, Influenza virus
SYLIEDPN

SEQ ID NO: 272044 - protein, 8 aa, Influenza virus
YLIEDPNA

SEQ ID NO: 272045 - protein, 8 aa, Influenza virus
LIEDPNAP

SEQ ID NO: 272046 - protein, 8 aa, Influenza virus
IEDPNAPN

SEQ ID NO: 272047 - protein, 8 aa, Influenza virus
EDPNAPNK

SEQ ID NO: 272048 - protein, 8 aa, Influenza virus
DPNAPNKL

SEQ ID NO: 272049 - protein, 8 aa, Influenza virus
PNAPNKLC

SEQ ID NO: 272050 - protein, 8 aa, Influenza virus
NAPHKLCF

SEQ ID NO: 272051 - protein, 8 aa, Influenza virus
APNKLCFP

SEQ ID NO: 272052 - protein, 8 aa, Influenza virus
PHKLCFPG

SEQ ID NO: 272053 - protein, 8 aa, Influenza virus
NKLCFPGE

SEQ ID NO: 272054 - protein, 8 aa, Influenza virus
KLCFPGEL

SEQ ID NO: 272055 - protein, 8 aa, Influenza virus
LCFPGELD

SEQ ID NO: 272056 - protein, 8 aa, Influenza virus
CFPGELDN

SEQ ID NO: 272057 - protein, 8 aa, Influenza virus
FPGELDNN

SEQ ID NO: 272058 - protein, 8 aa, Influenza virus
PGELDNNG

SEQ ID NO: 272059 - protein, 8 aa, Influenza virus
GELDNNGE

SEQ ID NO: 272060 - protein, 8 aa, Influenza virus
ELDNNGEL

SEQ ID NO: 272061 - protein, 8 aa, Influenza virus
LDNNGELR

SEQ ID NO: 272062 - protein, 8 aa, Influenza virus
DNNGELRH

SEQ ID NO: 272063 - protein, 8 aa, Influenza virus
NNGELRHL

SEQ ID NO: 272064 - protein, 8 aa, Influenza virus
NGELRHLF

SEQ ID NO: 272065 - protein, 8 aa, Influenza virus
GELRHLFS

SEQ ID NO: 272066 - protein, 8 aa, Influenza virus
ELRHLFSG

SEQ ID NO: 272067 - protein, 8 aa, Influenza virus
LRHLFSGV

SEQ ID NO: 272068 - protein, 8 aa, Influenza virus
RHLFSGVN

SEQ ID NO: 272069 - protein, 8 aa, Influenza virus
HLFSGVNS

SEQ ID NO: 272070 - protein, 8 aa, Influenza virus
LFSGVNSF

SEQ ID NO: 272071 - protein, 8 aa, Influenza virus
FSGVNSFS

SEQ ID NO: 272072 - protein, 8 aa, Influenza virus
SGVNSFSR

SEQ ID NO: 272073 - protein, 8 aa, Influenza virus
GVNSFSRT

SEQ ID NO: 272074 - protein, 8 aa, Influenza virus
VNSFSRTE

SEQ ID NO: 272075 - protein, 8 aa, Influenza virus
NSFSRTEL

SEQ ID NO: 272076 - protein, 8 aa, Influenza virus
SFSRTELI

SEQ ID NO: 272077 - protein, 8 aa, Influenza virus
FSRTELIS

SEQ ID NO: 272078 - protein, 8 aa, Influenza virus
SRTELISP

SEQ ID NO: 272079 - protein, 8 aa, Influenza virus
RTELISPS

SEQ ID NO: 272080 - protein, 8 aa, Influenza virus
TELISPSK

SEQ ID NO: 272081 - protein, 8 aa, Influenza virus
ELISPSKW

SEQ ID NO: 272082 - protein, 8 aa, Influenza virus
LISPSKWG

SEQ ID NO: 272083 - protein, 8 aa, Influenza virus
PSKWGNVL

SEQ ID NO: 272084 - protein, 8 aa, Influenza virus
SKWGNVLD

SEQ ID NO: 272085 - protein, 8 aa, Influenza virus
KWGNVLDG

SEQ ID NO: 272086 - protein, 8 aa, Influenza virus
WGNVLDGV

SEQ ID NO: 272087 - protein, 8 aa, Influenza virus
GNVLDGVT

SEQ ID NO: 272088 - protein, 8 aa, Influenza virus
NVLDGVTA

SEQ ID NO: 272089 - protein, 8 aa, Influenza virus
VLDGVTAS

SEQ ID NO: 272090 - protein, 8 aa, Influenza virus
LDGVTASC

SEQ ID NO: 272091 - protein, 8 aa, Influenza virus
DGVTASCL

SEQ ID NO: 272092 - protein, 8 aa, Influenza virus
GVTASCLD

SEQ ID NO: 272093 - protein, 8 aa, Influenza virus
VTASCLDR

SEQ ID NO: 272094 - protein, 8 aa, Influenza virus
TASCLDRG

SEQ ID NO: 272095 - protein, 8 aa, Influenza virus
ASCLDRGA

SEQ ID NO: 272096 - protein, 8 aa, Influenza virus
GASSFYRN

SEQ ID NO: 272097 - protein, 8 aa, Influenza virus
ASSFYRNL

SEQ ID NO: 272098 - protein, 8 aa, Influenza virus
SSFYRNLV

SEQ ID NO: 272099 - protein, 8 aa, Influenza virus
SFYRNLVW

SEQ ID NO: 272100 - protein, 8 aa, Influenza virus
FYRNLVWL

SEQ ID NO: 272101 - protein, 8 aa, Influenza virus
YRNLVWLV

SEQ ID NO: 272102 - protein, 8 aa, Influenza virus
RNLVWLVK

SEQ ID NO: 272103 - protein, 8 aa, Influenza virus
IGEYPVVK

SEQ ID NO: 272104 - protein, 8 aa, Influenza virus
VKGDYNNT

SEQ ID NO: 272105 - protein, 8 aa, Influenza virus
KGDYNNTT

SEQ ID NO: 272106 - protein, 8 aa, Influenza virus
GDYNNTTG

SEQ ID NO: 272107 - protein, 8 aa, Influenza virus
DYNNTTGR

SEQ ID NO: 272108 - protein, 8 aa, Influenza virus
YNNTTGRD

SEQ ID NO: 272109 - protein, 8 aa, Influenza virus
NNTTGRDV

SEQ ID NO: 272110 - protein, 8 aa, Influenza virus
NTTGRDVL

SEQ ID NO: 272111 - protein, 8 aa, Influenza virus
TTGRDVLV

SEQ ID NO: 272112 - protein, 8 aa, Influenza virus
TGRDVLVL

SEQ ID NO: 272113 - protein, 8 aa, Influenza virus
GRDVLVLW

SEQ ID NO: 272114 - protein, 8 aa, Influenza virus
RDVLVLWG

SEQ ID NO: 272115 - protein, 8 aa, Influenza virus
DVLVLWGI

SEQ ID NO: 272116 - protein, 8 aa, Influenza virus
VLVLWGIH

SEQ ID NO: 272117 - protein, 8 aa, Influenza virus
LVLWGIHH

SEQ ID NO: 272118 - protein, 8 aa, Influenza virus
VLWGIHHP

SEQ ID NO: 272119 - protein, 8 aa, Influenza virus
LWGIHHPD

SEQ ID NO: 272120 - protein, 8 aa, Influenza virus
WGIHHPDT

SEQ ID NO: 272121 - protein, 8 aa, Influenza virus
GIHHPDTE

SEQ ID NO: 272122 - protein, 8 aa, Influenza virus
IHHPDTEA

SEQ ID NO: 272123 - protein, 8 aa, Influenza virus
HHPDTETT

SEQ ID NO: 272124 - protein, 8 aa, Influenza virus
HPDTETTA

SEQ ID NO: 272125 - protein, 8 aa, Influenza virus
ATNLYVNK

SEQ ID NO: 272126 - protein, 8 aa, Influenza virus
TNLYVNKN

SEQ ID NO: 272127 - protein, 8 aa, Influenza virus
KLYVNKNP

SEQ ID NO: 272128 - protein, 8 aa, Influenza virus
LYVNKNPY

SEQ ID NO: 272129 - protein, 8 aa, Influenza virus
YVNKNPYT

SEQ ID NO: 272130 - protein, 8 aa, Influenza virus
VNKNPYTL

SEQ ID NO: 272131 - protein, 8 aa, Influenza virus
NKNPYTLV

SEQ ID NO: 272132 - protein, 8 aa, Influenza virus
KNPYTLVS

SEQ ID NO: 272133 - protein, 8 aa, Influenza virus
NPYTLVST

SEQ ID NO: 272134 - protein, 8 aa, Influenza virus
PYTLVSTK

SEQ ID NO: 272135 - protein, 8 aa, Influenza virus
YTLVSTKE

SEQ ID NO: 272136 - protein, 8 aa, Influenza virus
TLVSTKEW

SEQ ID NO: 272137 - protein, 8 aa, Influenza virus
LVSTKEWS

SEQ ID NO: 272138 - protein, 8 aa, Influenza virus
VSTKEWSK

SEQ ID NO: 272139 - protein, 8 aa, Influenza virus
STKEWSKR

SEQ ID NO: 272140 - protein, 8 aa, Influenza virus
TKEWSKRY

SEQ ID NO: 272141 - protein, 8 aa, Influenza virus
KEWSKRYE

SEQ ID NO: 272142 - protein, 8 aa, Influenza virus
EWSKRYEL

SEQ ID NO: 272143 - protein, 8 aa, Influenza virus
WSKRYELE

SEQ ID NO: 272144 - protein, 8 aa, Influenza virus
SKRYELEI

SEQ ID NO: 272145 - protein, 8 aa, Influenza virus
KRYELEIG

SEQ ID NO: 272146 - protein, 8 aa, Influenza virus
RYELEIGT

SEQ ID NO: 272147 - protein, 8 aa, Influenza virus
YELEIGTR

SEQ ID NO: 272148 - protein, 8 aa, Influenza virus
ELEIGTRI

SEQ ID NO: 272149 - protein, 8 aa, Influenza virus
LEIGTRIG

SEQ ID NO: 272150 - protein, 8 aa, Influenza virus
EIGTRIGD

SEQ ID NO: 272151 - protein, 8 aa, Influenza virus
IGTRIGDG

SEQ ID NO: 272152 - protein, 8 aa, Influenza virus
GTRIGDGQ

SEQ ID NO: 272153 - protein, 8 aa, Influenza virus
TRIGDGQR

SEQ ID NO: 272154 - protein, 8 aa, Influenza virus
RIGDGQRS

SEQ ID NO: 272155 - protein, 8 aa, Influenza virus
IGDGQRSW

SEQ ID NO: 272156 - protein, 8 aa, Influenza virus
GDGQRSWM

SEQ ID NO: 272157 - protein, 8 aa, Influenza virus
DGQRSWMK

SEQ ID NO: 272158 - protein, 8 aa, Influenza virus
GQRSWMKL

SEQ ID NO: 272159 - protein, 8 aa, Influenza virus
QRSWMKLY

SEQ ID NO: 272160 - protein, 8 aa, Influenza virus
RSWMKLYW

SEQ ID NO: 272161 - protein, 8 aa, Influenza virus
SWMKLYWH

SEQ ID NO: 272162 - protein, 8 aa, Influenza virus
WMKLYWHL

SEQ ID NO: 272163 - protein, 8 aa, Influenza virus
MKLYWHLM

SEQ ID NO: 272164 - protein, 8 aa, Influenza virus
KIYWHLMH

SEQ ID NO: 272165 - protein, 8 aa, Influenza virus
IYWHLMHP

SEQ ID NO: 272166 - protein, 8 aa, Influenza virus
YWHLMHPG

SEQ ID NO: 272167 - protein, 8 aa, Influenza virus
WHLMHPGE

SEQ ID NO: 272168 - protein, 8 aa, Influenza virus
HLMHPGER

SEQ ID NO: 272169 - protein, 8 aa, Influenza virus
LMHPGERI

SEQ ID NO: 272170 - protein, 8 aa, Influenza virus
PGERITFE

SEQ ID NO: 272171 - protein, 8 aa, Influenza virus
GERITFES

SEQ ID NO: 272172 - protein, 8 aa, Influenza virus
ERITFESN

SEQ ID NO: 272173 - protein, 8 aa, Influenza virus
RITFESNG

SEQ ID NO: 272174 - protein, 8 aa, Influenza virus
ITFESNGG

SEQ ID NO: 272175 - protein, 8 aa, Influenza virus
TFESNGGL

SEQ ID NO: 272176 - protein, 8 aa, Influenza virus
FESNGGLL

SEQ ID NO: 272177 - protein, 8 aa, Influenza virus
ESNGGLLA

SEQ ID NO: 272178 - protein, 8 aa, Influenza virus
SNGGLLAP

SEQ ID NO: 272179 - protein, 8 aa, Influenza virus
NGGLLAPR

SEQ ID NO: 272180 - protein, 8 aa, Influenza virus
GGLLAPRY

SEQ ID NO: 272181 - protein, 8 aa, Influenza virus
GLLAPRYG

SEQ ID NO: 272182 - protein, 8 aa, Influenza virus
LLAPRYGY

SEQ ID NO: 272183 - protein, 8 aa, Influenza virus
LAPRYGYI

SEQ ID NO: 272184 - protein, 8 aa, Influenza virus
APRYGYII

SEQ ID NO: 272185 - protein, 8 aa, Influenza virus
PRYGYIIE

SEQ ID NO: 272186 - protein, 8 aa, Influenza virus
RYGYIIEK

SEQ ID NO: 272187 - protein, 8 aa, Influenza virus
YGYIIEKY

SEQ ID NO: 272188 - protein, 8 aa, Influenza virus
GYIIEKYG

SEQ ID NO: 272189 - protein, 8 aa, Influenza virus
YIIEKYGT

SEQ ID NO: 272190 - protein, 8 aa, Influenza virus
IIEKYGTG

SEQ ID NO: 272191 - protein, 8 aa, Influenza virus
IEKYGTGR

SEQ ID NO: 272192 - protein, 8 aa, Influenza virus
EKYGTGRI

SEQ ID NO: 272193 - protein, 8 aa, Influenza virus
KYGTGRIF

SEQ ID NO: 272194 - protein, 8 aa, Influenza virus
YGTGRIFQ

SEQ ID NO: 272195 - protein, 8 aa, Influenza virus
GTGRIFQS

SEQ ID NO: 272196 - protein, 8 aa, Influenza virus
TGRIFQSG

SEQ ID NO: 272197 - protein, 8 aa, Influenza virus
GRIFQSGV

SEQ ID NO: 272198 - protein, 8 aa, Influenza virus
RIFQSGVR

SEQ ID NO: 272199 - protein, 8 aa, Influenza virus
IFQSGVRM

SEQ ID NO: 272200 - protein, 8 aa, Influenza virus
FQSGVRMA

SEQ ID NO: 272201 - protein, 8 aa, Influenza virus
RMAKCNTK

SEQ ID NO: 272202 - protein, 8 aa, Influenza virus
MAKCNTKC

SEQ ID NO: 272203 - protein, 8 aa, Influenza virus
AKCNTKCQ

SEQ ID NO: 272204 - protein, 8 aa, Influenza virus
KCNTKCQT

SEQ ID NO: 272205 - protein, 8 aa, Influenza virus
CNTKCQTS

SEQ ID NO: 272206 - protein, 8 aa, Influenza virus
NTKCQTSM

SEQ ID NO: 272207 - protein, 8 aa, Influenza virus
TKCQTSMG

SEQ ID NO: 272208 - protein, 8 aa, Influenza virus
KCQTSMGG

SEQ ID NO: 272209 - protein, 8 aa, Influenza virus
CQTSVGGI

SEQ ID NO: 272210 - protein, 8 aa, Influenza virus
GGINTNKT

SEQ ID NO: 272211 - protein, 8 aa, Influenza virus
GINTNKTF

SEQ ID NO: 272212 - protein, 8 aa, Influenza virus
INTNKTFQ

SEQ ID NO: 272213 - protein, 8 aa, Influenza virus
NTNKTFQN

SEQ ID NO: 272214 - protein, 8 aa, Influenza virus
TNKTFQNI

SEQ ID NO: 272215 - protein, 8 aa, Influenza virus
NKTFQNIE

SEQ ID NO: 272216 - protein, 8 aa, Influenza virus
KTFQNIER

SEQ ID NO: 272217 - protein, 8 aa, Influenza virus
TFQNIERN

SEQ ID NO: 272218 - protein, 8 aa, Influenza virus
FQNIERNA

SEQ ID NO: 272219 - protein, 8 aa, Influenza virus
QNIERNAL

SEQ ID NO: 272220 - protein, 8 aa, Influenza virus
NIERNALG

SEQ ID NO: 272221 - protein, 8 aa, Influenza virus
IERNALGD

SEQ ID NO: 272222 - protein, 8 aa, Influenza virus
ERNALGDC

SEQ ID NO: 272223 - protein, 8 aa, Influenza virus
RNALGDCP

SEQ ID NO: 272224 - protein, 8 aa, Influenza virus
NALGDCPK

SEQ ID NO: 272225 - protein, 8 aa, Influenza virus
ALGDCPKY

SEQ ID NO: 272226 - protein, 8 aa, Influenza virus
LGDCPKYI

SEQ ID NO: 272227 - protein, 8 aa, Influenza virus
GDCPKYIK

SEQ ID NO: 272228 - protein, 8 aa, Influenza virus
DCPKYIKS

SEQ ID NO: 272229 - protein, 8 aa, Influenza virus
CPKYIKSG

SEQ ID NO: 272230 - protein, 8 aa, Influenza virus
PKYIKSGQ

SEQ ID NO: 272231 - protein, 8 aa, Influenza virus
KYIKSGQL

SEQ ID NO: 272232 - protein, 8 aa, Influenza virus
YIKSGQLK

SEQ ID NO: 272233 - protein, 8 aa, Influenza virus
IKSGQLKL

SEQ ID NO: 272234 - protein, 8 aa, Influenza virus
KSGQLKLA

SEQ ID NO: 272235 - protein, 8 aa, Influenza virus
SGQLKLAT

SEQ ID NO: 272236 - protein, 8 aa, Influenza virus
GQLKLATG

SEQ ID NO: 272237 - protein, 8 aa, Influenza virus
QLKLATGL

SEQ ID NO: 272238 - protein, 8 aa, Influenza virus
LKLATGLR

SEQ ID NO: 272239 - protein, 8 aa, Influenza virus
KLATGLRN

SEQ ID NO: 272240 - protein, 8 aa, Influenza virus
LATGLRNV

SEQ ID NO: 272241 - protein, 8 aa, Influenza virus
ATGLRNVP

SEQ ID NO: 272242 - protein, 8 aa, Influenza virus
TGLRNVPS

SEQ ID NO: 272243 - protein, 8 aa, Influenza virus
GLRNVPSI

SEQ ID NO: 272244 - protein, 8 aa, Influenza virus
IPIGERGL

SEQ ID NO: 272245 - protein, 8 aa, Influenza virus
GERGLFGA

SEQ ID NO: 272246 - protein, 8 aa, Influenza virus
ERGLFGAI

SEQ ID NO: 272247 - protein, 8 aa, Influenza virus
RGLFGAIA

SEQ ID NO: 272248 - protein, 8 aa, Influenza virus
GLFGAIAG

SEQ ID NO: 272249 - protein, 8 aa, Influenza virus
LFGAIAGF

SEQ ID NO: 272250 - protein, 8 aa, Influenza virus
FGAIAGFI

SEQ ID NO: 272251 - protein, 8 aa, Influenza virus
GAIAGFIE

SEQ ID NO: 272252 - protein, 8 aa, Influenza virus
AIAGFIEG

SEQ ID NO: 272253 - protein, 8 aa, Influenza virus
IAGFIEGG

SEQ ID NO: 272254 - protein, 8 aa, Influenza virus
AGFIEGGW

SEQ ID NO: 272255 - protein, 8 aa, Influenza virus
GFIEGGWP

SEQ ID NO: 272256 - protein, 8 aa, Influenza virus
FIEGGWPG

SEQ ID NO: 272257 - protein, 8 aa, Influenza virus
IEGGWPGL

SEQ ID NO: 272258 - protein, 8 aa, Influenza virus
EGGWPGLI

SEQ ID NO: 272259 - protein, 8 aa, Influenza virus
GGWPGLIN

SEQ ID NO: 272260 - protein, 8 aa, Influenza virus
GWPGLING

SEQ ID NO: 272261 - protein, 8 aa, Influenza virus
WPGLINGW

SEQ ID NO: 272262 - protein, 8 aa, Influenza virus
PGLINGWY

SEQ ID NO: 272263 - protein, 8 aa, Influenza virus
GLINGWYG

SEQ ID NO: 272264 - protein, 8 aa, Influenza virus
LINGWYGF

SEQ ID NO: 272265 - protein, 8 aa, Influenza virus
INGWYGFQ

SEQ ID NO: 272266 - protein, 8 aa, Influenza virus
NGWYGFQH

SEQ ID NO: 272267 - protein, 8 aa, Influenza virus
GWYGFQHQ

SEQ ID NO: 272268 - protein, 8 aa, Influenza virus
WYGFQHQN

SEQ ID NO: 272269 - protein, 8 aa, Influenza virus
YGFQHQNE

SEQ ID NO: 272270 - protein, 8 aa, Influenza virus
GFQHQNEQ

SEQ ID NO: 272271 - protein, 8 aa, Influenza virus
FQHQNEQG

SEQ ID NO: 272272 - protein, 8 aa, Influenza virus
QHQNEQGT

SEQ ID NO: 272273 - protein, 8 aa, Influenza virus
HQNEQGTG

SEQ ID NO: 272274 - protein, 8 aa, Influenza virus
QNEQGTGI

SEQ ID NO: 272275 - protein, 8 aa, Influenza virus
NEQGTGIA

SEQ ID NO: 272276 - protein, 8 aa, Influenza virus
EQGTGIAA

SEQ ID NO: 272277 - protein, 8 aa, Influenza virus
QGTGIAAD

SEQ ID NO: 272278 - protein, 8 aa, Influenza virus
GTGIAADK

SEQ ID NO: 272279 - protein, 8 aa, Influenza virus
TGIAADKA

SEQ ID NO: 272280 - protein, 8 aa, Influenza virus
GIAADKAS

SEQ ID NO: 272281 - protein, 8 aa, Influenza virus
IAADKAST

SEQ ID NO: 272282 - protein, 8 aa, Influenza virus
AADKASTQ

SEQ ID NO: 272283 - protein, 8 aa, Influenza virus
ADKASTQK

SEQ ID NO: 272284 - protein, 8 aa, Influenza virus
DKASTQKA

SEQ ID NO: 272285 - protein, 8 aa, Influenza virus
KASTQKAI

SEQ ID NO: 272286 - protein, 8 aa, Influenza virus
ASTQKAID

SEQ ID NO: 272287 - protein, 8 aa, Influenza virus
STQKAINE

SEQ ID NO: 272288 - protein, 8 aa, Influenza virus
TQKAINEI

SEQ ID NO: 272289 - protein, 8 aa, Influenza virus
QKAINEIT

SEQ ID NO: 272290 - protein, 8 aa, Influenza virus
KAINEITT

SEQ ID NO: 272291 - protein, 8 aa, Influenza virus
AINEITTK

SEQ ID NO: 272292 - protein, 8 aa, Influenza virus
INEITTKI

SEQ ID NO: 272293 - protein, 8 aa, Influenza virus
NEITTKIN

SEQ ID NO: 272294 - protein, 8 aa, Influenza virus
EITTKINN

SEQ ID NO: 272295 - protein, 8 aa, Influenza virus
ITTKINNI

SEQ ID NO: 272296 - protein, 8 aa, Influenza virus
TTKINNII

SEQ ID NO: 272297 - protein, 8 aa, Influenza virus
TKINNIIE

SEQ ID NO: 272298 - protein, 8 aa, Influenza virus
KINNIIEK

SEQ ID NO: 272299 - protein, 8 aa, Influenza virus
INNIIEKM

SEQ ID NO: 272300 - protein, 8 aa, Influenza virus
NNIIEKMN

SEQ ID NO: 272301 - protein, 8 aa, Influenza virus
NIIEKMNG

SEQ ID NO: 272302 - protein, 8 aa, Influenza virus
IIEKMNGN

SEQ ID NO: 272303 - protein, 8 aa, Influenza virus
IEKMNGNY

SEQ ID NO: 272304 - protein, 8 aa, Influenza virus
EKMNGNYD

SEQ ID NO: 272305 - protein, 8 aa, Influenza virus
KMNGNYDS

SEQ ID NO: 272306 - protein, 8 aa, Influenza virus
MNGNYDSI

SEQ ID NO: 272307 - protein, 8 aa, Influenza virus
NGNYDSIR

SEQ ID NO: 272308 - protein, 8 aa, Influenza virus
GNYDSIRG

SEQ ID NO: 272309 - protein, 8 aa, Influenza virus
NYDSIRGE

SEQ ID NO: 272310 - protein, 8 aa, Influenza virus
YDSIRGEF

SEQ ID NO: 272311 - protein, 8 aa, Influenza virus
DSIRGEFN

SEQ ID NO: 272312 - protein, 8 aa, Influenza virus
SIRGEFNQ

SEQ ID NO: 272313 - protein, 8 aa, Influenza virus
IRGEFNQV

SEQ ID NO: 272314 - protein, 8 aa, Influenza virus
RGEFNQVE

SEQ ID NO: 272315 - protein, 8 aa, Influenza virus
GEFNQVEK

SEQ ID NO: 272316 - protein, 8 aa, Influenza virus
EFNQVEKR

SEQ ID NO: 272317 - protein, 8 aa, Influenza virus
FNQVEKRI

SEQ ID NO: 272318 - protein, 8 aa, Influenza virus
NQVEKRIN

SEQ ID NO: 272319 - protein, 8 aa, Influenza virus
QVEKRINM

SEQ ID NO: 272320 - protein, 8 aa, Influenza virus
VEKRINML

SEQ ID NO: 272321 - protein, 8 aa, Influenza virus
EKRINMLA

SEQ ID NO: 272322 - protein, 8 aa, Influenza virus
KRINMLAD

SEQ ID NO: 272323 - protein, 8 aa, Influenza virus
RINMLADR

SEQ ID NO: 272324 - protein, 8 aa, Influenza virus
INMLADRV

SEQ ID NO: 272325 - protein, 8 aa, Influenza virus
NMLADRVD

SEQ ID NO: 272326 - protein, 8 aa, Influenza virus
MLADRVDD

SEQ ID NO: 272327 - protein, 8 aa, Influenza virus
LADRVDDA

SEQ ID NO: 272328 - protein, 8 aa, Influenza virus
ADRVDDAV

SEQ ID NO: 272329 - protein, 8 aa, Influenza virus
DRVDDAVT

SEQ ID NO: 272330 - protein, 8 aa, Influenza virus
RVDDAVTD

SEQ ID NO: 272331 - protein, 8 aa, Influenza virus
VDDAVTDI

SEQ ID NO: 272332 - protein, 8 aa, Influenza virus
DDAVTDIW

SEQ ID NO: 272333 - protein, 8 aa, Influenza virus
DAVTDIWS

SEQ ID NO: 272334 - protein, 8 aa, Influenza virus
AVTDIWSY

SEQ ID NO: 272335 - protein, 8 aa, Influenza virus
VTDIWSYN

SEQ ID NO: 272336 - protein, 8 aa, Influenza virus
TDIWSYNA

SEQ ID NO: 272337 - protein, 8 aa, Influenza virus
DIWSYNAK

SEQ ID NO: 272338 - protein, 8 aa, Influenza virus
IWSYNAKL

SEQ ID NO: 272339 - protein, 8 aa, Influenza virus
WSYNAKLL

SEQ ID NO: 272340 - protein, 8 aa, Influenza virus
SYNAKLLV

SEQ ID NO: 272341 - protein, 8 aa, Influenza virus
YNAKLLVL

SEQ ID NO: 272342 - protein, 8 aa, Influenza virus
NAKLLVLI

SEQ ID NO: 272343 - protein, 8 aa, Influenza virus
AKLLVLIE

SEQ ID NO: 272344 - protein, 8 aa, Influenza virus
KLLVLIEN

SEQ ID NO: 272345 - protein, 8 aa, Influenza virus
LLVLIEND

SEQ ID NO: 272346 - protein, 8 aa, Influenza virus
LVLIENDR

SEQ ID NO: 272347 - protein, 8 aa, Influenza virus
VLIENDRT

SEQ ID NO: 272348 - protein, 8 aa, Influenza virus
LIENDRTL

SEQ ID NO: 272349 - protein, 8 aa, Influenza virus
IENDRTLD

SEQ ID NO: 272350 - protein, 8 aa, Influenza virus
ENDRTLDL

SEQ ID NO: 272351 - protein, 8 aa, Influenza virus
NDRTLDLH

SEQ ID NO: 272352 - protein, 8 aa, Influenza virus
DRTLDLHD

SEQ ID NO: 272353 - protein, 8 aa, Influenza virus
RTLDLHDA

SEQ ID NO: 272354 - protein, 8 aa, Influenza virus
TLDLHDAN

SEQ ID NO: 272355 - protein, 8 aa, Influenza virus
LDLHDANV

SEQ ID NO: 272356 - protein, 8 aa, Influenza virus
DLHDANVR

SEQ ID NO: 272357 - protein, 8 aa, Influenza virus
LHDANVRN

SEQ ID NO: 272358 - protein, 8 aa, Influenza virus
HDANVRNL

SEQ ID NO: 272359 - protein, 8 aa, Influenza virus
DANVRNLH

SEQ ID NO: 272360 - protein, 8 aa, Influenza virus
ANVRNLHD

SEQ ID NO: 272361 - protein, 8 aa, Influenza virus
NVRNLHDQ

SEQ ID NO: 272362 - protein, 8 aa, Influenza virus
VRNLHDQV

SEQ ID NO: 272363 - protein, 8 aa, Influenza virus
RNLHDQVK

SEQ ID NO: 272364 - protein, 8 aa, Influenza virus
NLHDQVKR

SEQ ID NO: 272365 - protein, 8 aa, Influenza virus
LKNNAIDE

SEQ ID NO: 272366 - protein, 8 aa, Influenza virus
KNNAIDEG

SEQ ID NO: 272367 - protein, 8 aa, Influenza virus
NNAIDEGD

SEQ ID NO: 272368 - protein, 8 aa, Influenza virus
NAIDEGDG

SEQ ID NO: 272369 - protein, 8 aa, Influenza virus
AIDEGDGC

SEQ ID NO: 272370 - protein, 8 aa, Influenza virus
IDEGDGCF

SEQ ID NO: 272371 - protein, 8 aa, Influenza virus
DEGDGCFN

SEQ ID NO: 272372 - protein, 8 aa, Influenza virus
EGDGCFNL

SEQ ID NO: 272373 - protein, 8 aa, Influenza virus
GDGCFNLL

SEQ ID NO: 272374 - protein, 8 aa, Influenza virus
DGCFNLLH

SEQ ID NO: 272375 - protein, 8 aa, Influenza virus
GCFNLLHK

SEQ ID NO: 272376 - protein, 8 aa, Influenza virus
CFNLLHKC

SEQ ID NO: 272377 - protein, 8 aa, Influenza virus
FNLLHKCN

SEQ ID NO: 272378 - protein, 8 aa, Influenza virus
NLLHKCND

SEQ ID NO: 272379 - protein, 8 aa, Influenza virus
LLHKCNDS

SEQ ID NO: 272380 - protein, 8 aa, Influenza virus
LHKCNDSC

SEQ ID NO: 272381 - protein, 8 aa, Influenza virus
HKCNDSCM

SEQ ID NO: 272382 - protein, 8 aa, Influenza virus
KCNDSCME

SEQ ID NO: 272383 - protein, 8 aa, Influenza virus
CNDSCMET

SEQ ID NO: 272384 - protein, 8 aa, Influenza virus
NDSCMETI

SEQ ID NO: 272385 - protein, 8 aa, Influenza virus
DSCMETIR

SEQ ID NO: 272386 - protein, 8 aa, Influenza virus
SCMETIRN

SEQ ID NO: 272387 - protein, 8 aa, Influenza virus
CMETIRNG

SEQ ID NO: 272388 - protein, 8 aa, Influenza virus
METIRNGT

SEQ ID NO: 272389 - protein, 8 aa, Influenza virus
ETIRNGTY

SEQ ID NO: 272390 - protein, 8 aa, Influenza virus
TIRNGTYN

SEQ ID NO: 272391 - protein, 8 aa, Influenza virus
IRNGTYNH

SEQ ID NO: 272392 - protein, 8 aa, Influenza virus
RNGTYNHE

SEQ ID NO: 272393 - protein, 8 aa, Influenza virus
NGTYNHED

SEQ ID NO: 272394 - protein, 8 aa, Influenza virus
GTYNHEDY

SEQ ID NO: 272395 - protein, 8 aa, Influenza virus
TYNHEDYK

SEQ ID NO: 272396 - protein, 8 aa, Influenza virus
YNHEDYKE

SEQ ID NO: 272397 - protein, 8 aa, Influenza virus
NHEDYKEE

SEQ ID NO: 272398 - protein, 8 aa, Influenza virus
HEDYKEES

SEQ ID NO: 272399 - protein, 8 aa, Influenza virus
EDYKEESQ

SEQ ID NO: 272400 - protein, 8 aa, Influenza virus
DYKEESQL

SEQ ID NO: 272401 - protein, 8 aa, Influenza virus
YKEESQLK

SEQ ID NO: 272402 - protein, 8 aa, Influenza virus
KEESQLKR

SEQ ID NO: 272403 - protein, 8 aa, Influenza virus
EESQLKRQ

SEQ ID NO: 272404 - protein, 8 aa, Influenza virus
ESQLKRQE

SEQ ID NO: 272405 - protein, 8 aa, Influenza virus
SQLKRQEI

SEQ ID NO: 272406 - protein, 8 aa, Influenza virus
QLKRQEIE

SEQ ID NO: 272407 - protein, 8 aa, Influenza virus
LKRQEIEG

SEQ ID NO: 272408 - protein, 8 aa, Influenza virus
KRQEIEGI

SEQ ID NO: 272409 - protein, 8 aa, Influenza virus
RQEIEGIK

SEQ ID NO: 272410 - protein, 8 aa, Influenza virus
QEIEGIKL

SEQ ID NO: 272411 - protein, 8 aa, Influenza virus
EIEGIKLK

SEQ ID NO: 272412 - protein, 8 aa, Influenza virus
IEGIKLKT

SEQ ID NO: 272413 - protein, 8 aa, Influenza virus
EGIKLKTE

SEQ ID NO: 272414 - protein, 8 aa, Influenza virus
GIKLKTED

SEQ ID NO: 272415 - protein, 8 aa, Influenza virus
IKLKTEDN

SEQ ID NO: 272416 - protein, 8 aa, Influenza virus
KLKTEDNV

SEQ ID NO: 272417 - protein, 8 aa, Influenza virus
LKTEDNVY

SEQ ID NO: 272418 - protein, 8 aa, Influenza virus
KTEDNVYK

SEQ ID NO: 272419 - protein, 8 aa, Influenza virus
TEDNVYKV

SEQ ID NO: 272420 - protein, 8 aa, Influenza virus
EDNVYKVL

SEQ ID NO: 272421 - protein, 8 aa, Influenza virus
DNVYKVLS

SEQ ID NO: 272422 - protein, 8 aa, Influenza virus
NVYKVLSI

SEQ ID NO: 272423 - protein, 8 aa, Influenza virus
VYKVLSIY

SEQ ID NO: 272424 - protein, 8 aa, Influenza virus
YKILSIYS

SEQ ID NO: 272425 - protein, 8 aa, Influenza virus
KILSIYSC

SEQ ID NO: 272426 - protein, 8 aa, Influenza virus
ILSIYSCI

SEQ ID NO: 272427 - protein, 8 aa, Influenza virus
LSIYSCIA

SEQ ID NO: 272428 - protein, 8 aa, Influenza virus
SIYSCIAS

SEQ ID NO: 272429 - protein, 8 aa, Influenza virus
IYSCIASS

SEQ ID NO: 272430 - protein, 8 aa, Influenza virus
YSCIASSI

SEQ ID NO: 272431 - protein, 8 aa, Influenza virus
SCIASSIV

SEQ ID NO: 272432 - protein, 8 aa, Influenza virus
CIASSVVL

SEQ ID NO: 272433 - protein, 8 aa, Influenza virus
IASSIVMV

SEQ ID NO: 272434 - protein, 8 aa, Influenza virus
ASSVVLVG

SEQ ID NO: 272435 - protein, 8 aa, Influenza virus
SSIVLVGL

SEQ ID NO: 272436 - protein, 8 aa, Influenza virus
SVVLVGLI

SEQ ID NO: 272437 - protein, 8 aa, Influenza virus
VVLVGLIL

SEQ ID NO: 272438 - protein, 8 aa, Influenza virus
VLVGLILA

SEQ ID NO: 272439 - protein, 8 aa, Influenza virus
LVGLILAF

SEQ ID NO: 272440 - protein, 8 aa, Influenza virus
VGLILAFI

SEQ ID NO: 272441 - protein, 8 aa, Influenza virus
GLILAFIM

SEQ ID NO: 272442 - protein, 8 aa, Influenza virus
LILAFIMW

SEQ ID NO: 272443 - protein, 8 aa, Influenza virus
ILAFIMWA

SEQ ID NO: 272444 - protein, 8 aa, Influenza virus
LAFIMWAC

SEQ ID NO: 272445 - protein, 8 aa, Influenza virus
AFIMWACS

SEQ ID NO: 272446 - protein, 8 aa, Influenza virus
FIMWACSS

SEQ ID NO: 272447 - protein, 8 aa, Influenza virus
IMWACSSG

SEQ ID NO: 272448 - protein, 8 aa, Influenza virus
MWACSSGN

SEQ ID NO: 272449 - protein, 8 aa, Influenza virus
WACSSGNC

SEQ ID NO: 272450 - protein, 8 aa, Influenza virus
ACSSGNCR

SEQ ID NO: 272451 - protein, 8 aa, Influenza virus
CSSGNCRF

SEQ ID NO: 272452 - protein, 8 aa, Influenza virus
SSGNCRFN

SEQ ID NO: 272453 - protein, 8 aa, Influenza virus
SGNCRFNV

SEQ ID NO: 272454 - protein, 8 aa, Influenza virus
GNCRFNVC

SEQ ID NO: 272455 - protein, 8 aa, Influenza virus
NCRFNVCI

SEQ ID NO: 272456 - protein, 8 aa, Influenza virus
KQGKTKAT

SEQ ID NO: 272457 - protein, 8 aa, Influenza virus
QGKTKATK

SEQ ID NO: 272458 - protein, 8 aa, Influenza virus
GKTKATKM

SEQ ID NO: 272459 - protein, 8 aa, Influenza virus
KTKATKMK

SEQ ID NO: 272460 - protein, 8 aa, Influenza virus
TKATKMKA

SEQ ID NO: 272461 - protein, 8 aa, Influenza virus
KATKMKAI

SEQ ID NO: 272462 - protein, 8 aa, Influenza virus
ATKMKAIL

SEQ ID NO: 272463 - protein, 8 aa, Influenza virus
TKMKAILV

SEQ ID NO: 272464 - protein, 8 aa, Influenza virus
TAYSQITN

SEQ ID NO: 272465 - protein, 8 aa, Influenza virus
AYSQITNG

SEQ ID NO: 272466 - protein, 8 aa, Influenza virus
YSQITNGT

SEQ ID NO: 272467 - protein, 8 aa, Influenza virus
SQITNGTT

SEQ ID NO: 272468 - protein, 8 aa, Influenza virus
QITNGTTG

SEQ ID NO: 272469 - protein, 8 aa, Influenza virus
ITNGTTGN

SEQ ID NO: 272470 - protein, 8 aa, Influenza virus
TNGTTGNP

SEQ ID NO: 272471 - protein, 8 aa, Influenza virus
NGTTGNPI

SEQ ID NO: 272472 - protein, 8 aa, Influenza virus
GTTGNPII

SEQ ID NO: 272473 - protein, 8 aa, Influenza virus
TTGNPIIC

SEQ ID NO: 272474 - protein, 8 aa, Influenza virus
TGNPIICL

SEQ ID NO: 272475 - protein, 8 aa, Influenza virus
SNAPSGIE

SEQ ID NO: 272476 - protein, 8 aa, Influenza virus
NAPSGIEY

SEQ ID NO: 272477 - protein, 8 aa, Influenza virus
APSGIEYN

SEQ ID NO: 272478 - protein, 8 aa, Influenza virus
PSGIEYNG

SEQ ID NO: 272479 - protein, 8 aa, Influenza virus
SGIEYNGK

SEQ ID NO: 272480 - protein, 8 aa, Influenza virus
GIEYNGKS

SEQ ID NO: 272481 - protein, 8 aa, Influenza virus
IEYNGKSL

SEQ ID NO: 272482 - protein, 8 aa, Influenza virus
EYNGKSLG

SEQ ID NO: 272483 - protein, 8 aa, Influenza virus
YNGKSLGI

SEQ ID NO: 272484 - protein, 8 aa, Influenza virus
NGKSLGIQ

SEQ ID NO: 272485 - protein, 8 aa, Influenza virus
TSLTSLPF

SEQ ID NO: 272486 - protein, 8 aa, Influenza virus
SLTSLPFQ

SEQ ID NO: 272487 - protein, 8 aa, Influenza virus
LTSLPFQN

SEQ ID NO: 272488 - protein, 8 aa, Influenza virus
RGLFGAIA

SEQ ID NO: 272489 - protein, 8 aa, Influenza virus
GLFGAIAG

SEQ ID NO: 272490 - protein, 8 aa, Influenza virus
LFGAIAGF

SEQ ID NO: 272491 - protein, 8 aa, Influenza virus
FGAIAGFI

SEQ ID NO: 272492 - protein, 8 aa, Influenza virus
GAIAGFIE

SEQ ID NO: 272493 - protein, 8 aa, Influenza virus
AIAGFIEG

SEQ ID NO: 272494 - protein, 8 aa, Influenza virus
IAGFIEGG

SEQ ID NO: 272495 - protein, 8 aa, Influenza virus
AGFIEGGW

SEQ ID NO: 272496 - protein, 8 aa, Influenza virus
GFIEGGWT

SEQ ID NO: 272497 - protein, 8 aa, Influenza virus
FIEGGWTG

SEQ ID NO: 272498 - protein, 8 aa, Influenza virus
IEGGWTGM

SEQ ID NO: 272499 - protein, 8 aa, Influenza virus
EGGWTGMV

SEQ ID NO: 272500 - protein, 8 aa, Influenza virus
GGWTGMVD

SEQ ID NO: 272501 - protein, 8 aa, Influenza virus
GWTGMVDG

SEQ ID NO: 272502 - protein, 8 aa, Influenza virus
WTGMVDGW

SEQ ID NO: 272503 - protein, 8 aa, Influenza virus
TGMVDGWY

SEQ ID NO: 272504 - protein, 8 aa, Influenza virus
GMVDGWYG

SEQ ID NO: 272505 - protein, 8 aa, Influenza virus
MVDGWYGY

SEQ ID NO: 272506 - protein, 8 aa, Influenza virus
VDGWYGYH

SEQ ID NO: 272507 - protein, 8 aa, Influenza virus
DGWYGYHH

SEQ ID NO: 272508 - protein, 8 aa, Influenza virus
GWYGYHHQ

SEQ ID NO: 272509 - protein, 8 aa, Influenza virus
WYGYHHQN

SEQ ID NO: 272510 - protein, 8 aa, Influenza virus
QGSGYAAD

SEQ ID NO: 272511 - protein, 8 aa, Influenza virus
WTYNAELL

SEQ ID NO: 272512 - protein, 8 aa, Influenza virus
YNAELLVL

SEQ ID NO: 272513 - protein, 8 aa, Influenza virus
NAELLVLL

SEQ ID NO: 272514 - protein, 8 aa, Influenza virus
AELLVLLE

SEQ ID NO: 272515 - protein, 8 aa, Influenza virus
ELLVLLEN

SEQ ID NO: 272516 - protein, 8 aa, Influenza virus
LLVLLENE

SEQ ID NO: 272517 - protein, 8 aa, Influenza virus
LLENERTL

SEQ ID NO: 272518 - protein, 8 aa, Influenza virus
LENERTLD

SEQ ID NO: 272519 - protein, 8 aa, Influenza virus
GNGCFEFY

SEQ ID NO: 272520 - protein, 8 aa, Influenza virus
NGCFEFYH

SEQ ID NO: 272521 - protein, 8 aa, Influenza virus
LAIYSTVA

SEQ ID NO: 272522 - protein, 8 aa, Influenza virus
AIYSTVAS

SEQ ID NO: 272523 - protein, 8 aa, Influenza virus
IYSTVASS

SEQ ID NO: 272524 - protein, 8 aa, Influenza virus
LCSVEYAS

SEQ ID NO: 272525 - protein, 8 aa, Influenza virus
CSVEYASK

SEQ ID NO: 272526 - protein, 8 aa, Influenza virus
SVEYASKT

SEQ ID NO: 272527 - protein, 8 aa, Influenza virus
VEYASKTR

SEQ ID NO: 272528 - protein, 8 aa, Influenza virus
EYASKTRI

SEQ ID NO: 272529 - protein, 8 aa, Influenza virus
YASKTRIS

SEQ ID NO: 272530 - protein, 8 aa, Influenza virus
CRICIRAD

SEQ ID NO: 272531 - protein, 8 aa, Influenza virus
RICIRADG

SEQ ID NO: 272532 - protein, 8 aa, Influenza virus
ICILDQNF

SEQ ID NO: 272533 - protein, 8 aa, Influenza virus
SLVKTTLF

SEQ ID NO: 272534 - protein, 8 aa, Influenza virus
IDFRDMRK

SEQ ID NO: 272535 - protein, 8 aa, Influenza virus
DFRDMRKN

SEQ ID NO: 272536 - protein, 8 aa, Influenza virus
FRDMRKNT

SEQ ID NO: 272537 - protein, 8 aa, Influenza virus
RDMRKNTL

SEQ ID NO: 272538 - protein, 8 aa, Influenza virus
KQGKTKAT

SEQ ID NO: 272539 - protein, 8 aa, Influenza virus
QGKTKATK

SEQ ID NO: 272540 - protein, 8 aa, Influenza virus
GKTKATKM

SEQ ID NO: 272541 - protein, 8 aa, Influenza virus
KTKATKMK

SEQ ID NO: 272542 - protein, 8 aa, Influenza virus
TKATKMKA

SEQ ID NO: 272543 - protein, 8 aa, Influenza virus
KATKMKAI

SEQ ID NO: 272544 - protein, 8 aa, Influenza virus
ATKMKAIL

SEQ ID NO: 272545 - protein, 8 aa, Influenza virus
TKMKAILV

SEQ ID NO: 272546 - protein, 8 aa, Influenza virus
KMKAILVV

SEQ ID NO: 272547 - protein, 8 aa, Influenza virus
IIIVVLLY

SEQ ID NO: 272548 - protein, 8 aa, Influenza virus
ADTLCIGY

SEQ ID NO: 272549 - protein, 8 aa, Influenza virus
DTLCIGYH

SEQ ID NO: 272550 - protein, 8 aa, Influenza virus
TLCIGYHA

SEQ ID NO: 272551 - protein, 8 aa, Influenza virus
LCIGYHAN

SEQ ID NO: 272552 - protein, 8 aa, Influenza virus
CIGYHANN

SEQ ID NO: 272553 - protein, 8 aa, Influenza virus
IGYHANNS

SEQ ID NO: 272554 - protein, 8 aa, Influenza virus
GYHANNST

SEQ ID NO: 272555 - protein, 8 aa, Influenza virus
YHANNSTD

SEQ ID NO: 272556 - protein, 8 aa, Influenza virus
HANNSTDT

SEQ ID NO: 272557 - protein, 8 aa, Influenza virus
ANNSTDTV

SEQ ID NO: 272558 - protein, 8 aa, Influenza virus
NNSTDTVD

SEQ ID NO: 272559 - protein, 8 aa, Influenza virus
NSTDTVDT

SEQ ID NO: 272560 - protein, 8 aa, Influenza virus
STDTVDTV

SEQ ID NO: 272561 - protein, 8 aa, Influenza virus
TDTVDTVL

SEQ ID NO: 272562 - protein, 8 aa, Influenza virus
DTVDTVLE

SEQ ID NO: 272563 - protein, 8 aa, Influenza virus
TVDTVLEK

SEQ ID NO: 272564 - protein, 8 aa, Influenza virus
VDTVLEKN

SEQ ID NO: 272565 - protein, 8 aa, Influenza virus
DTVLEKNV

SEQ ID NO: 272566 - protein, 8 aa, Influenza virus
TVLEKNVT

SEQ ID NO: 272567 - protein, 8 aa, Influenza virus
VLEKNVTV

SEQ ID NO: 272568 - protein, 8 aa, Influenza virus
LEKNVTVT

SEQ ID NO: 272569 - protein, 8 aa, Influenza virus
EKNVTVTH

SEQ ID NO: 272570 - protein, 8 aa, Influenza virus
KNVTVTHS

SEQ ID NO: 272571 - protein, 8 aa, Influenza virus
NVTVTHSV

SEQ ID NO: 272572 - protein, 8 aa, Influenza virus
VTVTHSVN

SEQ ID NO: 272573 - protein, 8 aa, Influenza virus
TVTHSVNL

SEQ ID NO: 272574 - protein, 8 aa, Influenza virus
VTHSVNLL

SEQ ID NO: 272575 - protein, 8 aa, Influenza virus
THSVNLLE

SEQ ID NO: 272576 - protein, 8 aa, Influenza virus
IAGWILGN

SEQ ID NO: 272577 - protein, 8 aa, Influenza virus
AGWILGNP

SEQ ID NO: 272578 - protein, 8 aa, Influenza virus
GWILGNPE

SEQ ID NO: 272579 - protein, 8 aa, Influenza virus
WILGNPEC

SEQ ID NO: 272580 - protein, 8 aa, Influenza virus
LGNPECES

SEQ ID NO: 272581 - protein, 8 aa, Influenza virus
SWSYIVET

SEQ ID NO: 272582 - protein, 8 aa, Influenza virus
DYEELREQ

SEQ ID NO: 272583 - protein, 8 aa, Influenza virus
YEELREQL

SEQ ID NO: 272584 - protein, 8 aa, Influenza virus
EELREQLS

SEQ ID NO: 272585 - protein, 8 aa, Influenza virus
ELREQLSS

SEQ ID NO: 272586 - protein, 8 aa, Influenza virus
LREQLSSV

SEQ ID NO: 272587 - protein, 8 aa, Influenza virus
REQLSSVS

SEQ ID NO: 272588 - protein, 8 aa, Influenza virus
EQLSSVSS

SEQ ID NO: 272589 - protein, 8 aa, Influenza virus
QLSSVSSF

SEQ ID NO: 272590 - protein, 8 aa, Influenza virus
LSSVSSFE

SEQ ID NO: 272591 - protein, 8 aa, Influenza virus
SSVSSFER

SEQ ID NO: 272592 - protein, 8 aa, Influenza virus
SVSSFERF

SEQ ID NO: 272593 - protein, 8 aa, Influenza virus
VSSFERFE

SEQ ID NO: 272594 - protein, 8 aa, Influenza virus
SSFERFEI

SEQ ID NO: 272595 - protein, 8 aa, Influenza virus
SFERFEIF

SEQ ID NO: 272596 - protein, 8 aa, Influenza virus
FERFEIFP

SEQ ID NO: 272597 - protein, 8 aa, Influenza virus
ERFEIFPK

SEQ ID NO: 272598 - protein, 8 aa, Influenza virus
SFYKNLIW

SEQ ID NO: 272599 - protein, 8 aa, Influenza virus
FYKNLIWL

SEQ ID NO: 272600 - protein, 8 aa, Influenza virus
KEKENSYP

SEQ ID NO: 272601 - protein, 8 aa, Influenza virus
EKENSYPM

SEQ ID NO: 272602 - protein, 8 aa, Influenza virus
VLVLWGIH

SEQ ID NO: 272603 - protein, 8 aa, Influenza virus
LVLWGIHH

SEQ ID NO: 272604 - protein, 8 aa, Influenza virus
VLWGIHHP

SEQ ID NO: 272605 - protein, 8 aa, Influenza virus
GRMNYYWT

SEQ ID NO: 272606 - protein, 8 aa, Influenza virus
RMNYYWTL

SEQ ID NO: 272607 - protein, 8 aa, Influenza virus
PGDKITFE

SEQ ID NO: 272608 - protein, 8 aa, Influenza virus
GDKITFEA

SEQ ID NO: 272609 - protein, 8 aa, Influenza virus
DKITFEAT

SEQ ID NO: 272610 - protein, 8 aa, Influenza virus
KITFEATG

SEQ ID NO: 272611 - protein, 8 aa, Influenza virus
ITFEATGN

SEQ ID NO: 272612 - protein, 8 aa, Influenza virus
TFEATGNL

SEQ ID NO: 272613 - protein, 8 aa, Influenza virus
FEATGNLV

SEQ ID NO: 272614 - protein, 8 aa, Influenza virus
EATGNLVV

SEQ ID NO: 272615 - protein, 8 aa, Influenza virus
ATGNLVVP

SEQ ID NO: 272616 - protein, 8 aa, Influenza virus
GAINTSLP

SEQ ID NO: 272617 - protein, 8 aa, Influenza virus
NTSLPFQN

SEQ ID NO: 272618 - protein, 8 aa, Influenza virus
TSLTSLPF

SEQ ID NO: 272619 - protein, 8 aa, Influenza virus
SLTSLPFQ

SEQ ID NO: 272620 - protein, 8 aa, Influenza virus
LTSLPFQN

SEQ ID NO: 272621 - protein, 8 aa, Influenza virus
SLPFQNIH

SEQ ID NO: 272622 - protein, 8 aa, Influenza virus
LPFQNIHP

SEQ ID NO: 272623 - protein, 8 aa, Influenza virus
NIHPITIG

SEQ ID NO: 272624 - protein, 8 aa, Influenza virus
HPITIGKC

SEQ ID NO: 272625 - protein, 8 aa, Influenza virus
PITIGKCP

SEQ ID NO: 272626 - protein, 8 aa, Influenza virus
ITIGKCPK

SEQ ID NO: 272627 - protein, 8 aa, Influenza virus
TIGKCPKY

SEQ ID NO: 272628 - protein, 8 aa, Influenza virus
IGKCPKYV

SEQ ID NO: 272629 - protein, 8 aa, Influenza virus
GKCPKYVK

SEQ ID NO: 272630 - protein, 8 aa, Influenza virus
KCPKYVKS

SEQ ID NO: 272631 - protein, 8 aa, Influenza virus
CPKYVKST

SEQ ID NO: 272632 - protein, 8 aa, Influenza virus
KLRLATGL

SEQ ID NO: 272633 - protein, 8 aa, Influenza virus
LRLATGLR

SEQ ID NO: 272634 - protein, 8 aa, Influenza virus
RLATGLRN

SEQ ID NO: 272635 - protein, 8 aa, Influenza virus
LATGLRNV

SEQ ID NO: 272636 - protein, 8 aa, Influenza virus
ATGLRNVP

SEQ ID NO: 272637 - protein, 8 aa, Influenza virus
TGLRNVPS

SEQ ID NO: 272638 - protein, 8 aa, Influenza virus
GLRNVPSI

SEQ ID NO: 272639 - protein, 8 aa, Influenza virus
LRNVPSIQ

SEQ ID NO: 272640 - protein, 8 aa, Influenza virus
RNVPSIQS

SEQ ID NO: 272641 - protein, 8 aa, Influenza virus
NVPSIQSR

SEQ ID NO: 272642 - protein, 8 aa, Influenza virus
VPSIQSRG

SEQ ID NO: 272643 - protein, 8 aa, Influenza virus
PSIQSRGL

SEQ ID NO: 272644 - protein, 8 aa, Influenza virus
SIQSRGLF

SEQ ID NO: 272645 - protein, 8 aa, Influenza virus
IQSRGLFG

SEQ ID NO: 272646 - protein, 8 aa, Influenza virus
QSRGLFGA

SEQ ID NO: 272647 - protein, 8 aa, Influenza virus
SRGLFGAI

SEQ ID NO: 272648 - protein, 8 aa, Influenza virus
RGLFGAIA

SEQ ID NO: 272649 - protein, 8 aa, Influenza virus
GLFGAIAG

SEQ ID NO: 272650 - protein, 8 aa, Influenza virus
LFGAIAGF

SEQ ID NO: 272651 - protein, 8 aa, Influenza virus
FGAIAGFI

SEQ ID NO: 272652 - protein, 8 aa, Influenza virus
GAIAGFIE

SEQ ID NO: 272653 - protein, 8 aa, Influenza virus
AIAGFIEG

SEQ ID NO: 272654 - protein, 8 aa, Influenza virus
IAGFIEGG

SEQ ID NO: 272655 - protein, 8 aa, Influenza virus
AGFIEGGW

SEQ ID NO: 272656 - protein, 8 aa, Influenza virus
GFIEGGWT

SEQ ID NO: 272657 - protein, 8 aa, Influenza virus
FIEGGWTG

SEQ ID NO: 272658 - protein, 8 aa, Influenza virus
IEGGWTGM

SEQ ID NO: 272659 - protein, 8 aa, Influenza virus
EGGWTGMV

SEQ ID NO: 272660 - protein, 8 aa, Influenza virus
GGWTGMVD

SEQ ID NO: 272661 - protein, 8 aa, Influenza virus
GWTGMVDG

SEQ ID NO: 272662 - protein, 8 aa, Influenza virus
WTGMVDGW

SEQ ID NO: 272663 - protein, 8 aa, Influenza virus
TGMVDGWY

SEQ ID NO: 272664 - protein, 8 aa, Influenza virus
GMVDGWYG

SEQ ID NO: 272665 - protein, 8 aa, Influenza virus
MVDGWYGY

SEQ ID NO: 272666 - protein, 8 aa, Influenza virus
VDGWYGYH

SEQ ID NO: 272667 - protein, 8 aa, Influenza virus
DGWYGYHH

SEQ ID NO: 272668 - protein, 8 aa, Influenza virus
GWYGYHHQ

SEQ ID NO: 272669 - protein, 8 aa, Influenza virus
WYGYHHQN

SEQ ID NO: 272670 - protein, 8 aa, Influenza virus
YGYHHQNE

SEQ ID NO: 272671 - protein, 8 aa, Influenza virus
GYHHQNEQ

SEQ ID NO: 272672 - protein, 8 aa, Influenza virus
YHHQNEQG

SEQ ID NO: 272673 - protein, 8 aa, Influenza virus
HHQNEQGS

SEQ ID NO: 272674 - protein, 8 aa, Influenza virus
HQNEQGSG

SEQ ID NO: 272675 - protein, 8 aa, Influenza virus
QNEQGSGY

SEQ ID NO: 272676 - protein, 8 aa, Influenza virus
NEQGSGYA

SEQ ID NO: 272677 - protein, 8 aa, Influenza virus
EQGSGYAA

SEQ ID NO: 272678 - protein, 8 aa, Influenza virus
QGSGYAAD

SEQ ID NO: 272679 - protein, 8 aa, Influenza virus
GSGYAADL

SEQ ID NO: 272680 - protein, 8 aa, Influenza virus
SGYAADLK

SEQ ID NO: 272681 - protein, 8 aa, Influenza virus
GYAADLKS

SEQ ID NO: 272682 - protein, 8 aa, Influenza virus
YAADLKST

SEQ ID NO: 272683 - protein, 8 aa, Influenza virus
AADLKSTQ

SEQ ID NO: 272684 - protein, 8 aa, Influenza virus
KSTQNAID

SEQ ID NO: 272685 - protein, 8 aa, Influenza virus
DEITNKVN

SEQ ID NO: 272686 - protein, 8 aa, Influenza virus
EITNKVNS

SEQ ID NO: 272687 - protein, 8 aa, Influenza virus
ITNKVNSV

SEQ ID NO: 272688 - protein, 8 aa, Influenza virus
TNKVNSVI

SEQ ID NO: 272689 - protein, 8 aa, Influenza virus
NKVNSVIE

SEQ ID NO: 272690 - protein, 8 aa, Influenza virus
KVNSVIEK

SEQ ID NO: 272691 - protein, 8 aa, Influenza virus
VNSVIEKM

SEQ ID NO: 272692 - protein, 8 aa, Influenza virus
NSVIEKMN

SEQ ID NO: 272693 - protein, 8 aa, Influenza virus
SVIEKMNT

SEQ ID NO: 272694 - protein, 8 aa, Influenza virus
VIEKMNTQ

SEQ ID NO: 272695 - protein, 8 aa, Influenza virus
IEKMNTQF

SEQ ID NO: 272696 - protein, 8 aa, Influenza virus
EKMNTQFT

SEQ ID NO: 272697 - protein, 8 aa, Influenza virus
KMNTQFTA

SEQ ID NO: 272698 - protein, 8 aa, Influenza virus
MNTQFTAV

SEQ ID NO: 272699 - protein, 8 aa, Influenza virus
NTQFTAVG

SEQ ID NO: 272700 - protein, 8 aa, Influenza virus
TQFTAVGK

SEQ ID NO: 272701 - protein, 8 aa, Influenza virus
QFTAVGKE

SEQ ID NO: 272702 - protein, 8 aa, Influenza virus
FTAVGKEF

SEQ ID NO: 272703 - protein, 8 aa, Influenza virus
TAVGKEFN

SEQ ID NO: 272704 - protein, 8 aa, Influenza virus
LEKRIENL

SEQ ID NO: 272705 - protein, 8 aa, Influenza virus
EKRIENLN

SEQ ID NO: 272706 - protein, 8 aa, Influenza virus
RIENLNKK

SEQ ID NO: 272707 - protein, 8 aa, Influenza virus
IENLNKKV

SEQ ID NO: 272708 - protein, 8 aa, Influenza virus
ENLNKKVD

SEQ ID NO: 272709 - protein, 8 aa, Influenza virus
NLNKKVDD

SEQ ID NO: 272710 - protein, 8 aa, Influenza virus
LNKKVDDG

SEQ ID NO: 272711 - protein, 8 aa, Influenza virus
NKKVDDGF

SEQ ID NO: 272712 - protein, 8 aa, Influenza virus
KKVDDGFL

SEQ ID NO: 272713 - protein, 8 aa, Influenza virus
KVDDGFLD

SEQ ID NO: 272714 - protein, 8 aa, Influenza virus
DDGFLDIW

SEQ ID NO: 272715 - protein, 8 aa, Influenza virus
DGFLDIWT

SEQ ID NO: 272716 - protein, 8 aa, Influenza virus
GFLDIWTY

SEQ ID NO: 272717 - protein, 8 aa, Influenza virus
FLDIWTYN

SEQ ID NO: 272718 - protein, 8 aa, Influenza virus
LDIWTYNA

SEQ ID NO: 272719 - protein, 8 aa, Influenza virus
DIWTYNAE

SEQ ID NO: 272720 - protein, 8 aa, Influenza virus
IWTYNAEL

SEQ ID NO: 272721 - protein, 8 aa, Influenza virus
WTYNAELL

SEQ ID NO: 272722 - protein, 8 aa, Influenza virus
TYNAELLV

SEQ ID NO: 272723 - protein, 8 aa, Influenza virus
YNAELLVL

SEQ ID NO: 272724 - protein, 8 aa, Influenza virus
NAELLVLL

SEQ ID NO: 272725 - protein, 8 aa, Influenza virus
AELLVLLE

SEQ ID NO: 272726 - protein, 8 aa, Influenza virus
ELLVLLEN

SEQ ID NO: 272727 - protein, 8 aa, Influenza virus
LLVLLENE

SEQ ID NO: 272728 - protein, 8 aa, Influenza virus
LVLLENER

SEQ ID NO: 272729 - protein, 8 aa, Influenza virus
VLLENERT

SEQ ID NO: 272730 - protein, 8 aa, Influenza virus
LLENERTL

SEQ ID NO: 272731 - protein, 8 aa, Influenza virus
LENERTLD

SEQ ID NO: 272732 - protein, 8 aa, Influenza virus
ENERTLDY

SEQ ID NO: 272733 - protein, 8 aa, Influenza virus
NERTLDYH

SEQ ID NO: 272734 - protein, 8 aa, Influenza virus
ERTLDYHD

SEQ ID NO: 272735 - protein, 8 aa, Influenza virus
RTLDYHDS

SEQ ID NO: 272736 - protein, 8 aa, Influenza virus
QLKNNAKE

SEQ ID NO: 272737 - protein, 8 aa, Influenza virus
NNAKEIGN

SEQ ID NO: 272738 - protein, 8 aa, Influenza virus
NAKEIGNG

SEQ ID NO: 272739 - protein, 8 aa, Influenza virus
AKEIGNGC

SEQ ID NO: 272740 - protein, 8 aa, Influenza virus
KEIGNGCF

SEQ ID NO: 272741 - protein, 8 aa, Influenza virus
EIGNGCFE

SEQ ID NO: 272742 - protein, 8 aa, Influenza virus
IGNGCFEF

SEQ ID NO: 272743 - protein, 8 aa, Influenza virus
GNGCFEFY

SEQ ID NO: 272744 - protein, 8 aa, Influenza virus
NGCFEFYH

SEQ ID NO: 272745 - protein, 8 aa, Influenza virus
GCFEFYHK

SEQ ID NO: 272746 - protein, 8 aa, Influenza virus
CFEFYHKC

SEQ ID NO: 272747 - protein, 8 aa, Influenza virus
FEFYHKCD

SEQ ID NO: 272748 - protein, 8 aa, Influenza virus
EFYHKCDN

SEQ ID NO: 272749 - protein, 8 aa, Influenza virus
CMESVKNG

SEQ ID NO: 272750 - protein, 8 aa, Influenza virus
MESVKNGT

SEQ ID NO: 272751 - protein, 8 aa, Influenza virus
ESVKNGTY

SEQ ID NO: 272752 - protein, 8 aa, Influenza virus
SVKNGTYD

SEQ ID NO: 272753 - protein, 8 aa, Influenza virus
VKNGTYDY

SEQ ID NO: 272754 - protein, 8 aa, Influenza virus
KNGTYDYP

SEQ ID NO: 272755 - protein, 8 aa, Influenza virus
NGTYDYPK

SEQ ID NO: 272756 - protein, 8 aa, Influenza virus
GTYDYPKY

SEQ ID NO: 272757 - protein, 8 aa, Influenza virus
TYDYPKYS

SEQ ID NO: 272758 - protein, 8 aa, Influenza virus
YDYPKYSE

SEQ ID NO: 272759 - protein, 8 aa, Influenza virus
DYPKYSEE

SEQ ID NO: 272760 - protein, 8 aa, Influenza virus
YPKYSEEA

SEQ ID NO: 272761 - protein, 8 aa, Influenza virus
PKYSEEAK

SEQ ID NO: 272762 - protein, 8 aa, Influenza virus
KYSEEAKL

SEQ ID NO: 272763 - protein, 8 aa, Influenza virus
IDGVKLES

SEQ ID NO: 272764 - protein, 8 aa, Influenza virus
IYQILAIY

SEQ ID NO: 272765 - protein, 8 aa, Influenza virus
YQILAIYS

SEQ ID NO: 272766 - protein, 8 aa, Influenza virus
QILAIYST

SEQ ID NO: 272767 - protein, 8 aa, Influenza virus
ILAIYSTV

SEQ ID NO: 272768 - protein, 8 aa, Influenza virus
LAIYSTVA

SEQ ID NO: 272769 - protein, 8 aa, Influenza virus
AIYSTVAS

SEQ ID NO: 272770 - protein, 8 aa, Influenza virus
IYSTVASS

SEQ ID NO: 272771 - protein, 8 aa, Influenza virus
YSTVASSL

SEQ ID NO: 272772 - protein, 8 aa, Influenza virus
STVASSLV

SEQ ID NO: 272773 - protein, 8 aa, Influenza virus
TVASSLVL

SEQ ID NO: 272774 - protein, 8 aa, Influenza virus
ASSLVLVV

SEQ ID NO: 272775 - protein, 8 aa, Influenza virus
SSLVLVVS

SEQ ID NO: 272776 - protein, 8 aa, Influenza virus
SLVLVVSL

SEQ ID NO: 272777 - protein, 8 aa, Influenza virus
LVLVVSLG

SEQ ID NO: 272778 - protein, 8 aa, Influenza virus
VLVVSLGA

SEQ ID NO: 272779 - protein, 8 aa, Influenza virus
LVVSLGAI

SEQ ID NO: 272780 - protein, 8 aa, Influenza virus
VVSLGAIS

SEQ ID NO: 272781 - protein, 8 aa, Influenza virus
VSLGAISF

SEQ ID NO: 272782 - protein, 8 aa, Influenza virus
SLGAISFW

SEQ ID NO: 272783 - protein, 8 aa, Influenza virus
LGAISFWM

SEQ ID NO: 272784 - protein, 8 aa, Influenza virus
GAISFWMC

SEQ ID NO: 272785 - protein, 8 aa, Influenza virus
AISFWMCS

SEQ ID NO: 272786 - protein, 8 aa, Influenza virus
ISFWMCSN

SEQ ID NO: 272787 - protein, 8 aa, Influenza virus
SFWMCSNG

SEQ ID NO: 272788 - protein, 8 aa, Influenza virus
FWMCSNGS

SEQ ID NO: 272789 - protein, 8 aa, Influenza virus
WMCSNGSL

SEQ ID NO: 272790 - protein, 8 aa, Influenza virus
MCSNGSLQ

SEQ ID NO: 272791 - protein, 8 aa, Influenza virus
CSNGSLQC

SEQ ID NO: 272792 - protein, 8 aa, Influenza virus
SNGSLQCR

SEQ ID NO: 272793 - protein, 8 aa, Influenza virus
NGSLQCRI

SEQ ID NO: 272794 - protein, 8 aa, Influenza virus
GSLQCRIC

SEQ ID NO: 272795 - protein, 8 aa, Influenza virus
LCSVEYAS

SEQ ID NO: 272796 - protein, 8 aa, Influenza virus
CSVEYASK

SEQ ID NO: 272797 - protein, 8 aa, Influenza virus
SVEYASKT

SEQ ID NO: 272798 - protein, 8 aa, Influenza virus
VEYASKTR

SEQ ID NO: 272799 - protein, 8 aa, Influenza virus
EYASKTRI

SEQ ID NO: 272800 - protein, 8 aa, Influenza virus
YASKTRIS

SEQ ID NO: 272801 - protein, 8 aa, Influenza virus
SLQCRICI

SEQ ID NO: 272802 - protein, 8 aa, Influenza virus
CRICIRAD

SEQ ID NO: 272803 - protein, 8 aa, Influenza virus
RICIRADG

SEQ ID NO: 272804 - protein, 8 aa, Influenza virus
ICIDFRDM

SEQ ID NO: 272805 - protein, 8 aa, Influenza virus
CILDQNFR

SEQ ID NO: 272806 - protein, 8 aa, Influenza virus
IDFRDMRK

SEQ ID NO: 272807 - protein, 8 aa, Influenza virus
DFRDMRKN

SEQ ID NO: 272808 - protein, 8 aa, Influenza virus
FRDMRKNT

SEQ ID NO: 272809 - protein, 8 aa, Influenza virus
RDMRKNTL

SEQ ID NO: 272810 - protein, 8 aa, Influenza virus
IGLREQKQ

SEQ ID NO: 272811 - protein, 8 aa, Influenza virus
GLREQKQE

SEQ ID NO: 272812 - protein, 8 aa, Influenza virus
LREQKQEF

SEQ ID NO: 272813 - protein, 8 aa, Influenza virus
REQKQEFK

SEQ ID NO: 272814 - protein, 8 aa, Influenza virus
EQKQEFKM

SEQ ID NO: 272815 - protein, 8 aa, Influenza virus
QKQEFKMN

SEQ ID NO: 272816 - protein, 8 aa, Influenza virus
KQEFKMNP

SEQ ID NO: 272817 - protein, 8 aa, Influenza virus
QEFKMNPN

SEQ ID NO: 272818 - protein, 8 aa, Influenza virus
EFKMNPNQ

SEQ ID NO: 272819 - protein, 8 aa, Influenza virus
FKMNPNQK

SEQ ID NO: 272820 - protein, 8 aa, Influenza virus
KMNPNQKI

SEQ ID NO: 272821 - protein, 8 aa, Influenza virus
GWAIYSKD

SEQ ID NO: 272822 - protein, 8 aa, Influenza virus
WAIYSKDN

SEQ ID NO: 272823 - protein, 8 aa, Influenza virus
AIYSKDNS

SEQ ID NO: 272824 - protein, 8 aa, Influenza virus
YSKDNSIR

SEQ ID NO: 272825 - protein, 8 aa, Influenza virus
SKDNSIRI

SEQ ID NO: 272826 - protein, 8 aa, Influenza virus
KDNSIRIG

SEQ ID NO: 272827 - protein, 8 aa, Influenza virus
DNSIRIGS

SEQ ID NO: 272828 - protein, 8 aa, Influenza virus
NSIRIGSK

SEQ ID NO: 272829 - protein, 8 aa, Influenza virus
SIRIGSKG

SEQ ID NO: 272830 - protein, 8 aa, Influenza virus
IRIGSKGD

SEQ ID NO: 272831 - protein, 8 aa, Influenza virus
RIGSKGDV

SEQ ID NO: 272832 - protein, 8 aa, Influenza virus
IGSKGDVF

SEQ ID NO: 272833 - protein, 8 aa, Influenza virus
GSKGDVFV

SEQ ID NO: 272834 - protein, 8 aa, Influenza virus
SKGDVFVI

SEQ ID NO: 272835 - protein, 8 aa, Influenza virus
KGDVFVIR

SEQ ID NO: 272836 - protein, 8 aa, Influenza virus
GDVFVIRE

SEQ ID NO: 272837 - protein, 8 aa, Influenza virus
DVFVIREP

SEQ ID NO: 272838 - protein, 8 aa, Influenza virus
VFVIREPF

SEQ ID NO: 272839 - protein, 8 aa, Influenza virus
FVIREPFI

SEQ ID NO: 272840 - protein, 8 aa, Influenza virus
VIREPFIS

SEQ ID NO: 272841 - protein, 8 aa, Influenza virus
IREPFISC

SEQ ID NO: 272842 - protein, 8 aa, Influenza virus
REPFISCS

SEQ ID NO: 272843 - protein, 8 aa, Influenza virus
EPFISCSP

SEQ ID NO: 272844 - protein, 8 aa, Influenza virus
PFISCSPL

SEQ ID NO: 272845 - protein, 8 aa, Influenza virus
FISCSPLE

SEQ ID NO: 272846 - protein, 8 aa, Influenza virus
ISCSPLEC

SEQ ID NO: 272847 - protein, 8 aa, Influenza virus
SCSPLECR

SEQ ID NO: 272848 - protein, 8 aa, Influenza virus
PLECRTFF

SEQ ID NO: 272849 - protein, 8 aa, Influenza virus
LECRTFFL

SEQ ID NO: 272850 - protein, 8 aa, Influenza virus
ECRTFFLT

SEQ ID NO: 272851 - protein, 8 aa, Influenza virus
CRTFFLTQ

SEQ ID NO: 272852 - protein, 8 aa, Influenza virus
RTFFLTQG

SEQ ID NO: 272853 - protein, 8 aa, Influenza virus
TFFLTQGA

SEQ ID NO: 272854 - protein, 8 aa, Influenza virus
FFLTQGAL

SEQ ID NO: 272855 - protein, 8 aa, Influenza virus
FLTQGALL

SEQ ID NO: 272856 - protein, 8 aa, Influenza virus
LTQGALLN

SEQ ID NO: 272857 - protein, 8 aa, Influenza virus
TQGALLND

SEQ ID NO: 272858 - protein, 8 aa, Influenza virus
QGALLNDK

SEQ ID NO: 272859 - protein, 8 aa, Influenza virus
GALLNDKH

SEQ ID NO: 272860 - protein, 8 aa, Influenza virus
ALLNDKHS

SEQ ID NO: 272861 - protein, 8 aa, Influenza virus
LLNDKHSN

SEQ ID NO: 272862 - protein, 8 aa, Influenza virus
LNDKHSNG

SEQ ID NO: 272863 - protein, 8 aa, Influenza virus
NDKHSNGT

SEQ ID NO: 272864 - protein, 8 aa, Influenza virus
DKHSNGTI

SEQ ID NO: 272865 - protein, 8 aa, Influenza virus
KHSNGTIK

SEQ ID NO: 272866 - protein, 8 aa, Influenza virus
HSNGTIKD

SEQ ID NO: 272867 - protein, 8 aa, Influenza virus
SNGTIKDR

SEQ ID NO: 272868 - protein, 8 aa, Influenza virus
NGTIKDRS

SEQ ID NO: 272869 - protein, 8 aa, Influenza virus
GTIKDRSP

SEQ ID NO: 272870 - protein, 8 aa, Influenza virus
KDRSPYRT

SEQ ID NO: 272871 - protein, 8 aa, Influenza virus
DRSPYRTL

SEQ ID NO: 272872 - protein, 8 aa, Influenza virus
RSPYRTLM

SEQ ID NO: 272873 - protein, 8 aa, Influenza virus
SPYRTLMS

SEQ ID NO: 272874 - protein, 8 aa, Influenza virus
PYRTLMSC

SEQ ID NO: 272875 - protein, 8 aa, Influenza virus
YRTLMSCP

SEQ ID NO: 272876 - protein, 8 aa, Influenza virus
RTLMSCPI

SEQ ID NO: 272877 - protein, 8 aa, Influenza virus
TLMSCPIG

SEQ ID NO: 272878 - protein, 8 aa, Influenza virus
LMSCPIGE

SEQ ID NO: 272879 - protein, 8 aa, Influenza virus
MSCPIGEV

SEQ ID NO: 272880 - protein, 8 aa, Influenza virus
SCPIGEVP

SEQ ID NO: 272881 - protein, 8 aa, Influenza virus
CPIGEVPS

SEQ ID NO: 272882 - protein, 8 aa, Influenza virus
PIGEVPSP

SEQ ID NO: 272883 - protein, 8 aa, Influenza virus
IGEVPSPY

SEQ ID NO: 272884 - protein, 8 aa, Influenza virus
GEVPSPYN

SEQ ID NO: 272885 - protein, 8 aa, Influenza virus
EVPSPYNS

SEQ ID NO: 272886 - protein, 8 aa, Influenza virus
VPSPYNSR

SEQ ID NO: 272887 - protein, 8 aa, Influenza virus
PSPYNSRF

SEQ ID NO: 272888 - protein, 8 aa, Influenza virus
SPYNSRFE

SEQ ID NO: 272889 - protein, 8 aa, Influenza virus
PYNSRFES

SEQ ID NO: 272890 - protein, 8 aa, Influenza virus
YNSRFESV

SEQ ID NO: 272891 - protein, 8 aa, Influenza virus
NSRFESVA

SEQ ID NO: 272892 - protein, 8 aa, Influenza virus
SRFESVAW

SEQ ID NO: 272893 - protein, 8 aa, Influenza virus
RFESVAWS

SEQ ID NO: 272894 - protein, 8 aa, Influenza virus
FESVAWSA

SEQ ID NO: 272895 - protein, 8 aa, Influenza virus
ESVAWSAS

SEQ ID NO: 272896 - protein, 8 aa, Influenza virus
SVAWSASA

SEQ ID NO: 272897 - protein, 8 aa, Influenza virus
VAWSASAC

SEQ ID NO: 272898 - protein, 8 aa, Influenza virus
AWSASACH

SEQ ID NO: 272899 - protein, 8 aa, Influenza virus
WSASACHD

SEQ ID NO: 272900 - protein, 8 aa, Influenza virus
SASACHDG

SEQ ID NO: 272901 - protein, 8 aa, Influenza virus
ASACHDGI

SEQ ID NO: 272902 - protein, 8 aa, Influenza virus
NWLTIGIS

SEQ ID NO: 272903 - protein, 8 aa, Influenza virus
WLTIGISG

SEQ ID NO: 272904 - protein, 8 aa, Influenza virus
LTIGISGP

SEQ ID NO: 272905 - protein, 8 aa, Influenza virus
TIGISGPD

SEQ ID NO: 272906 - protein, 8 aa, Influenza virus
IGISGPDN

SEQ ID NO: 272907 - protein, 8 aa, Influenza virus
GISGPDNG

SEQ ID NO: 272908 - protein, 8 aa, Influenza virus
ISGPDNGA

SEQ ID NO: 272909 - protein, 8 aa, Influenza virus
SGPDNGAV

SEQ ID NO: 272910 - protein, 8 aa, Influenza virus
GPDNGAVA

SEQ ID NO: 272911 - protein, 8 aa, Influenza virus
PDNGAVAV

SEQ ID NO: 272912 - protein, 8 aa, Influenza virus
DNGAVAVL

SEQ ID NO: 272913 - protein, 8 aa, Influenza virus
NGAVAVLK

SEQ ID NO: 272914 - protein, 8 aa, Influenza virus
GAVAVLKY

SEQ ID NO: 272915 - protein, 8 aa, Influenza virus
AVAVLKYN

SEQ ID NO: 272916 - protein, 8 aa, Influenza virus
VAVLKYNG

SEQ ID NO: 272917 - protein, 8 aa, Influenza virus
AVLKYNGI

SEQ ID NO: 272918 - protein, 8 aa, Influenza virus
VLKYNGII

SEQ ID NO: 272919 - protein, 8 aa, Influenza virus
LKYNGIIT

SEQ ID NO: 272920 - protein, 8 aa, Influenza virus
KYNGIITD

SEQ ID NO: 272921 - protein, 8 aa, Influenza virus
YNGIITDT

SEQ ID NO: 272922 - protein, 8 aa, Influenza virus
GIITDTIK

SEQ ID NO: 272923 - protein, 8 aa, Influenza virus
IITDTIKS

SEQ ID NO: 272924 - protein, 8 aa, Influenza virus
ITDTIKSW

SEQ ID NO: 272925 - protein, 8 aa, Influenza virus
NILRTQES

SEQ ID NO: 272926 - protein, 8 aa, Influenza virus
ILRTQESE

SEQ ID NO: 272927 - protein, 8 aa, Influenza virus
LRTQESEC

SEQ ID NO: 272928 - protein, 8 aa, Influenza virus
RTQESECA

SEQ ID NO: 272929 - protein, 8 aa, Influenza virus
TQESECAC

SEQ ID NO: 272930 - protein, 8 aa, Influenza virus
QESECACV

SEQ ID NO: 272931 - protein, 8 aa, Influenza virus
ESECACVN

SEQ ID NO: 272932 - protein, 8 aa, Influenza virus
SECACVNG

SEQ ID NO: 272933 - protein, 8 aa, Influenza virus
ECACVNGS

SEQ ID NO: 272934 - protein, 8 aa, Influenza virus
CACVNGSC

SEQ ID NO: 272935 - protein, 8 aa, Influenza virus
CVNGSCFT

SEQ ID NO: 272936 - protein, 8 aa, Influenza virus
NGSCFTVM

SEQ ID NO: 272937 - protein, 8 aa, Influenza virus
GSCFTVMT

SEQ ID NO: 272938 - protein, 8 aa, Influenza virus
SCFTVMTD

SEQ ID NO: 272939 - protein, 8 aa, Influenza virus
CFTVMTDG

SEQ ID NO: 272940 - protein, 8 aa, Influenza virus
FTVMTDGP

SEQ ID NO: 272941 - protein, 8 aa, Influenza virus
TVMTDGPS

SEQ ID NO: 272942 - protein, 8 aa, Influenza virus
VMGQASYK

SEQ ID NO: 272943 - protein, 8 aa, Influenza virus
APNYHYEE

SEQ ID NO: 272944 - protein, 8 aa, Influenza virus
PNYHYEEC

SEQ ID NO: 272945 - protein, 8 aa, Influenza virus
NYHYEECS

SEQ ID NO: 272946 - protein, 8 aa, Influenza virus
YHYEECSC

SEQ ID NO: 272947 - protein, 8 aa, Influenza virus
HYEECSCY

SEQ ID NO: 272948 - protein, 8 aa, Influenza virus
YEECSCYP

SEQ ID NO: 272949 - protein, 8 aa, Influenza virus
EECSCYPD

SEQ ID NO: 272950 - protein, 8 aa, Influenza virus
ECSCYPDS

SEQ ID NO: 272951 - protein, 8 aa, Influenza virus
ITCVCRDN

SEQ ID NO: 272952 - protein, 8 aa, Influenza virus
TCVCRDNW

SEQ ID NO: 272953 - protein, 8 aa, Influenza virus
CVCRDNWH

SEQ ID NO: 272954 - protein, 8 aa, Influenza virus
VCRDNWHG

SEQ ID NO: 272955 - protein, 8 aa, Influenza virus
CRDNWHGS

SEQ ID NO: 272956 - protein, 8 aa, Influenza virus
RDNWHGSN

SEQ ID NO: 272957 - protein, 8 aa, Influenza virus
DNWHGSNR

SEQ ID NO: 272958 - protein, 8 aa, Influenza virus
NWHGSNRP

SEQ ID NO: 272959 - protein, 8 aa, Influenza virus
WHGSNRPW

SEQ ID NO: 272960 - protein, 8 aa, Influenza virus
HGSNRPWV

SEQ ID NO: 272961 - protein, 8 aa, Influenza virus
GSNRPWVS

SEQ ID NO: 272962 - protein, 8 aa, Influenza virus
SNRPWVSF

SEQ ID NO: 272963 - protein, 8 aa, Influenza virus
NRPWVSFN

SEQ ID NO: 272964 - protein, 8 aa, Influenza virus
RPWVSFNQ

SEQ ID NO: 272965 - protein, 8 aa, Influenza virus
PWVSFNQN

SEQ ID NO: 272966 - protein, 8 aa, Influenza virus
WVSFNQNL

SEQ ID NO: 272967 - protein, 8 aa, Influenza virus
YQIGYICS

SEQ ID NO: 272968 - protein, 8 aa, Influenza virus
QIGYICSG

SEQ ID NO: 272969 - protein, 8 aa, Influenza virus
IGYICSGI

SEQ ID NO: 272970 - protein, 8 aa, Influenza virus
GYICSGIF

SEQ ID NO: 272971 - protein, 8 aa, Influenza virus
YICSGIFG

SEQ ID NO: 272972 - protein, 8 aa, Influenza virus
ICSGIFGD

SEQ ID NO: 272973 - protein, 8 aa, Influenza virus
CSGIFGDN

SEQ ID NO: 272974 - protein, 8 aa, Influenza virus
SGIFGDNP

SEQ ID NO: 272975 - protein, 8 aa, Influenza virus
GIFGDNPR

SEQ ID NO: 272976 - protein, 8 aa, Influenza virus
IFGDNPRP

SEQ ID NO: 272977 - protein, 8 aa, Influenza virus
GDNPRPND

SEQ ID NO: 272978 - protein, 8 aa, Influenza virus
GANGVKGF

SEQ ID NO: 272979 - protein, 8 aa, Influenza virus
ANGVKGFS

SEQ ID NO: 272980 - protein, 8 aa, Influenza virus
NGVKGFSF

SEQ ID NO: 272981 - protein, 8 aa, Influenza virus
GVKGFSFK

SEQ ID NO: 272982 - protein, 8 aa, Influenza virus
VKGFSFKY

SEQ ID NO: 272983 - protein, 8 aa, Influenza virus
KGFSFKYG

SEQ ID NO: 272984 - protein, 8 aa, Influenza virus
GFSFKYGN

SEQ ID NO: 272985 - protein, 8 aa, Influenza virus
FSFKYGNG

SEQ ID NO: 272986 - protein, 8 aa, Influenza virus
SFKYGNGV

SEQ ID NO: 272987 - protein, 8 aa, Influenza virus
FKYGNGVW

SEQ ID NO: 272988 - protein, 8 aa, Influenza virus
KYGNGVWI

SEQ ID NO: 272989 - protein, 8 aa, Influenza virus
YGNGVWIG

SEQ ID NO: 272990 - protein, 8 aa, Influenza virus
GNGVWIGR

SEQ ID NO: 272991 - protein, 8 aa, Influenza virus
NGVWIGRT

SEQ ID NO: 272992 - protein, 8 aa, Influenza virus
GVWIGRTK

SEQ ID NO: 272993 - protein, 8 aa, Influenza virus
VWIGRTKS

SEQ ID NO: 272994 - protein, 8 aa, Influenza virus
WIGRTKSI

SEQ ID NO: 272995 - protein, 8 aa, Influenza virus
GFEMIWDP

SEQ ID NO: 272996 - protein, 8 aa, Influenza virus
FEMIWDPN

SEQ ID NO: 272997 - protein, 8 aa, Influenza virus
EMIWDPNG

SEQ ID NO: 272998 - protein, 8 aa, Influenza virus
MIWDPNGW

SEQ ID NO: 272999 - protein, 8 aa, Influenza virus
IWDPNGWT

SEQ ID NO: 273000 - protein, 8 aa, Influenza virus
NEWSGYSG

SEQ ID NO: 273001 - protein, 8 aa, Influenza virus
EWSGYSGS

SEQ ID NO: 273002 - protein, 8 aa, Influenza virus
WSGYSGSF

SEQ ID NO: 273003 - protein, 8 aa, Influenza virus
SGYSGSFV

SEQ ID NO: 273004 - protein, 8 aa, Influenza virus
GYSGSFVQ

SEQ ID NO: 273005 - protein, 8 aa, Influenza virus
YSGSFVQH

SEQ ID NO: 273006 - protein, 8 aa, Influenza virus
SGSFVQHP

SEQ ID NO: 273007 - protein, 8 aa, Influenza virus
GSFVQHPE

SEQ ID NO: 273008 - protein, 8 aa, Influenza virus
SFVQHPEL

SEQ ID NO: 273009 - protein, 8 aa, Influenza virus
FVQHPELT

SEQ ID NO: 273010 - protein, 8 aa, Influenza virus
VQHPELTG

SEQ ID NO: 273011 - protein, 8 aa, Influenza virus
QHPELTGL

SEQ ID NO: 273012 - protein, 8 aa, Influenza virus
HPELTGLD

SEQ ID NO: 273013 - protein, 8 aa, Influenza virus
PELTGLDC

SEQ ID NO: 273014 - protein, 8 aa, Influenza virus
ELTGLDCI

SEQ ID NO: 273015 - protein, 8 aa, Influenza virus
DCIRPCFW

SEQ ID NO: 273016 - protein, 8 aa, Influenza virus
CIRPCFWV

SEQ ID NO: 273017 - protein, 8 aa, Influenza virus
IRPCFWVE

SEQ ID NO: 273018 - protein, 8 aa, Influenza virus
RPCFWVEL

SEQ ID NO: 273019 - protein, 8 aa, Influenza virus
PCFWVELI

SEQ ID NO: 273020 - protein, 8 aa, Influenza virus
CFWVELIR

SEQ ID NO: 273021 - protein, 8 aa, Influenza virus
FWVELIRG

SEQ ID NO: 273022 - protein, 8 aa, Influenza virus
WVELIRGR

SEQ ID NO: 273023 - protein, 8 aa, Influenza virus
VELIRGRP

SEQ ID NO: 273024 - protein, 8 aa, Influenza virus
TTIWTSGS

SEQ ID NO: 273025 - protein, 8 aa, Influenza virus
TIWTSGSS

SEQ ID NO: 273026 - protein, 8 aa, Influenza virus
IWTSGSSI

SEQ ID NO: 273027 - protein, 8 aa, Influenza virus
WTSGSSIS

SEQ ID NO: 273028 - protein, 8 aa, Influenza virus
TSGSSISF

SEQ ID NO: 273029 - protein, 8 aa, Influenza virus
SGSSISFC

SEQ ID NO: 273030 - protein, 8 aa, Influenza virus
GSSISFCG

SEQ ID NO: 273031 - protein, 8 aa, Influenza virus
SSISFCGV

SEQ ID NO: 273032 - protein, 8 aa, Influenza virus
SISFCGVN

SEQ ID NO: 273033 - protein, 8 aa, Influenza virus
ISFCGVNS

SEQ ID NO: 273034 - protein, 8 aa, Influenza virus
GWSWPDGA

SEQ ID NO: 273035 - protein, 8 aa, Influenza virus
WSWPDGAE

SEQ ID NO: 273036 - protein, 8 aa, Influenza virus
SWPDGAEL

SEQ ID NO: 273037 - protein, 8 aa, Influenza virus
WPDGAELP

SEQ ID NO: 273038 - protein, 8 aa, Influenza virus
PDGAELPF

SEQ ID NO: 273039 - protein, 8 aa, Influenza virus
DGAELPFT

SEQ ID NO: 273040 - protein, 8 aa, Influenza virus
GAELPFTI

SEQ ID NO: 273041 - protein, 8 aa, Influenza virus
LPFTQEQK

SEQ ID NO: 273042 - protein, 8 aa, Influenza virus
DTICIGYH

SEQ ID NO: 273043 - protein, 8 aa, Influenza virus
TICIGYHA

SEQ ID NO: 273044 - protein, 8 aa, Influenza virus
ICIGYHAN

SEQ ID NO: 273045 - protein, 8 aa, Influenza virus
CIGYHANN

SEQ ID NO: 273046 - protein, 8 aa, Influenza virus
IGYHANNS

SEQ ID NO: 273047 - protein, 8 aa, Influenza virus
GYHANNST

SEQ ID NO: 273048 - protein, 8 aa, Influenza virus
YHANNSTD

SEQ ID NO: 273049 - protein, 8 aa, Influenza virus
HANNSTDT

SEQ ID NO: 273050 - protein, 8 aa, Influenza virus
ANNSTDTV

SEQ ID NO: 273051 - protein, 8 aa, Influenza virus
NNSTDTVD

SEQ ID NO: 273052 - protein, 8 aa, Influenza virus
NSTDTVDT

SEQ ID NO: 273053 - protein, 8 aa, Influenza virus
EKNVTVTH

SEQ ID NO: 273054 - protein, 8 aa, Influenza virus
KNVTVTHS

SEQ ID NO: 273055 - protein, 8 aa, Influenza virus
NVTVTHSV

SEQ ID NO: 273056 - protein, 8 aa, Influenza virus
VTVTHSVN

SEQ ID NO: 273057 - protein, 8 aa, Influenza virus
TVTHSVNL

SEQ ID NO: 273058 - protein, 8 aa, Influenza virus
VTHSVNLL

SEQ ID NO: 273059 - protein, 8 aa, Influenza virus
THSVNLLE

SEQ ID NO: 273060 - protein, 8 aa, Influenza virus
HNGKLCLL

SEQ ID NO: 273061 - protein, 8 aa, Influenza virus
VAGWILGN

SEQ ID NO: 273062 - protein, 8 aa, Influenza virus
AGWILGNP

SEQ ID NO: 273063 - protein, 8 aa, Influenza virus
GWILGNPE

SEQ ID NO: 273064 - protein, 8 aa, Influenza virus
WILGNPEC

SEQ ID NO: 273065 - protein, 8 aa, Influenza virus
DYEELREQ

SEQ ID NO: 273066 - protein, 8 aa, Influenza virus
YEELREQL

SEQ ID NO: 273067 - protein, 8 aa, Influenza virus
EELREQLS

SEQ ID NO: 273068 - protein, 8 aa, Influenza virus
GRINYYWT

SEQ ID NO: 273069 - protein, 8 aa, Influenza virus
LPFQNVHP

SEQ ID NO: 273070 - protein, 8 aa, Influenza virus
PFQNVHPV

SEQ ID NO: 273071 - protein, 8 aa, Influenza virus
FQNVHPVT

SEQ ID NO: 273072 - protein, 8 aa, Influenza virus
QNVHPVTI

SEQ ID NO: 273073 - protein, 8 aa, Influenza virus
NVHPVTIG

SEQ ID NO: 273074 - protein, 8 aa, Influenza virus
HPVTIGEC

SEQ ID NO: 273075 - protein, 8 aa, Influenza virus
PVTIGECP

SEQ ID NO: 273076 - protein, 8 aa, Influenza virus
VTIGECPK

SEQ ID NO: 273077 - protein, 8 aa, Influenza virus
TIGECPKY

SEQ ID NO: 273078 - protein, 8 aa, Influenza virus
IGECPKYV

SEQ ID NO: 273079 - protein, 8 aa, Influenza virus
GECPKYVK

SEQ ID NO: 273080 - protein, 8 aa, Influenza virus
ECPKYVKS

SEQ ID NO: 273081 - protein, 8 aa, Influenza virus
LRMVTGLR

SEQ ID NO: 273082 - protein, 8 aa, Influenza virus
RMVTGLRN

SEQ ID NO: 273083 - protein, 8 aa, Influenza virus
TGLRNIPS

SEQ ID NO: 273084 - protein, 8 aa, Influenza virus
GLRNIPSI

SEQ ID NO: 273085 - protein, 8 aa, Influenza virus
PSIQSRGL

SEQ ID NO: 273086 - protein, 8 aa, Influenza virus
SIQSRGLF

SEQ ID NO: 273087 - protein, 8 aa, Influenza virus
IQSRGLFG

SEQ ID NO: 273088 - protein, 8 aa, Influenza virus
QSRGLFGA

SEQ ID NO: 273089 - protein, 8 aa, Influenza virus
SRGLFGAI

SEQ ID NO: 273090 - protein, 8 aa, Influenza virus
RGLFGAIA

SEQ ID NO: 273091 - protein, 8 aa, Influenza virus
GLFGAIAG

SEQ ID NO: 273092 - protein, 8 aa, Influenza virus
LFGAIAGF

SEQ ID NO: 273093 - protein, 8 aa, Influenza virus
FGAIAGFI

SEQ ID NO: 273094 - protein, 8 aa, Influenza virus
GAIAGFIE

SEQ ID NO: 273095 - protein, 8 aa, Influenza virus
AIAGFIEG

SEQ ID NO: 273096 - protein, 8 aa, Influenza virus
IAGFIEGG

SEQ ID NO: 273097 - protein, 8 aa, Influenza virus
AGFIEGGW

SEQ ID NO: 273098 - protein, 8 aa, Influenza virus
GFIEGGWT

SEQ ID NO: 273099 - protein, 8 aa, Influenza virus
FIEGGWTG

SEQ ID NO: 273100 - protein, 8 aa, Influenza virus
IEGGWTGM

SEQ ID NO: 273101 - protein, 8 aa, Influenza virus
EGGWTGMI

SEQ ID NO: 273102 - protein, 8 aa, Influenza virus
GGWTGMID

SEQ ID NO: 273103 - protein, 8 aa, Influenza virus
GWTGMIDG

SEQ ID NO: 273104 - protein, 8 aa, Influenza virus
WTGMIDGW

SEQ ID NO: 273105 - protein, 8 aa, Influenza virus
TGMIDGWY

SEQ ID NO: 273106 - protein, 8 aa, Influenza virus
GMIDGWYG

SEQ ID NO: 273107 - protein, 8 aa, Influenza virus
MIDGWYGY

SEQ ID NO: 273108 - protein, 8 aa, Influenza virus
NEQGSGYA

SEQ ID NO: 273109 - protein, 8 aa, Influenza virus
EQGSGYAA

SEQ ID NO: 273110 - protein, 8 aa, Influenza virus
QGSGYAAD

SEQ ID NO: 273111 - protein, 8 aa, Influenza virus
TNKVNSVI

SEQ ID NO: 273112 - protein, 8 aa, Influenza virus
ENLNKKVD

SEQ ID NO: 273113 - protein, 8 aa, Influenza virus
NLNKKVDD

SEQ ID NO: 273114 - protein, 8 aa, Influenza virus
LNKKVDDG

SEQ ID NO: 273115 - protein, 8 aa, Influenza virus
NKKVDDGF

SEQ ID NO: 273116 - protein, 8 aa, Influenza virus
KVDDGFLD

SEQ ID NO: 273117 - protein, 8 aa, Influenza virus
DIWTYNAE

SEQ ID NO: 273118 - protein, 8 aa, Influenza virus
IWTYNAEL

SEQ ID NO: 273119 - protein, 8 aa, Influenza virus
WTYNAELL

SEQ ID NO: 273120 - protein, 8 aa, Influenza virus
TYNAELLV

SEQ ID NO: 273121 - protein, 8 aa, Influenza virus
YNAELLVL

SEQ ID NO: 273122 - protein, 8 aa, Influenza virus
NAELLVLL

SEQ ID NO: 273123 - protein, 8 aa, Influenza virus
AELLVLLE

SEQ ID NO: 273124 - protein, 8 aa, Influenza virus
ELLVLLEN

SEQ ID NO: 273125 - protein, 8 aa, Influenza virus
LLVLLENE

SEQ ID NO: 273126 - protein, 8 aa, Influenza virus
LVLLENER

SEQ ID NO: 273127 - protein, 8 aa, Influenza virus
VLLENERT

SEQ ID NO: 273128 - protein, 8 aa, Influenza virus
LLENERTL

SEQ ID NO: 273129 - protein, 8 aa, Influenza virus
LENERTLD

SEQ ID NO: 273130 - protein, 8 aa, Influenza virus
ENERTLDF

SEQ ID NO: 273131 - protein, 8 aa, Influenza virus
NERTLDFH

SEQ ID NO: 273132 - protein, 8 aa, Influenza virus
ERTLDFHD

SEQ ID NO: 273133 - protein, 8 aa, Influenza virus
RTLDFHDS

SEQ ID NO: 273134 - protein, 8 aa, Influenza virus
TLDFHDSN

SEQ ID NO: 273135 - protein, 8 aa, Influenza virus
LDFHDSNV

SEQ ID NO: 273136 - protein, 8 aa, Influenza virus
QLKNNAKE

SEQ ID NO: 273137 - protein, 8 aa, Influenza virus
NNAKEIGN

SEQ ID NO: 273138 - protein, 8 aa, Influenza virus
NAKEIGNG

SEQ ID NO: 273139 - protein, 8 aa, Influenza virus
AKEIGNGC

SEQ ID NO: 273140 - protein, 8 aa, Influenza virus
KEIGNGCF

SEQ ID NO: 273141 - protein, 8 aa, Influenza virus
EIGNGCFE

SEQ ID NO: 273142 - protein, 8 aa, Influenza virus
IGNGCFEF

SEQ ID NO: 273143 - protein, 8 aa, Influenza virus
GNGCFEFY

SEQ ID NO: 273144 - protein, 8 aa, Influenza virus
NGCFEFYH

SEQ ID NO: 273145 - protein, 8 aa, Influenza virus
GCFEFYHK

SEQ ID NO: 273146 - protein, 8 aa, Influenza virus
CFEFYHKC

SEQ ID NO: 273147 - protein, 8 aa, Influenza virus
FEFYHKCN

SEQ ID NO: 273148 - protein, 8 aa, Influenza virus
EFYHKCNN

SEQ ID NO: 273149 - protein, 8 aa, Influenza virus
CMESVKNG

SEQ ID NO: 273150 - protein, 8 aa, Influenza virus
MESVKNGT

SEQ ID NO: 273151 - protein, 8 aa, Influenza virus
ESVKNGTY

SEQ ID NO: 273152 - protein, 8 aa, Influenza virus
SVKNGTYD

SEQ ID NO: 273153 - protein, 8 aa, Influenza virus
VKNGTYDY

SEQ ID NO: 273154 - protein, 8 aa, Influenza virus
YQILAIYS

SEQ ID NO: 273155 - protein, 8 aa, Influenza virus
QILAIYST

SEQ ID NO: 273156 - protein, 8 aa, Influenza virus
ILAIYSTV

SEQ ID NO: 273157 - protein, 8 aa, Influenza virus
SFWMCSNG

SEQ ID NO: 273158 - protein, 8 aa, Influenza virus
FWMCSNGS

SEQ ID NO: 273159 - protein, 8 aa, Influenza virus
WMCSNGSL

SEQ ID NO: 273160 - protein, 8 aa, Influenza virus
MCSNGSLQ

SEQ ID NO: 273161 - protein, 8 aa, Influenza virus
CSNGSLQC

SEQ ID NO: 273162 - protein, 8 aa, Influenza virus
SNGSLQCR

SEQ ID NO: 273163 - protein, 8 aa, Influenza virus
NGSLQCRI

SEQ ID NO: 273164 - protein, 8 aa, Influenza virus
GSLQCRIC

SEQ ID NO: 273165 - protein, 8 aa, Influenza virus
SLQCRICI

SEQ ID NO: 273166 - protein, 8 aa, Influenza virus
KNNQVILC

SEQ ID NO: 273167 - protein, 8 aa, Influenza virus
YRNWSKPQ

SEQ ID NO: 273168 - protein, 8 aa, Influenza virus
RNWSKPQC

SEQ ID NO: 273169 - protein, 8 aa, Influenza virus
ITGFAPFS

SEQ ID NO: 273170 - protein, 8 aa, Influenza virus
TGFAPFSK

SEQ ID NO: 273171 - protein, 8 aa, Influenza virus
GFAPFSKD

SEQ ID NO: 273172 - protein, 8 aa, Influenza virus
FAPFSKDN

SEQ ID NO: 273173 - protein, 8 aa, Influenza virus
APFSKDNS

SEQ ID NO: 273174 - protein, 8 aa, Influenza virus
PFSKDNSI

SEQ ID NO: 273175 - protein, 8 aa, Influenza virus
FSKDNSIR

SEQ ID NO: 273176 - protein, 8 aa, Influenza virus
SKDNSIRL

SEQ ID NO: 273177 - protein, 8 aa, Influenza virus
KDNSIRLS

SEQ ID NO: 273178 - protein, 8 aa, Influenza virus
DNSIRLSA

SEQ ID NO: 273179 - protein, 8 aa, Influenza virus
NSIRLSAG

SEQ ID NO: 273180 - protein, 8 aa, Influenza virus
SIRLSAGG

SEQ ID NO: 273181 - protein, 8 aa, Influenza virus
IRLSAGGD

SEQ ID NO: 273182 - protein, 8 aa, Influenza virus
RLSAGGDI

SEQ ID NO: 273183 - protein, 8 aa, Influenza virus
LSAGGDIW

SEQ ID NO: 273184 - protein, 8 aa, Influenza virus
SAGGDIWV

SEQ ID NO: 273185 - protein, 8 aa, Influenza virus
AGGDIWVT

SEQ ID NO: 273186 - protein, 8 aa, Influenza virus
GGDIWVTR

SEQ ID NO: 273187 - protein, 8 aa, Influenza virus
GDIWVTRE

SEQ ID NO: 273188 - protein, 8 aa, Influenza virus
DIWVTREP

SEQ ID NO: 273189 - protein, 8 aa, Influenza virus
IWVTREPY

SEQ ID NO: 273190 - protein, 8 aa, Influenza virus
WVTREPYV

SEQ ID NO: 273191 - protein, 8 aa, Influenza virus
VTREPYVS

SEQ ID NO: 273192 - protein, 8 aa, Influenza virus
TREPYVSC

SEQ ID NO: 273193 - protein, 8 aa, Influenza virus
REPYVSCD

SEQ ID NO: 273194 - protein, 8 aa, Influenza virus
KCYQFALG

SEQ ID NO: 273195 - protein, 8 aa, Influenza virus
CYQFALGQ

SEQ ID NO: 273196 - protein, 8 aa, Influenza virus
YQFALGQG

SEQ ID NO: 273197 - protein, 8 aa, Influenza virus
QFALGQGT

SEQ ID NO: 273198 - protein, 8 aa, Influenza virus
FALGQGTT

SEQ ID NO: 273199 - protein, 8 aa, Influenza virus
ALGQGTTL

SEQ ID NO: 273200 - protein, 8 aa, Influenza virus
LGQGTTLN

SEQ ID NO: 273201 - protein, 8 aa, Influenza virus
GQGTTLNN

SEQ ID NO: 273202 - protein, 8 aa, Influenza virus
DRTPYRTL

SEQ ID NO: 273203 - protein, 8 aa, Influenza virus
RTPYRTLL

SEQ ID NO: 273204 - protein, 8 aa, Influenza virus
TPYRTLLM

SEQ ID NO: 273205 - protein, 8 aa, Influenza virus
PYRTLLMN

SEQ ID NO: 273206 - protein, 8 aa, Influenza virus
YRTLLMNE

SEQ ID NO: 273207 - protein, 8 aa, Influenza virus
RTLLMNEL

SEQ ID NO: 273208 - protein, 8 aa, Influenza virus
TLLMNELG

SEQ ID NO: 273209 - protein, 8 aa, Influenza virus
LLMNELGV

SEQ ID NO: 273210 - protein, 8 aa, Influenza virus
LMNELGVP

SEQ ID NO: 273211 - protein, 8 aa, Influenza virus
MNELGVPF

SEQ ID NO: 273212 - protein, 8 aa, Influenza virus
NELGVPFH

SEQ ID NO: 273213 - protein, 8 aa, Influenza virus
ELGVPFHL

SEQ ID NO: 273214 - protein, 8 aa, Influenza virus
LGVPFHLG

SEQ ID NO: 273215 - protein, 8 aa, Influenza virus
GVPFHLGT

SEQ ID NO: 273216 - protein, 8 aa, Influenza virus
VPFHLGTK

SEQ ID NO: 273217 - protein, 8 aa, Influenza virus
PFHLGTKQ

SEQ ID NO: 273218 - protein, 8 aa, Influenza virus
FHLGTKQV

SEQ ID NO: 273219 - protein, 8 aa, Influenza virus
HLGTKQVC

SEQ ID NO: 273220 - protein, 8 aa, Influenza virus
LGTKQVCI

SEQ ID NO: 273221 - protein, 8 aa, Influenza virus
GTKQVCIA

SEQ ID NO: 273222 - protein, 8 aa, Influenza virus
TKQVCIAW

SEQ ID NO: 273223 - protein, 8 aa, Influenza virus
KQVCIAWS

SEQ ID NO: 273224 - protein, 8 aa, Influenza virus
QVCIAWSS

SEQ ID NO: 273225 - protein, 8 aa, Influenza virus
VCIAWSSS

SEQ ID NO: 273226 - protein, 8 aa, Influenza virus
CIAWSSSS

SEQ ID NO: 273227 - protein, 8 aa, Influenza virus
IAWSSSSC

SEQ ID NO: 273228 - protein, 8 aa, Influenza virus
AWSSSSCH

SEQ ID NO: 273229 - protein, 8 aa, Influenza virus
WSSSSCHD

SEQ ID NO: 273230 - protein, 8 aa, Influenza virus
SSSSCHDG

SEQ ID NO: 273231 - protein, 8 aa, Influenza virus
SSSCHDGK

SEQ ID NO: 273232 - protein, 8 aa, Influenza virus
SSCHDGKA

SEQ ID NO: 273233 - protein, 8 aa, Influenza virus
SCHDGKAW

SEQ ID NO: 273234 - protein, 8 aa, Influenza virus
CHDGKAWL

SEQ ID NO: 273235 - protein, 8 aa, Influenza virus
HDGKAWLH

SEQ ID NO: 273236 - protein, 8 aa, Influenza virus
DGKAWLHV

SEQ ID NO: 273237 - protein, 8 aa, Influenza virus
GKAWLHVC

SEQ ID NO: 273238 - protein, 8 aa, Influenza virus
AWLHVCVT

SEQ ID NO: 273239 - protein, 8 aa, Influenza virus
WLHVCVTG

SEQ ID NO: 273240 - protein, 8 aa, Influenza virus
NATASFIY

SEQ ID NO: 273241 - protein, 8 aa, Influenza virus
NILRTQES

SEQ ID NO: 273242 - protein, 8 aa, Influenza virus
ILRTQESE

SEQ ID NO: 273243 - protein, 8 aa, Influenza virus
LRTQESEC

SEQ ID NO: 273244 - protein, 8 aa, Influenza virus
RTQESECV

SEQ ID NO: 273245 - protein, 8 aa, Influenza virus
TQESECVC

SEQ ID NO: 273246 - protein, 8 aa, Influenza virus
QESECVCI

SEQ ID NO: 273247 - protein, 8 aa, Influenza virus
ESECVCIN

SEQ ID NO: 273248 - protein, 8 aa, Influenza virus
TCTVVMTD

SEQ ID NO: 273249 - protein, 8 aa, Influenza virus
CTVVMTDG

SEQ ID NO: 273250 - protein, 8 aa, Influenza virus
TVVMTDGS

SEQ ID NO: 273251 - protein, 8 aa, Influenza virus
VVMTDGSA

SEQ ID NO: 273252 - protein, 8 aa, Influenza virus
VMTDGSAS

SEQ ID NO: 273253 - protein, 8 aa, Influenza virus
MTDGSASG

SEQ ID NO: 273254 - protein, 8 aa, Influenza virus
GSAQHVEE

SEQ ID NO: 273255 - protein, 8 aa, Influenza virus
SAQHVEEC

SEQ ID NO: 273256 - protein, 8 aa, Influenza virus
AQHVEECS

SEQ ID NO: 273257 - protein, 8 aa, Influenza virus
QHVEECSC

SEQ ID NO: 273258 - protein, 8 aa, Influenza virus
HVEECSCY

SEQ ID NO: 273259 - protein, 8 aa, Influenza virus
VEECSCYP

SEQ ID NO: 273260 - protein, 8 aa, Influenza virus
EECSCYPR

SEQ ID NO: 273261 - protein, 8 aa, Influenza virus
ECSCYPRY

SEQ ID NO: 273262 - protein, 8 aa, Influenza virus
CSCYPRYP

SEQ ID NO: 273263 - protein, 8 aa, Influenza virus
VRCVCRDN

SEQ ID NO: 273264 - protein, 8 aa, Influenza virus
RCVCRDNW

SEQ ID NO: 273265 - protein, 8 aa, Influenza virus
CVCRDNWK

SEQ ID NO: 273266 - protein, 8 aa, Influenza virus
VCRDNWKG

SEQ ID NO: 273267 - protein, 8 aa, Influenza virus
CRDNWKGS

SEQ ID NO: 273268 - protein, 8 aa, Influenza virus
RDNWKGSN

SEQ ID NO: 273269 - protein, 8 aa, Influenza virus
DNWKGSNR

SEQ ID NO: 273270 - protein, 8 aa, Influenza virus
NWKGSNRP

SEQ ID NO: 273271 - protein, 8 aa, Influenza virus
WKGSNRPI

SEQ ID NO: 273272 - protein, 8 aa, Influenza virus
KGSNRPIV

SEQ ID NO: 273273 - protein, 8 aa, Influenza virus
GSNRPIVD

SEQ ID NO: 273274 - protein, 8 aa, Influenza virus
SNRPIVDI

SEQ ID NO: 273275 - protein, 8 aa, Influenza virus
SSYVCSGL

SEQ ID NO: 273276 - protein, 8 aa, Influenza virus
SYVCSGLV

SEQ ID NO: 273277 - protein, 8 aa, Influenza virus
YVCSGLVG

SEQ ID NO: 273278 - protein, 8 aa, Influenza virus
VCSGLVGD

SEQ ID NO: 273279 - protein, 8 aa, Influenza virus
CSGLVGDT

SEQ ID NO: 273280 - protein, 8 aa, Influenza virus
SGLVGDTP

SEQ ID NO: 273281 - protein, 8 aa, Influenza virus
GLVGDTPR

SEQ ID NO: 273282 - protein, 8 aa, Influenza virus
GGHGVKGW

SEQ ID NO: 273283 - protein, 8 aa, Influenza virus
GHGVKGWA

SEQ ID NO: 273284 - protein, 8 aa, Influenza virus
HGVKGWAF

SEQ ID NO: 273285 - protein, 8 aa, Influenza virus
GVKGWAFD

SEQ ID NO: 273286 - protein, 8 aa, Influenza virus
VKGWAFDD

SEQ ID NO: 273287 - protein, 8 aa, Influenza virus
DVWMGRTI

SEQ ID NO: 273288 - protein, 8 aa, Influenza virus
LRSGYETF

SEQ ID NO: 273289 - protein, 8 aa, Influenza virus
RSGYETFK

SEQ ID NO: 273290 - protein, 8 aa, Influenza virus
SGYETFKV

SEQ ID NO: 273291 - protein, 8 aa, Influenza virus
GYETFKVI

SEQ ID NO: 273292 - protein, 8 aa, Influenza virus
RSGYSGIF

SEQ ID NO: 273293 - protein, 8 aa, Influenza virus
SGYSGIFS

SEQ ID NO: 273294 - protein, 8 aa, Influenza virus
GYSGIFSV

SEQ ID NO: 273295 - protein, 8 aa, Influenza virus
YSGIFSVE

SEQ ID NO: 273296 - protein, 8 aa, Influenza virus
SCINRCFY

SEQ ID NO: 273297 - protein, 8 aa, Influenza virus
CINRCFYV

SEQ ID NO: 273298 - protein, 8 aa, Influenza virus
INRCFYVE

SEQ ID NO: 273299 - protein, 8 aa, Influenza virus
NRCFYVEL

SEQ ID NO: 273300 - protein, 8 aa, Influenza virus
RCFYVELI

SEQ ID NO: 273301 - protein, 8 aa, Influenza virus
CFYVELIR

SEQ ID NO: 273302 - protein, 8 aa, Influenza virus
FYVELIRG

SEQ ID NO: 273303 - protein, 8 aa, Influenza virus
YVELIRGR

SEQ ID NO: 273304 - protein, 8 aa, Influenza virus
VELIRGRK

SEQ ID NO: 273305 - protein, 8 aa, Influenza virus
VWWTSNSI

SEQ ID NO: 273306 - protein, 8 aa, Influenza virus
WWTSNSIV

SEQ ID NO: 273307 - protein, 8 aa, Influenza virus
WTSNSIVV

SEQ ID NO: 273308 - protein, 8 aa, Influenza virus
TSNSIVVF

SEQ ID NO: 273309 - protein, 8 aa, Influenza virus
SNSIVVFC

SEQ ID NO: 273310 - protein, 8 aa, Influenza virus
NSIVVFCG

SEQ ID NO: 273311 - protein, 8 aa, Influenza virus
SIVVFCGT

SEQ ID NO: 273312 - protein, 8 aa, Influenza virus
IVVFCGTS

SEQ ID NO: 273313 - protein, 8 aa, Influenza virus
VVFCGTSG

SEQ ID NO: 273314 - protein, 8 aa, Influenza virus
VFCGTSGT

SEQ ID NO: 273315 - protein, 8 aa, Influenza virus
FCGTSGTY

SEQ ID NO: 273316 - protein, 8 aa, Influenza virus
CGTSGTYG

SEQ ID NO: 273317 - protein, 8 aa, Influenza virus
TSGTYGTG

SEQ ID NO: 273318 - protein, 8 aa, Influenza virus
GTYGTGSW

SEQ ID NO: 273319 - protein, 8 aa, Influenza virus
TYGTGSWP

SEQ ID NO: 273320 - protein, 8 aa, Influenza virus
YGTGSWPD

SEQ ID NO: 273321 - protein, 8 aa, Influenza virus
GTGSWPDG

SEQ ID NO: 273322 - protein, 8 aa, Influenza virus
TGSWPDGA

SEQ ID NO: 273323 - protein, 8 aa, Influenza virus
GSWPDGAD

SEQ ID NO: 273324 - protein, 8 aa, Influenza virus
SWPDGADI

SEQ ID NO: 273325 - protein, 8 aa, Influenza virus
RTSISCLY

SEQ ID NO: 273326 - protein, 8 aa, Influenza virus
SISCLYKL

SEQ ID NO: 273327 - protein, 8 aa, Influenza virus
ISCLYKLS

SEQ ID NO: 273328 - protein, 8 aa, Influenza virus
SCLYKLSQ

SEQ ID NO: 273329 - protein, 8 aa, Influenza virus
CLYKLSQF

SEQ ID NO: 273330 - protein, 8 aa, Influenza virus
MDNQTKTM

SEQ ID NO: 273331 - protein, 8 aa, Influenza virus
DNQTKTMT

SEQ ID NO: 273332 - protein, 8 aa, Influenza virus
NQTKTMTI

SEQ ID NO: 273333 - protein, 8 aa, Influenza virus
QTKTMTIT

SEQ ID NO: 273334 - protein, 8 aa, Influenza virus
TKTMTITF

SEQ ID NO: 273335 - protein, 8 aa, Influenza virus
KTMTITFL

SEQ ID NO: 273336 - protein, 8 aa, Influenza virus
TMTITFLI

SEQ ID NO: 273337 - protein, 8 aa, Influenza virus
GDQICIGY

SEQ ID NO: 273338 - protein, 8 aa, Influenza virus
DQICIGYH

SEQ ID NO: 273339 - protein, 8 aa, Influenza virus
QICIGYHA

SEQ ID NO: 273340 - protein, 8 aa, Influenza virus
ICIGYHAN

SEQ ID NO: 273341 - protein, 8 aa, Influenza virus
CIGYHANN

SEQ ID NO: 273342 - protein, 8 aa, Influenza virus
IGYHANNS

SEQ ID NO: 273343 - protein, 8 aa, Influenza virus
GYHANNST

SEQ ID NO: 273344 - protein, 8 aa, Influenza virus
YHANNSTE

SEQ ID NO: 273345 - protein, 8 aa, Influenza virus
HANNSTEK

SEQ ID NO: 273346 - protein, 8 aa, Influenza virus
NNSTEKVD

SEQ ID NO: 273347 - protein, 8 aa, Influenza virus
NSTEKVDT

SEQ ID NO: 273348 - protein, 8 aa, Influenza virus
VDTILERN

SEQ ID NO: 273349 - protein, 8 aa, Influenza virus
DTILERNV

SEQ ID NO: 273350 - protein, 8 aa, Influenza virus
TILERNVT

SEQ ID NO: 273351 - protein, 8 aa, Influenza virus
ILERNVTV

SEQ ID NO: 273352 - protein, 8 aa, Influenza virus
LERNVTVT

SEQ ID NO: 273353 - protein, 8 aa, Influenza virus
ERNVTVTH

SEQ ID NO: 273354 - protein, 8 aa, Influenza virus
RNVTVTHA

SEQ ID NO: 273355 - protein, 8 aa, Influenza virus
NVTVTHAK

SEQ ID NO: 273356 - protein, 8 aa, Influenza virus
VTVTHAKD

SEQ ID NO: 273357 - protein, 8 aa, Influenza virus
TVTHAKDI

SEQ ID NO: 273358 - protein, 8 aa, Influenza virus
VTHAKDIL

SEQ ID NO: 273359 - protein, 8 aa, Influenza virus
THAKDILE

SEQ ID NO: 273360 - protein, 8 aa, Influenza virus
HAKDILEK

SEQ ID NO: 273361 - protein, 8 aa, Influenza virus
DILEKTHN

SEQ ID NO: 273362 - protein, 8 aa, Influenza virus
ILEKTHNG

SEQ ID NO: 273363 - protein, 8 aa, Influenza virus
LEKTHNGK

SEQ ID NO: 273364 - protein, 8 aa, Influenza virus
EKTHNGKL

SEQ ID NO: 273365 - protein, 8 aa, Influenza virus
KTHNGKLC

SEQ ID NO: 273366 - protein, 8 aa, Influenza virus
THNGKLCK

SEQ ID NO: 273367 - protein, 8 aa, Influenza virus
HNGKLCKL

SEQ ID NO: 273368 - protein, 8 aa, Influenza virus
NGKLCKLN

SEQ ID NO: 273369 - protein, 8 aa, Influenza virus
GKLCKLNG

SEQ ID NO: 273370 - protein, 8 aa, Influenza virus
LNGIPPLE

SEQ ID NO: 273371 - protein, 8 aa, Influenza virus
NGIPPLEL

SEQ ID NO: 273372 - protein, 8 aa, Influenza virus
GIPPLELG

SEQ ID NO: 273373 - protein, 8 aa, Influenza virus
IPPLELGD

SEQ ID NO: 273374 - protein, 8 aa, Influenza virus
PPLELGDC

SEQ ID NO: 273375 - protein, 8 aa, Influenza virus
PLELGDCS

SEQ ID NO: 273376 - protein, 8 aa, Influenza virus
LELGDCSI

SEQ ID NO: 273377 - protein, 8 aa, Influenza virus
ELGDCSIA

SEQ ID NO: 273378 - protein, 8 aa, Influenza virus
LGDCSIAG

SEQ ID NO: 273379 - protein, 8 aa, Influenza virus
GDCSIAGW

SEQ ID NO: 273380 - protein, 8 aa, Influenza virus
DCSIAGWL

SEQ ID NO: 273381 - protein, 8 aa, Influenza virus
CSIAGWLL

SEQ ID NO: 273382 - protein, 8 aa, Influenza virus
SIAGWLLG

SEQ ID NO: 273383 - protein, 8 aa, Influenza virus
IAGWLLGN

SEQ ID NO: 273384 - protein, 8 aa, Influenza virus
AGWLLGNP

SEQ ID NO: 273385 - protein, 8 aa, Influenza virus
GWLLGNPE

SEQ ID NO: 273386 - protein, 8 aa, Influenza virus
WLLGNPEC

SEQ ID NO: 273387 - protein, 8 aa, Influenza virus
LLGNPECD

SEQ ID NO: 273388 - protein, 8 aa, Influenza virus
LGNPECDR

SEQ ID NO: 273389 - protein, 8 aa, Influenza virus
GNPECDRL

SEQ ID NO: 273390 - protein, 8 aa, Influenza virus
NPECDRLL

SEQ ID NO: 273391 - protein, 8 aa, Influenza virus
VPEWSYIV

SEQ ID NO: 273392 - protein, 8 aa, Influenza virus
PEWSYIVE

SEQ ID NO: 273393 - protein, 8 aa, Influenza virus
EWSYIMEK

SEQ ID NO: 273394 - protein, 8 aa, Influenza virus
WSYIVEKE

SEQ ID NO: 273395 - protein, 8 aa, Influenza virus
LCYPGSFN

SEQ ID NO: 273396 - protein, 8 aa, Influenza virus
FNDYEELK

SEQ ID NO: 273397 - protein, 8 aa, Influenza virus
NDYEELKH

SEQ ID NO: 273398 - protein, 8 aa, Influenza virus
HFEKVKIL

SEQ ID NO: 273399 - protein, 8 aa, Influenza virus
PSFFRNMV

SEQ ID NO: 273400 - protein, 8 aa, Influenza virus
SFFRNMVW

SEQ ID NO: 273401 - protein, 8 aa, Influenza virus
FFRNMVWL

SEQ ID NO: 273402 - protein, 8 aa, Influenza virus
FRNMVWLT

SEQ ID NO: 273403 - protein, 8 aa, Influenza virus
RSYNNTSG

SEQ ID NO: 273404 - protein, 8 aa, Influenza virus
SYNNTSGE

SEQ ID NO: 273405 - protein, 8 aa, Influenza virus
YNNTSGEQ

SEQ ID NO: 273406 - protein, 8 aa, Influenza virus
NNTSGEQM

SEQ ID NO: 273407 - protein, 8 aa, Influenza virus
NTSGEQML

SEQ ID NO: 273408 - protein, 8 aa, Influenza virus
TSTLNKRS

SEQ ID NO: 273409 - protein, 8 aa, Influenza virus
GQGGRMEF

SEQ ID NO: 273410 - protein, 8 aa, Influenza virus
GRMEFSWT

SEQ ID NO: 273411 - protein, 8 aa, Influenza virus
RMEFSWTL

SEQ ID NO: 273412 - protein, 8 aa, Influenza virus
MEFSWTLL

SEQ ID NO: 273413 - protein, 8 aa, Influenza virus
INFESTGN

SEQ ID NO: 273414 - protein, 8 aa, Influenza virus
NFESTGNL

SEQ ID NO: 273415 - protein, 8 aa, Influenza virus
FESTGNLI

SEQ ID NO: 273416 - protein, 8 aa, Influenza virus
ESTGNLIA

SEQ ID NO: 273417 - protein, 8 aa, Influenza virus
STGNLIAP

SEQ ID NO: 273418 - protein, 8 aa, Influenza virus
TGNLIAPE

SEQ ID NO: 273419 - protein, 8 aa, Influenza virus
GNLIAPEY

SEQ ID NO: 273420 - protein, 8 aa, Influenza virus
NLIAPEYG

SEQ ID NO: 273421 - protein, 8 aa, Influenza virus
LIAPEYGF

SEQ ID NO: 273422 - protein, 8 aa, Influenza virus
IAPEYGFK

SEQ ID NO: 273423 - protein, 8 aa, Influenza virus
APEYGFKI

SEQ ID NO: 273424 - protein, 8 aa, Influenza virus
PEYGFKIS

SEQ ID NO: 273425 - protein, 8 aa, Influenza virus
EYGFKISK

SEQ ID NO: 273426 - protein, 8 aa, Influenza virus
YGFKISKR

SEQ ID NO: 273427 - protein, 8 aa, Influenza virus
GFKISKRG

SEQ ID NO: 273428 - protein, 8 aa, Influenza virus
FKISKRGS

SEQ ID NO: 273429 - protein, 8 aa, Influenza virus
KISKRGSS

SEQ ID NO: 273430 - protein, 8 aa, Influenza virus
ISKRGSSG

SEQ ID NO: 273431 - protein, 8 aa, Influenza virus
SKRGSSGI

SEQ ID NO: 273432 - protein, 8 aa, Influenza virus
KRGSSGIM

SEQ ID NO: 273433 - protein, 8 aa, Influenza virus
RGSSGIMK

SEQ ID NO: 273434 - protein, 8 aa, Influenza virus
GSSGIMKT

SEQ ID NO: 273435 - protein, 8 aa, Influenza virus
CETKCQTP

SEQ ID NO: 273436 - protein, 8 aa, Influenza virus
ETKCQTPL

SEQ ID NO: 273437 - protein, 8 aa, Influenza virus
TKCQTPLG

SEQ ID NO: 273438 - protein, 8 aa, Influenza virus
KCQTPLGA

SEQ ID NO: 273439 - protein, 8 aa, Influenza virus
CQTPLGAI

SEQ ID NO: 273440 - protein, 8 aa, Influenza virus
QTPLGAIN

SEQ ID NO: 273441 - protein, 8 aa, Influenza virus
TPLGAINT

SEQ ID NO: 273442 - protein, 8 aa, Influenza virus
PLGAINTT

SEQ ID NO: 273443 - protein, 8 aa, Influenza virus
LGAINTTL

SEQ ID NO: 273444 - protein, 8 aa, Influenza virus
GAINTTLP

SEQ ID NO: 273445 - protein, 8 aa, Influenza virus
AINTTLPF

SEQ ID NO: 273446 - protein, 8 aa, Influenza virus
INTTLPFH

SEQ ID NO: 273447 - protein, 8 aa, Influenza virus
NTTLPFHN

SEQ ID NO: 273448 - protein, 8 aa, Influenza virus
TTLPFHNI

SEQ ID NO: 273449 - protein, 8 aa, Influenza virus
TLPFHNIH

SEQ ID NO: 273450 - protein, 8 aa, Influenza virus
LPFHNIHP

SEQ ID NO: 273451 - protein, 8 aa, Influenza virus
PFHNIHPL

SEQ ID NO: 273452 - protein, 8 aa, Influenza virus
FHNIHPLT

SEQ ID NO: 273453 - protein, 8 aa, Influenza virus
HNIHPLTI

SEQ ID NO: 273454 - protein, 8 aa, Influenza virus
NIHPLTIG

SEQ ID NO: 273455 - protein, 8 aa, Influenza virus
IHPLTIGE

SEQ ID NO: 273456 - protein, 8 aa, Influenza virus
HPLTIGEC

SEQ ID NO: 273457 - protein, 8 aa, Influenza virus
PLTIGECP

SEQ ID NO: 273458 - protein, 8 aa, Influenza virus
LTIGECPK

SEQ ID NO: 273459 - protein, 8 aa, Influenza virus
TIGECPKY

SEQ ID NO: 273460 - protein, 8 aa, Influenza virus
IGECPKYV

SEQ ID NO: 273461 - protein, 8 aa, Influenza virus
GECPKYVK

SEQ ID NO: 273462 - protein, 8 aa, Influenza virus
ECPKYVKS

SEQ ID NO: 273463 - protein, 8 aa, Influenza virus
LVLATGLR

SEQ ID NO: 273464 - protein, 8 aa, Influenza virus
VLATGLRN

SEQ ID NO: 273465 - protein, 8 aa, Influenza virus
PQIESRGL

SEQ ID NO: 273466 - protein, 8 aa, Influenza virus
QIESRGLF

SEQ ID NO: 273467 - protein, 8 aa, Influenza virus
IESRGLFG

SEQ ID NO: 273468 - protein, 8 aa, Influenza virus
ESRGLFGA

SEQ ID NO: 273469 - protein, 8 aa, Influenza virus
SRGLFGAI

SEQ ID NO: 273470 - protein, 8 aa, Influenza virus
RGLFGAIA

SEQ ID NO: 273471 - protein, 8 aa, Influenza virus
GLFGAIAG

SEQ ID NO: 273472 - protein, 8 aa, Influenza virus
LFGAIAGF

SEQ ID NO: 273473 - protein, 8 aa, Influenza virus
FGAIAGFI

SEQ ID NO: 273474 - protein, 8 aa, Influenza virus
GAIAGFIE

SEQ ID NO: 273475 - protein, 8 aa, Influenza virus
AIAGFIEG

SEQ ID NO: 273476 - protein, 8 aa, Influenza virus
IAGFIEGG

SEQ ID NO: 273477 - protein, 8 aa, Influenza virus
AGFIEGGW

SEQ ID NO: 273478 - protein, 8 aa, Influenza virus
GFIEGGWQ

SEQ ID NO: 273479 - protein, 8 aa, Influenza virus
FIEGGWQG

SEQ ID NO: 273480 - protein, 8 aa, Influenza virus
IEGGWQGM

SEQ ID NO: 273481 - protein, 8 aa, Influenza virus
EGGWQGMV

SEQ ID NO: 273482 - protein, 8 aa, Influenza virus
GGWQGMVD

SEQ ID NO: 273483 - protein, 8 aa, Influenza virus
GWQGMVDG

SEQ ID NO: 273484 - protein, 8 aa, Influenza virus
WQGMVDGW

SEQ ID NO: 273485 - protein, 8 aa, Influenza virus
QGMVDGWY

SEQ ID NO: 273486 - protein, 8 aa, Influenza virus
GMVDGWYG

SEQ ID NO: 273487 - protein, 8 aa, Influenza virus
MVDGWYGY

SEQ ID NO: 273488 - protein, 8 aa, Influenza virus
VDGWYGYH

SEQ ID NO: 273489 - protein, 8 aa, Influenza virus
DGWYGYHH

SEQ ID NO: 273490 - protein, 8 aa, Influenza virus
GWYGYHHS

SEQ ID NO: 273491 - protein, 8 aa, Influenza virus
WYGYHHSN

SEQ ID NO: 273492 - protein, 8 aa, Influenza virus
YGYHHSND

SEQ ID NO: 273493 - protein, 8 aa, Influenza virus
GYHHSNDQ

SEQ ID NO: 273494 - protein, 8 aa, Influenza virus
YHHSNDQG

SEQ ID NO: 273495 - protein, 8 aa, Influenza virus
HHSNDQGS

SEQ ID NO: 273496 - protein, 8 aa, Influenza virus
HSNDQGSG

SEQ ID NO: 273497 - protein, 8 aa, Influenza virus
SNDQGSGY

SEQ ID NO: 273498 - protein, 8 aa, Influenza virus
NDQGSGYA

SEQ ID NO: 273499 - protein, 8 aa, Influenza virus
DQGSGYAA

SEQ ID NO: 273500 - protein, 8 aa, Influenza virus
QGSGYAAD

SEQ ID NO: 273501 - protein, 8 aa, Influenza virus
GSGYAADK

SEQ ID NO: 273502 - protein, 8 aa, Influenza virus
SGYAADKE

SEQ ID NO: 273503 - protein, 8 aa, Influenza virus
GYAADKES

SEQ ID NO: 273504 - protein, 8 aa, Influenza virus
YAADKEST

SEQ ID NO: 273505 - protein, 8 aa, Influenza virus
AADKESTQ

SEQ ID NO: 273506 - protein, 8 aa, Influenza virus
ADKESTQK

SEQ ID NO: 273507 - protein, 8 aa, Influenza virus
DKESTQKA

SEQ ID NO: 273508 - protein, 8 aa, Influenza virus
NSVIEKMN

SEQ ID NO: 273509 - protein, 8 aa, Influenza virus
SVIEKMNT

SEQ ID NO: 273510 - protein, 8 aa, Influenza virus
VIEKMNTQ

SEQ ID NO: 273511 - protein, 8 aa, Influenza virus
IEKMNTQF

SEQ ID NO: 273512 - protein, 8 aa, Influenza virus
EKMNTQFE

SEQ ID NO: 273513 - protein, 8 aa, Influenza virus
VGKEFNNL

SEQ ID NO: 273514 - protein, 8 aa, Influenza virus
GKEFNNLE

SEQ ID NO: 273515 - protein, 8 aa, Influenza virus
NLERRLEN

SEQ ID NO: 273516 - protein, 8 aa, Influenza virus
LERRLENL

SEQ ID NO: 273517 - protein, 8 aa, Influenza virus
ERRLENLN

SEQ ID NO: 273518 - protein, 8 aa, Influenza virus
RRLENLNK

SEQ ID NO: 273519 - protein, 8 aa, Influenza virus
RLENLNKK

SEQ ID NO: 273520 - protein, 8 aa, Influenza virus
LENLNKKM

SEQ ID NO: 273521 - protein, 8 aa, Influenza virus
ENLNKKME

SEQ ID NO: 273522 - protein, 8 aa, Influenza virus
NLNKKMED

SEQ ID NO: 273523 - protein, 8 aa, Influenza virus
LNKKMEDG

SEQ ID NO: 273524 - protein, 8 aa, Influenza virus
NKKMEDGF

SEQ ID NO: 273525 - protein, 8 aa, Influenza virus
KKMEDGFL

SEQ ID NO: 273526 - protein, 8 aa, Influenza virus
VWTYNAEL

SEQ ID NO: 273527 - protein, 8 aa, Influenza virus
WTYNAELL

SEQ ID NO: 273528 - protein, 8 aa, Influenza virus
TYNAELLV

SEQ ID NO: 273529 - protein, 8 aa, Influenza virus
YNAELLVL

SEQ ID NO: 273530 - protein, 8 aa, Influenza virus
NAELLVLM

SEQ ID NO: 273531 - protein, 8 aa, Influenza virus
AELLVLME

SEQ ID NO: 273532 - protein, 8 aa, Influenza virus
ELLVLMEN

SEQ ID NO: 273533 - protein, 8 aa, Influenza virus
LLVLMENE

SEQ ID NO: 273534 - protein, 8 aa, Influenza virus
LVLMENER

SEQ ID NO: 273535 - protein, 8 aa, Influenza virus
VLMENERT

SEQ ID NO: 273536 - protein, 8 aa, Influenza virus
LMENERTL

SEQ ID NO: 273537 - protein, 8 aa, Influenza virus
MENERTLD

SEQ ID NO: 273538 - protein, 8 aa, Influenza virus
ENERTLDF

SEQ ID NO: 273539 - protein, 8 aa, Influenza virus
NERTLDFH

SEQ ID NO: 273540 - protein, 8 aa, Influenza virus
ERTLDFHD

SEQ ID NO: 273541 - protein, 8 aa, Influenza virus
RTLDFHDS

SEQ ID NO: 273542 - protein, 8 aa, Influenza virus
TLDFHDSN

SEQ ID NO: 273543 - protein, 8 aa, Influenza virus
LDFHDSNV

SEQ ID NO: 273544 - protein, 8 aa, Influenza virus
DFHDSNVK

SEQ ID NO: 273545 - protein, 8 aa, Influenza virus
FHDSNVKN

SEQ ID NO: 273546 - protein, 8 aa, Influenza virus
HDSNVKNL

SEQ ID NO: 273547 - protein, 8 aa, Influenza virus
DSNVKNLY

SEQ ID NO: 273548 - protein, 8 aa, Influenza virus
SNVKNLYD

SEQ ID NO: 273549 - protein, 8 aa, Influenza virus
NLYDKVRM

SEQ ID NO: 273550 - protein, 8 aa, Influenza virus
LYDKVRMQ

SEQ ID NO: 273551 - protein, 8 aa, Influenza virus
YDKVRMQL

SEQ ID NO: 273552 - protein, 8 aa, Influenza virus
DKVRMQLR

SEQ ID NO: 273553 - protein, 8 aa, Influenza virus
KVRMQLRD

SEQ ID NO: 273554 - protein, 8 aa, Influenza virus
VRMQLRDN

SEQ ID NO: 273555 - protein, 8 aa, Influenza virus
RMQLRDNA

SEQ ID NO: 273556 - protein, 8 aa, Influenza virus
MQLRDNAK

SEQ ID NO: 273557 - protein, 8 aa, Influenza virus
QLRDNAKE

SEQ ID NO: 273558 - protein, 8 aa, Influenza virus
LRDNAKEI

SEQ ID NO: 273559 - protein, 8 aa, Influenza virus
RDNAKEIG

SEQ ID NO: 273560 - protein, 8 aa, Influenza virus
DNAKEIGN

SEQ ID NO: 273561 - protein, 8 aa, Influenza virus
NAKEIGNG

SEQ ID NO: 273562 - protein, 8 aa, Influenza virus
AKEIGNGC

SEQ ID NO: 273563 - protein, 8 aa, Influenza virus
KEIGNGCF

SEQ ID NO: 273564 - protein, 8 aa, Influenza virus
EIGNGCFE

SEQ ID NO: 273565 - protein, 8 aa, Influenza virus
IGNGCFEF

SEQ ID NO: 273566 - protein, 8 aa, Influenza virus
GNGCFEFY

SEQ ID NO: 273567 - protein, 8 aa, Influenza virus
NGCFEFYH

SEQ ID NO: 273568 - protein, 8 aa, Influenza virus
GCFEFYHK

SEQ ID NO: 273569 - protein, 8 aa, Influenza virus
CFEFYHKC

SEQ ID NO: 273570 - protein, 8 aa, Influenza virus
FEFYHKCD

SEQ ID NO: 273571 - protein, 8 aa, Influenza virus
EFYHKCDD

SEQ ID NO: 273572 - protein, 8 aa, Influenza virus
FYHKCDDE

SEQ ID NO: 273573 - protein, 8 aa, Influenza virus
YHKCDDEC

SEQ ID NO: 273574 - protein, 8 aa, Influenza virus
HKCDDECM

SEQ ID NO: 273575 - protein, 8 aa, Influenza virus
KCDDECMN

SEQ ID NO: 273576 - protein, 8 aa, Influenza virus
CDDECMNS

SEQ ID NO: 273577 - protein, 8 aa, Influenza virus
SVKNGTYD

SEQ ID NO: 273578 - protein, 8 aa, Influenza virus
VKNGTYDY

SEQ ID NO: 273579 - protein, 8 aa, Influenza virus
NGTYDYPK

SEQ ID NO: 273580 - protein, 8 aa, Influenza virus
GTYDYPKY

SEQ ID NO: 273581 - protein, 8 aa, Influenza virus
TYDYPKYE

SEQ ID NO: 273582 - protein, 8 aa, Influenza virus
YDYPKYEE

SEQ ID NO: 273583 - protein, 8 aa, Influenza virus
DYPKYEEE

SEQ ID NO: 273584 - protein, 8 aa, Influenza virus
YPKYEEES

SEQ ID NO: 273585 - protein, 8 aa, Influenza virus
PKYEEESK

SEQ ID NO: 273586 - protein, 8 aa, Influenza virus
KYEEESKL

SEQ ID NO: 273587 - protein, 8 aa, Influenza virus
YEEESKLN

SEQ ID NO: 273588 - protein, 8 aa, Influenza virus
EEESKLNR

SEQ ID NO: 273589 - protein, 8 aa, Influenza virus
EESKLNRN

SEQ ID NO: 273590 - protein, 8 aa, Influenza virus
ESKLNRNE

SEQ ID NO: 273591 - protein, 8 aa, Influenza virus
SKLNRNEI

SEQ ID NO: 273592 - protein, 8 aa, Influenza virus
KLNRNEIK

SEQ ID NO: 273593 - protein, 8 aa, Influenza virus
LNRNEIKG

SEQ ID NO: 273594 - protein, 8 aa, Influenza virus
NEIKGVKL

SEQ ID NO: 273595 - protein, 8 aa, Influenza virus
EIKGVKLS

SEQ ID NO: 273596 - protein, 8 aa, Influenza virus
MGVYQILA

SEQ ID NO: 273597 - protein, 8 aa, Influenza virus
GVYQILAI

SEQ ID NO: 273598 - protein, 8 aa, Influenza virus
VYQILAIY

SEQ ID NO: 273599 - protein, 8 aa, Influenza virus
YQILAIYA

SEQ ID NO: 273600 - protein, 8 aa, Influenza virus
QILAIYAT

SEQ ID NO: 273601 - protein, 8 aa, Influenza virus
ILAIYATV

SEQ ID NO: 273602 - protein, 8 aa, Influenza virus
LAIYATVA

SEQ ID NO: 273603 - protein, 8 aa, Influenza virus
AIYATVAG

SEQ ID NO: 273604 - protein, 8 aa, Influenza virus
IYATVAGS

SEQ ID NO: 273605 - protein, 8 aa, Influenza virus
YATVAGSL

SEQ ID NO: 273606 - protein, 8 aa, Influenza virus
ATVAGSLS

SEQ ID NO: 273607 - protein, 8 aa, Influenza virus
TVAGSLSL

SEQ ID NO: 273608 - protein, 8 aa, Influenza virus
VAGSLSLA

SEQ ID NO: 273609 - protein, 8 aa, Influenza virus
AGSLSLAI

SEQ ID NO: 273610 - protein, 8 aa, Influenza virus
GSLSLAIM

SEQ ID NO: 273611 - protein, 8 aa, Influenza virus
SLSLAIMI

SEQ ID NO: 273612 - protein, 8 aa, Influenza virus
LSLAIMIA

SEQ ID NO: 273613 - protein, 8 aa, Influenza virus
SLAIMIAG

SEQ ID NO: 273614 - protein, 8 aa, Influenza virus
LAIMIAGI

SEQ ID NO: 273615 - protein, 8 aa, Influenza virus
AIMIAGIS

SEQ ID NO: 273616 - protein, 8 aa, Influenza virus
AGISFWMC

SEQ ID NO: 273617 - protein, 8 aa, Influenza virus
GISFWMCS

SEQ ID NO: 273618 - protein, 8 aa, Influenza virus
ISFWMCSN

SEQ ID NO: 273619 - protein, 8 aa, Influenza virus
SFWMCSNG

SEQ ID NO: 273620 - protein, 8 aa, Influenza virus
FWMCSNGS

SEQ ID NO: 273621 - protein, 8 aa, Influenza virus
WMCSNGSL

SEQ ID NO: 273622 - protein, 8 aa, Influenza virus
MCSNGSLQ

SEQ ID NO: 273623 - protein, 8 aa, Influenza virus
CSNGSLQC

SEQ ID NO: 273624 - protein, 8 aa, Influenza virus
SNGSLQCR

SEQ ID NO: 273625 - protein, 8 aa, Influenza virus
NGSLQCRI

SEQ ID NO: 273626 - protein, 8 aa, Influenza virus
GSLQCRIC

SEQ ID NO: 273627 - protein, 8 aa, Influenza virus
SLQCRICI

SEQ ID NO: 273628 - protein, 8 aa, Influenza virus
VRGDQICI

SEQ ID NO: 273629 - protein, 8 aa, Influenza virus
RGDQICIG

SEQ ID NO: 273630 - protein, 8 aa, Influenza virus
GDQICIGY

SEQ ID NO: 273631 - protein, 8 aa, Influenza virus
DQICIGYH

SEQ ID NO: 273632 - protein, 8 aa, Influenza virus
QICIGYHA

SEQ ID NO: 273633 - protein, 8 aa, Influenza virus
ICIGYHAN

SEQ ID NO: 273634 - protein, 8 aa, Influenza virus
CIGYHANN

SEQ ID NO: 273635 - protein, 8 aa, Influenza virus
IGYHANNS

SEQ ID NO: 273636 - protein, 8 aa, Influenza virus
GYHANNST

SEQ ID NO: 273637 - protein, 8 aa, Influenza virus
YHANNSTE

SEQ ID NO: 273638 - protein, 8 aa, Influenza virus
HANNSTEK

SEQ ID NO: 273639 - protein, 8 aa, Influenza virus
NNSTEKVD

SEQ ID NO: 273640 - protein, 8 aa, Influenza virus
NSTEKVDT

SEQ ID NO: 273641 - protein, 8 aa, Influenza virus
KVDTILER

SEQ ID NO: 273642 - protein, 8 aa, Influenza virus
VDTILERN

SEQ ID NO: 273643 - protein, 8 aa, Influenza virus
DTILERNV

SEQ ID NO: 273644 - protein, 8 aa, Influenza virus
TILERNVT

SEQ ID NO: 273645 - protein, 8 aa, Influenza virus
ILERNVTV

SEQ ID NO: 273646 - protein, 8 aa, Influenza virus
LERNVTVT

SEQ ID NO: 273647 - protein, 8 aa, Influenza virus
ERNVTVTH

SEQ ID NO: 273648 - protein, 8 aa, Influenza virus
RNVTVTHA

SEQ ID NO: 273649 - protein, 8 aa, Influenza virus
NVTVTHAK

SEQ ID NO: 273650 - protein, 8 aa, Influenza virus
VTVTHAKD

SEQ ID NO: 273651 - protein, 8 aa, Influenza virus
TVTHAKDI

SEQ ID NO: 273652 - protein, 8 aa, Influenza virus
VTHAKDIL

SEQ ID NO: 273653 - protein, 8 aa, Influenza virus
THAKDILE

SEQ ID NO: 273654 - protein, 8 aa, Influenza virus
HAKDILEK

SEQ ID NO: 273655 - protein, 8 aa, Influenza virus
AKDILEKT

SEQ ID NO: 273656 - protein, 8 aa, Influenza virus
KDILEKTH

SEQ ID NO: 273657 - protein, 8 aa, Influenza virus
DILEKTHN

SEQ ID NO: 273658 - protein, 8 aa, Influenza virus
ILEKTHNG

SEQ ID NO: 273659 - protein, 8 aa, Influenza virus
LEKTHNGK

SEQ ID NO: 273660 - protein, 8 aa, Influenza virus
EKTHNGKL

SEQ ID NO: 273661 - protein, 8 aa, Influenza virus
KTHNGKLC

SEQ ID NO: 273662 - protein, 8 aa, Influenza virus
THNGKLCK

SEQ ID NO: 273663 - protein, 8 aa, Influenza virus
HNGKLCKL

SEQ ID NO: 273664 - protein, 8 aa, Influenza virus
NGKLCKLN

SEQ ID NO: 273665 - protein, 8 aa, Influenza virus
GKLCKLNG

SEQ ID NO: 273666 - protein, 8 aa, Influenza virus
KLCKLNGI

SEQ ID NO: 273667 - protein, 8 aa, Influenza virus
LCKLNGIP

SEQ ID NO: 273668 - protein, 8 aa, Influenza virus
CKLNGIPP

SEQ ID NO: 273669 - protein, 8 aa, Influenza virus
KLNGIPPL

SEQ ID NO: 273670 - protein, 8 aa, Influenza virus
LNGIPPLE

SEQ ID NO: 273671 - protein, 8 aa, Influenza virus
NGIPPLEL

SEQ ID NO: 273672 - protein, 8 aa, Influenza virus
GIPPLELG

SEQ ID NO: 273673 - protein, 8 aa, Influenza virus
IPPLELGD

SEQ ID NO: 273674 - protein, 8 aa, Influenza virus
PPLELGDC

SEQ ID NO: 273675 - protein, 8 aa, Influenza virus
PLELGDCS

SEQ ID NO: 273676 - protein, 8 aa, Influenza virus
LELGDCSI

SEQ ID NO: 273677 - protein, 8 aa, Influenza virus
ELGDCSIA

SEQ ID NO: 273678 - protein, 8 aa, Influenza virus
LGDCSIAG

SEQ ID NO: 273679 - protein, 8 aa, Influenza virus
GDCSIAGW

SEQ ID NO: 273680 - protein, 8 aa, Influenza virus
DCSIAGWL

SEQ ID NO: 273681 - protein, 8 aa, Influenza virus
CSIAGWLL

SEQ ID NO: 273682 - protein, 8 aa, Influenza virus
SIAGWLLG

SEQ ID NO: 273683 - protein, 8 aa, Influenza virus
IAGWLLGN

SEQ ID NO: 273684 - protein, 8 aa, Influenza virus
AGWLLGNP

SEQ ID NO: 273685 - protein, 8 aa, Influenza virus
GWLLGNPE

SEQ ID NO: 273686 - protein, 8 aa, Influenza virus
WLLGNPEC

SEQ ID NO: 273687 - protein, 8 aa, Influenza virus
LLGNPECD

SEQ ID NO: 273688 - protein, 8 aa, Influenza virus
LGNPECDR

SEQ ID NO: 273689 - protein, 8 aa, Influenza virus
GNPECDRL

SEQ ID NO: 273690 - protein, 8 aa, Influenza virus
NPECDRLL

SEQ ID NO: 273691 - protein, 8 aa, Influenza virus
PECDRLLS

SEQ ID NO: 273692 - protein, 8 aa, Influenza virus
LSVPEWSY

SEQ ID NO: 273693 - protein, 8 aa, Influenza virus
SVPEWSYI

SEQ ID NO: 273694 - protein, 8 aa, Influenza virus
VPEWSYIM

SEQ ID NO: 273695 - protein, 8 aa, Influenza virus
PEWSYIME

SEQ ID NO: 273696 - protein, 8 aa, Influenza virus
EWSYIMEK

SEQ ID NO: 273697 - protein, 8 aa, Influenza virus
WSYIMEKE

SEQ ID NO: 273698 - protein, 8 aa, Influenza virus
SYIMEKEN

SEQ ID NO: 273699 - protein, 8 aa, Influenza virus
YIMEKENP

SEQ ID NO: 273700 - protein, 8 aa, Influenza virus
NGLCYPGS

SEQ ID NO: 273701 - protein, 8 aa, Influenza virus
GLCYPGSF

SEQ ID NO: 273702 - protein, 8 aa, Influenza virus
LCYPGSFN

SEQ ID NO: 273703 - protein, 8 aa, Influenza virus
CYPGSFND

SEQ ID NO: 273704 - protein, 8 aa, Influenza virus
YPGSFNDY

SEQ ID NO: 273705 - protein, 8 aa, Influenza virus
PGSFNDYE

SEQ ID NO: 273706 - protein, 8 aa, Influenza virus
GSFNDYEE

SEQ ID NO: 273707 - protein, 8 aa, Influenza virus
SFNDYEEL

SEQ ID NO: 273708 - protein, 8 aa, Influenza virus
FNDYEELK

SEQ ID NO: 273709 - protein, 8 aa, Influenza virus
NDYEELKH

SEQ ID NO: 273710 - protein, 8 aa, Influenza virus
DYEELKHL

SEQ ID NO: 273711 - protein, 8 aa, Influenza virus
YEELKHLL

SEQ ID NO: 273712 - protein, 8 aa, Influenza virus
SVKHFEKV

SEQ ID NO: 273713 - protein, 8 aa, Influenza virus
VKHFEKVK

SEQ ID NO: 273714 - protein, 8 aa, Influenza virus
KHFEKVKI

SEQ ID NO: 273715 - protein, 8 aa, Influenza virus
HFEKVKIL

SEQ ID NO: 273716 - protein, 8 aa, Influenza virus
FEKVKILP

SEQ ID NO: 273717 - protein, 8 aa, Influenza virus
EKVKILPK

SEQ ID NO: 273718 - protein, 8 aa, Influenza virus
KVKILPKD

SEQ ID NO: 273719 - protein, 8 aa, Influenza virus
PSFFRNMV

SEQ ID NO: 273720 - protein, 8 aa, Influenza virus
SFFRNMVW

SEQ ID NO: 273721 - protein, 8 aa, Influenza virus
FFRNMVWL

SEQ ID NO: 273722 - protein, 8 aa, Influenza virus
FRNMVWLT

SEQ ID NO: 273723 - protein, 8 aa, Influenza virus
VAKGSYNN

SEQ ID NO: 273724 - protein, 8 aa, Influenza virus
AKGSYNNT

SEQ ID NO: 273725 - protein, 8 aa, Influenza virus
KGSYNNTS

SEQ ID NO: 273726 - protein, 8 aa, Influenza virus
GSYNNTSG

SEQ ID NO: 273727 - protein, 8 aa, Influenza virus
SYNNTSGE

SEQ ID NO: 273728 - protein, 8 aa, Influenza virus
YNNTSGEQ

SEQ ID NO: 273729 - protein, 8 aa, Influenza virus
NNTSGEQM

SEQ ID NO: 273730 - protein, 8 aa, Influenza virus
NTSGEQML

SEQ ID NO: 273731 - protein, 8 aa, Influenza virus
TSGEQMLI

SEQ ID NO: 273732 - protein, 8 aa, Influenza virus
SGEQMLII

SEQ ID NO: 273733 - protein, 8 aa, Influenza virus
GEQMLIIW

SEQ ID NO: 273734 - protein, 8 aa, Influenza virus
EQMLIIWG

SEQ ID NO: 273735 - protein, 8 aa, Influenza virus
LIIWGVHH

SEQ ID NO: 273736 - protein, 8 aa, Influenza virus
IIWGVHHP

SEQ ID NO: 273737 - protein, 8 aa, Influenza virus
IWGVHHPN

SEQ ID NO: 273738 - protein, 8 aa, Influenza virus
WGVHHPND

SEQ ID NO: 273739 - protein, 8 aa, Influenza virus
GVHHPNDE

SEQ ID NO: 273740 - protein, 8 aa, Influenza virus
LYQNVGTY

SEQ ID NO: 273741 - protein, 8 aa, Influenza virus
YQNVGTYV

SEQ ID NO: 273742 - protein, 8 aa, Influenza virus
QNVGTYVS

SEQ ID NO: 273743 - protein, 8 aa, Influenza virus
TSTLNKRS

SEQ ID NO: 273744 - protein, 8 aa, Influenza virus
GQGGRMEF

SEQ ID NO: 273745 - protein, 8 aa, Influenza virus
RMEFSWTL

SEQ ID NO: 273746 - protein, 8 aa, Influenza virus
MEFSWTLL

SEQ ID NO: 273747 - protein, 8 aa, Influenza virus
WDTINFES

SEQ ID NO: 273748 - protein, 8 aa, Influenza virus
DTINFEST

SEQ ID NO: 273749 - protein, 8 aa, Influenza virus
TINFESTG

SEQ ID NO: 273750 - protein, 8 aa, Influenza virus
INFESTGN

SEQ ID NO: 273751 - protein, 8 aa, Influenza virus
NFESTGNL

SEQ ID NO: 273752 - protein, 8 aa, Influenza virus
FESTGNLI

SEQ ID NO: 273753 - protein, 8 aa, Influenza virus
ESTGNLIA

SEQ ID NO: 273754 - protein, 8 aa, Influenza virus
STGNLIAP

SEQ ID NO: 273755 - protein, 8 aa, Influenza virus
TGNLIAPE

SEQ ID NO: 273756 - protein, 8 aa, Influenza virus
GNLIAPEY

SEQ ID NO: 273757 - protein, 8 aa, Influenza virus
NLIAPEYG

SEQ ID NO: 273758 - protein, 8 aa, Influenza virus
LIAPEYGF

SEQ ID NO: 273759 - protein, 8 aa, Influenza virus
IAPEYGFK

SEQ ID NO: 273760 - protein, 8 aa, Influenza virus
APEYGFKI

SEQ ID NO: 273761 - protein, 8 aa, Influenza virus
PEYGFKIS

SEQ ID NO: 273762 - protein, 8 aa, Influenza virus
EYGFKISK

SEQ ID NO: 273763 - protein, 8 aa, Influenza virus
YGFKISKR

SEQ ID NO: 273764 - protein, 8 aa, Influenza virus
GFKISKRG

SEQ ID NO: 273765 - protein, 8 aa, Influenza virus
FKISKRGS

SEQ ID NO: 273766 - protein, 8 aa, Influenza virus
KISKRGSS

SEQ ID NO: 273767 - protein, 8 aa, Influenza virus
ISKRGSSG

SEQ ID NO: 273768 - protein, 8 aa, Influenza virus
SKRGSSGI

SEQ ID NO: 273769 - protein, 8 aa, Influenza virus
KRGSSGIM

SEQ ID NO: 273770 - protein, 8 aa, Influenza virus
RGSSGIMK

SEQ ID NO: 273771 - protein, 8 aa, Influenza virus
GSSGIMKT

SEQ ID NO: 273772 - protein, 8 aa, Influenza virus
SSGIMKTE

SEQ ID NO: 273773 - protein, 8 aa, Influenza virus
SGIMKTEG

SEQ ID NO: 273774 - protein, 8 aa, Influenza virus
GIMKTEGT

SEQ ID NO: 273775 - protein, 8 aa, Influenza virus
IMKTEGTL

SEQ ID NO: 273776 - protein, 8 aa, Influenza virus
MKTEGTLE

SEQ ID NO: 273777 - protein, 8 aa, Influenza virus
ENCETKCQ

SEQ ID NO: 273778 - protein, 8 aa, Influenza virus
NCETKCQT

SEQ ID NO: 273779 - protein, 8 aa, Influenza virus
CETKCQTP

SEQ ID NO: 273780 - protein, 8 aa, Influenza virus
ETKCQTPL

SEQ ID NO: 273781 - protein, 8 aa, Influenza virus
TKCQTPLG

SEQ ID NO: 273782 - protein, 8 aa, Influenza virus
KCQTPLGA

SEQ ID NO: 273783 - protein, 8 aa, Influenza virus
CQTPLGAI

SEQ ID NO: 273784 - protein, 8 aa, Influenza virus
QTPLGAIN

SEQ ID NO: 273785 - protein, 8 aa, Influenza virus
TPLGAINT

SEQ ID NO: 273786 - protein, 8 aa, Influenza virus
PLGAINTT

SEQ ID NO: 273787 - protein, 8 aa, Influenza virus
LGAINTTL

SEQ ID NO: 273788 - protein, 8 aa, Influenza virus
GAINTTLP

SEQ ID NO: 273789 - protein, 8 aa, Influenza virus
AINTTLPF

SEQ ID NO: 273790 - protein, 8 aa, Influenza virus
INTTLPFH

SEQ ID NO: 273791 - protein, 8 aa, Influenza virus
NTTLPFHN

SEQ ID NO: 273792 - protein, 8 aa, Influenza virus
TTLPFHNV

SEQ ID NO: 273793 - protein, 8 aa, Influenza virus
TLPFHNVH

SEQ ID NO: 273794 - protein, 8 aa, Influenza virus
LPFHNVHP

SEQ ID NO: 273795 - protein, 8 aa, Influenza virus
PFHNVHPL

SEQ ID NO: 273796 - protein, 8 aa, Influenza virus
FHNVHPLT

SEQ ID NO: 273797 - protein, 8 aa, Influenza virus
HNVHPLTI

SEQ ID NO: 273798 - protein, 8 aa, Influenza virus
NVHPLTIG

SEQ ID NO: 273799 - protein, 8 aa, Influenza virus
VHPLTIGE

SEQ ID NO: 273800 - protein, 8 aa, Influenza virus
HPLTIGEC

SEQ ID NO: 273801 - protein, 8 aa, Influenza virus
PLTIGECP

SEQ ID NO: 273802 - protein, 8 aa, Influenza virus
LTIGECPK

SEQ ID NO: 273803 - protein, 8 aa, Influenza virus
TIGECPKY

SEQ ID NO: 273804 - protein, 8 aa, Influenza virus
IGECPKYV

SEQ ID NO: 273805 - protein, 8 aa, Influenza virus
GECPKYVK

SEQ ID NO: 273806 - protein, 8 aa, Influenza virus
ECPKYVKS

SEQ ID NO: 273807 - protein, 8 aa, Influenza virus
CPKYVKSE

SEQ ID NO: 273808 - protein, 8 aa, Influenza virus
PKYVKSEK

SEQ ID NO: 273809 - protein, 8 aa, Influenza virus
KYVKSEKL

SEQ ID NO: 273810 - protein, 8 aa, Influenza virus
YVKSEKLV

SEQ ID NO: 273811 - protein, 8 aa, Influenza virus
VKSEKLVL

SEQ ID NO: 273812 - protein, 8 aa, Influenza virus
KSEKLVLA

SEQ ID NO: 273813 - protein, 8 aa, Influenza virus
SEKLVLAT

SEQ ID NO: 273814 - protein, 8 aa, Influenza virus
EKLVLATG

SEQ ID NO: 273815 - protein, 8 aa, Influenza virus
KLVLATGL

SEQ ID NO: 273816 - protein, 8 aa, Influenza virus
LVLATGLR

SEQ ID NO: 273817 - protein, 8 aa, Influenza virus
VLATGLRN

SEQ ID NO: 273818 - protein, 8 aa, Influenza virus
LATGLRNV

SEQ ID NO: 273819 - protein, 8 aa, Influenza virus
ATGLRNVP

SEQ ID NO: 273820 - protein, 8 aa, Influenza virus
TGLRNVPQ

SEQ ID NO: 273821 - protein, 8 aa, Influenza virus
GLRNVPQI

SEQ ID NO: 273822 - protein, 8 aa, Influenza virus
LRNVPQIE

SEQ ID NO: 273823 - protein, 8 aa, Influenza virus
RNVPQIES

SEQ ID NO: 273824 - protein, 8 aa, Influenza virus
NVPQIESR

SEQ ID NO: 273825 - protein, 8 aa, Influenza virus
VPQIESRG

SEQ ID NO: 273826 - protein, 8 aa, Influenza virus
PQIESRGL

SEQ ID NO: 273827 - protein, 8 aa, Influenza virus
QIESRGLF

SEQ ID NO: 273828 - protein, 8 aa, Influenza virus
IESRGLFG

SEQ ID NO: 273829 - protein, 8 aa, Influenza virus
ESRGLFGA

SEQ ID NO: 273830 - protein, 8 aa, Influenza virus
SRGLFGAI

SEQ ID NO: 273831 - protein, 8 aa, Influenza virus
RGLFGAIA

SEQ ID NO: 273832 - protein, 8 aa, Influenza virus
GLFGAIAG

SEQ ID NO: 273833 - protein, 8 aa, Influenza virus
LFGAIAGF

SEQ ID NO: 273834 - protein, 8 aa, Influenza virus
FGAIAGFI

SEQ ID NO: 273835 - protein, 8 aa, Influenza virus
GAIAGFIE

SEQ ID NO: 273836 - protein, 8 aa, Influenza virus
AIAGFIEG

SEQ ID NO: 273837 - protein, 8 aa, Influenza virus
IAGFIEGG

SEQ ID NO: 273838 - protein, 8 aa, Influenza virus
AGFIEGGW

SEQ ID NO: 273839 - protein, 8 aa, Influenza virus
GFIEGGWQ

SEQ ID NO: 273840 - protein, 8 aa, Influenza virus
FIEGGWQG

SEQ ID NO: 273841 - protein, 8 aa, Influenza virus
IEGGWQGM

SEQ ID NO: 273842 - protein, 8 aa, Influenza virus
EGGWQGMV

SEQ ID NO: 273843 - protein, 8 aa, Influenza virus
GGWQGMVD

SEQ ID NO: 273844 - protein, 8 aa, Influenza virus
GWQGMVDG

SEQ ID NO: 273845 - protein, 8 aa, Influenza virus
WQGMVDGW

SEQ ID NO: 273846 - protein, 8 aa, Influenza virus
QGMVDGWY

SEQ ID NO: 273847 - protein, 8 aa, Influenza virus
GMVDGWYG

SEQ ID NO: 273848 - protein, 8 aa, Influenza virus
MVDGWYGY

SEQ ID NO: 273849 - protein, 8 aa, Influenza virus
VDGWYGYH

SEQ ID NO: 273850 - protein, 8 aa, Influenza virus
DGWYGYHH

SEQ ID NO: 273851 - protein, 8 aa, Influenza virus
GWYGYHHS

SEQ ID NO: 273852 - protein, 8 aa, Influenza virus
WYGYHHSN

SEQ ID NO: 273853 - protein, 8 aa, Influenza virus
YGYHHSND

SEQ ID NO: 273854 - protein, 8 aa, Influenza virus
GYHHSNDQ

SEQ ID NO: 273855 - protein, 8 aa, Influenza virus
YHHSNDQG

SEQ ID NO: 273856 - protein, 8 aa, Influenza virus
HHSNDQGS

SEQ ID NO: 273857 - protein, 8 aa, Influenza virus
HSNDQGSG

SEQ ID NO: 273858 - protein, 8 aa, Influenza virus
SNDQGSGY

SEQ ID NO: 273859 - protein, 8 aa, Influenza virus
NDQGSGYA

SEQ ID NO: 273860 - protein, 8 aa, Influenza virus
DQGSGYAA

SEQ ID NO: 273861 - protein, 8 aa, Influenza virus
QGSGYAAD

SEQ ID NO: 273862 - protein, 8 aa, Influenza virus
GSGYAADK

SEQ ID NO: 273863 - protein, 8 aa, Influenza virus
SGYAADKE

SEQ ID NO: 273864 - protein, 8 aa, Influenza virus
GYAADKES

SEQ ID NO: 273865 - protein, 8 aa, Influenza virus
YAADKEST

SEQ ID NO: 273866 - protein, 8 aa, Influenza virus
AADKESTQ

SEQ ID NO: 273867 - protein, 8 aa, Influenza virus
ADKESTQK

SEQ ID NO: 273868 - protein, 8 aa, Influenza virus
DKESTQKA

SEQ ID NO: 273869 - protein, 8 aa, Influenza virus
KESTQKAF

SEQ ID NO: 273870 - protein, 8 aa, Influenza virus
VNSVIEKM

SEQ ID NO: 273871 - protein, 8 aa, Influenza virus
NSVIEKMN

SEQ ID NO: 273872 - protein, 8 aa, Influenza virus
SVIEKMNT

SEQ ID NO: 273873 - protein, 8 aa, Influenza virus
VIEKMNTQ

SEQ ID NO: 273874 - protein, 8 aa, Influenza virus
IEKMNTQF

SEQ ID NO: 273875 - protein, 8 aa, Influenza virus
EKMNTQFE

SEQ ID NO: 273876 - protein, 8 aa, Influenza virus
AVGKEFSN

SEQ ID NO: 273877 - protein, 8 aa, Influenza virus
VGKEFSNL

SEQ ID NO: 273878 - protein, 8 aa, Influenza virus
GKEFSNLE

SEQ ID NO: 273879 - protein, 8 aa, Influenza virus
KEFSNLER

SEQ ID NO: 273880 - protein, 8 aa, Influenza virus
EFSNLERR

SEQ ID NO: 273881 - protein, 8 aa, Influenza virus
FSNLERRL

SEQ ID NO: 273882 - protein, 8 aa, Influenza virus
SNLERRLE

SEQ ID NO: 273883 - protein, 8 aa, Influenza virus
NLERRLEN

SEQ ID NO: 273884 - protein, 8 aa, Influenza virus
LERRLENL

SEQ ID NO: 273885 - protein, 8 aa, Influenza virus
ERRLENLN

SEQ ID NO: 273886 - protein, 8 aa, Influenza virus
RRLENLNK

SEQ ID NO: 273887 - protein, 8 aa, Influenza virus
RLENLNKK

SEQ ID NO: 273888 - protein, 8 aa, Influenza virus
LENLNKKM

SEQ ID NO: 273889 - protein, 8 aa, Influenza virus
ENLNKKME

SEQ ID NO: 273890 - protein, 8 aa, Influenza virus
NLNKKMED

SEQ ID NO: 273891 - protein, 8 aa, Influenza virus
LNKKMEDG

SEQ ID NO: 273892 - protein, 8 aa, Influenza virus
NKKMEDGF

SEQ ID NO: 273893 - protein, 8 aa, Influenza virus
MEDGFLDV

SEQ ID NO: 273894 - protein, 8 aa, Influenza virus
EDGFLDVW

SEQ ID NO: 273895 - protein, 8 aa, Influenza virus
DGFLDVWT

SEQ ID NO: 273896 - protein, 8 aa, Influenza virus
GFLDVWTY

SEQ ID NO: 273897 - protein, 8 aa, Influenza virus
FLDVWTYN

SEQ ID NO: 273898 - protein, 8 aa, Influenza virus
LDVWTYNA

SEQ ID NO: 273899 - protein, 8 aa, Influenza virus
DVWTYNAE

SEQ ID NO: 273900 - protein, 8 aa, Influenza virus
VWTYNAEL

SEQ ID NO: 273901 - protein, 8 aa, Influenza virus
WTYNAELL

SEQ ID NO: 273902 - protein, 8 aa, Influenza virus
TYNAELLV

SEQ ID NO: 273903 - protein, 8 aa, Influenza virus
YNAELLVL

SEQ ID NO: 273904 - protein, 8 aa, Influenza virus
NAELLVLM

SEQ ID NO: 273905 - protein, 8 aa, Influenza virus
AELLVLME

SEQ ID NO: 273906 - protein, 8 aa, Influenza virus
ELLVLMEN

SEQ ID NO: 273907 - protein, 8 aa, Influenza virus
LLVLMENE

SEQ ID NO: 273908 - protein, 8 aa, Influenza virus
LVLMENER

SEQ ID NO: 273909 - protein, 8 aa, Influenza virus
VLMENERT

SEQ ID NO: 273910 - protein, 8 aa, Influenza virus
LMENERTL

SEQ ID NO: 273911 - protein, 8 aa, Influenza virus
MENERTLD

SEQ ID NO: 273912 - protein, 8 aa, Influenza virus
ENERTLDF

SEQ ID NO: 273913 - protein, 8 aa, Influenza virus
NERTLDFH

SEQ ID NO: 273914 - protein, 8 aa, Influenza virus
ERTLDFHD

SEQ ID NO: 273915 - protein, 8 aa, Influenza virus
RTLDFHDS

SEQ ID NO: 273916 - protein, 8 aa, Influenza virus
TLDFHDSN

SEQ ID NO: 273917 - protein, 8 aa, Influenza virus
LDFHDSNV

SEQ ID NO: 273918 - protein, 8 aa, Influenza virus
DFHDSNVK

SEQ ID NO: 273919 - protein, 8 aa, Influenza virus
FHDSNVKN

SEQ ID NO: 273920 - protein, 8 aa, Influenza virus
HDSNVKNL

SEQ ID NO: 273921 - protein, 8 aa, Influenza virus
DSNVKNLY

SEQ ID NO: 273922 - protein, 8 aa, Influenza virus
SNVKNLYD

SEQ ID NO: 273923 - protein, 8 aa, Influenza virus
VKNLYDKV

SEQ ID NO: 273924 - protein, 8 aa, Influenza virus
KNLYDKVR

SEQ ID NO: 273925 - protein, 8 aa, Influenza virus
NLYDKVRM

SEQ ID NO: 273926 - protein, 8 aa, Influenza virus
LYDKVRMQ

SEQ ID NO: 273927 - protein, 8 aa, Influenza virus
YDKVRMQL

SEQ ID NO: 273928 - protein, 8 aa, Influenza virus
DKVRMQLR

SEQ ID NO: 273929 - protein, 8 aa, Influenza virus
KVRMQLRD

SEQ ID NO: 273930 - protein, 8 aa, Influenza virus
VRMQLRDN

SEQ ID NO: 273931 - protein, 8 aa, Influenza virus
RMQLRDNV

SEQ ID NO: 273932 - protein, 8 aa, Influenza virus
MQLRDNVK

SEQ ID NO: 273933 - protein, 8 aa, Influenza virus
QLRDNVKE

SEQ ID NO: 273934 - protein, 8 aa, Influenza virus
LRDNVKEL

SEQ ID NO: 273935 - protein, 8 aa, Influenza virus
RDNVKELG

SEQ ID NO: 273936 - protein, 8 aa, Influenza virus
DNVKELGN

SEQ ID NO: 273937 - protein, 8 aa, Influenza virus
NVKELGNG

SEQ ID NO: 273938 - protein, 8 aa, Influenza virus
VKELGNGC

SEQ ID NO: 273939 - protein, 8 aa, Influenza virus
KELGNGCF

SEQ ID NO: 273940 - protein, 8 aa, Influenza virus
ELGNGCFE

SEQ ID NO: 273941 - protein, 8 aa, Influenza virus
LGNGCFEF

SEQ ID NO: 273942 - protein, 8 aa, Influenza virus
GNGCFEFY

SEQ ID NO: 273943 - protein, 8 aa, Influenza virus
NGCFEFYH

SEQ ID NO: 273944 - protein, 8 aa, Influenza virus
GCFEFYHK

SEQ ID NO: 273945 - protein, 8 aa, Influenza virus
CFEFYHKC

SEQ ID NO: 273946 - protein, 8 aa, Influenza virus
FEFYHKCD

SEQ ID NO: 273947 - protein, 8 aa, Influenza virus
EFYHKCDD

SEQ ID NO: 273948 - protein, 8 aa, Influenza virus
FYHKCDDE

SEQ ID NO: 273949 - protein, 8 aa, Influenza virus
YHKCDDEC

SEQ ID NO: 273950 - protein, 8 aa, Influenza virus
HKCDDECM

SEQ ID NO: 273951 - protein, 8 aa, Influenza virus
CMNSVKNG

SEQ ID NO: 273952 - protein, 8 aa, Influenza virus
MNSVKNGT

SEQ ID NO: 273953 - protein, 8 aa, Influenza virus
NSVKNGTY

SEQ ID NO: 273954 - protein, 8 aa, Influenza virus
SVKNGTYD

SEQ ID NO: 273955 - protein, 8 aa, Influenza virus
VKNGTYDY

SEQ ID NO: 273956 - protein, 8 aa, Influenza virus
KNGTYDYP

SEQ ID NO: 273957 - protein, 8 aa, Influenza virus
NGTYDYPK

SEQ ID NO: 273958 - protein, 8 aa, Influenza virus
GTYDYPKY

SEQ ID NO: 273959 - protein, 8 aa, Influenza virus
TYDYPKYE

SEQ ID NO: 273960 - protein, 8 aa, Influenza virus
YDYPKYEE

SEQ ID NO: 273961 - protein, 8 aa, Influenza virus
DYPKYEEE

SEQ ID NO: 273962 - protein, 8 aa, Influenza virus
YPKYEEES

SEQ ID NO: 273963 - protein, 8 aa, Influenza virus
PKYEEESK

SEQ ID NO: 273964 - protein, 8 aa, Influenza virus
KYEEESKL

SEQ ID NO: 273965 - protein, 8 aa, Influenza virus
YEEESKLN

SEQ ID NO: 273966 - protein, 8 aa, Influenza virus
EEESKLNR

SEQ ID NO: 273967 - protein, 8 aa, Influenza virus
EESKLNRN

SEQ ID NO: 273968 - protein, 8 aa, Influenza virus
ESKLNRNE

SEQ ID NO: 273969 - protein, 8 aa, Influenza virus
SKLNRNEI

SEQ ID NO: 273970 - protein, 8 aa, Influenza virus
KLNRNEIK

SEQ ID NO: 273971 - protein, 8 aa, Influenza virus
LNRNEIKG

SEQ ID NO: 273972 - protein, 8 aa, Influenza virus
NRNEIKGV

SEQ ID NO: 273973 - protein, 8 aa, Influenza virus
RNEIKGVK

SEQ ID NO: 273974 - protein, 8 aa, Influenza virus
NEIKGVKL

SEQ ID NO: 273975 - protein, 8 aa, Influenza virus
EIKGVKLS

SEQ ID NO: 273976 - protein, 8 aa, Influenza virus
IKGVKLSS

SEQ ID NO: 273977 - protein, 8 aa, Influenza virus
KGVKLSSM

SEQ ID NO: 273978 - protein, 8 aa, Influenza virus
GVKLSSMG

SEQ ID NO: 273979 - protein, 8 aa, Influenza virus
VKLSSMGV

SEQ ID NO: 273980 - protein, 8 aa, Influenza virus
KLSSMGVY

SEQ ID NO: 273981 - protein, 8 aa, Influenza virus
LSSMGVYQ

SEQ ID NO: 273982 - protein, 8 aa, Influenza virus
SSMGVYQI

SEQ ID NO: 273983 - protein, 8 aa, Influenza virus
SMGVYQIL

SEQ ID NO: 273984 - protein, 8 aa, Influenza virus
MGVYQILA

SEQ ID NO: 273985 - protein, 8 aa, Influenza virus
GVYQILAI

SEQ ID NO: 273986 - protein, 8 aa, Influenza virus
VYQILAIY

SEQ ID NO: 273987 - protein, 8 aa, Influenza virus
YQILAIYA

SEQ ID NO: 273988 - protein, 8 aa, Influenza virus
QILAIYAT

SEQ ID NO: 273989 - protein, 8 aa, Influenza virus
ILAIYATV

SEQ ID NO: 273990 - protein, 8 aa, Influenza virus
LAIYATVA

SEQ ID NO: 273991 - protein, 8 aa, Influenza virus
AIYATVAG

SEQ ID NO: 273992 - protein, 8 aa, Influenza virus
IYATVAGS

SEQ ID NO: 273993 - protein, 8 aa, Influenza virus
YATVAGSL

SEQ ID NO: 273994 - protein, 8 aa, Influenza virus
ATVAGSLS

SEQ ID NO: 273995 - protein, 8 aa, Influenza virus
TVAGSLSL

SEQ ID NO: 273996 - protein, 8 aa, Influenza virus
VAGSLSLA

SEQ ID NO: 273997 - protein, 8 aa, Influenza virus
AGSLSLAI

SEQ ID NO: 273998 - protein, 8 aa, Influenza virus
GSLSLAIM

SEQ ID NO: 273999 - protein, 8 aa, Influenza virus
SLSLAIMM

SEQ ID NO: 274000 - protein, 8 aa, Influenza virus
LSLAIMMA

SEQ ID NO: 274001 - protein, 8 aa, Influenza virus
SLAIMMAG

SEQ ID NO: 274002 - protein, 8 aa, Influenza virus
LAIMMAGI

SEQ ID NO: 274003 - protein, 8 aa, Influenza virus
AIMMAGIS

SEQ ID NO: 274004 - protein, 8 aa, Influenza virus
AGISFWMC

SEQ ID NO: 274005 - protein, 8 aa, Influenza virus
GISFWMCS

SEQ ID NO: 274006 - protein, 8 aa, Influenza virus
ISFWMCSN

SEQ ID NO: 274007 - protein, 8 aa, Influenza virus
SFWMCSNG

SEQ ID NO: 274008 - protein, 8 aa, Influenza virus
FWMCSNGS

SEQ ID NO: 274009 - protein, 8 aa, Influenza virus
WMCSNGSL

SEQ ID NO: 274010 - protein, 8 aa, Influenza virus
MCSNGSLQ

SEQ ID NO: 274011 - protein, 8 aa, Influenza virus
CSNGSLQC

SEQ ID NO: 274012 - protein, 8 aa, Influenza virus
SNGSLQCR

SEQ ID NO: 274013 - protein, 8 aa, Influenza virus
NGSLQCRI

SEQ ID NO: 274014 - protein, 8 aa, Influenza virus
GSLQCRIC

SEQ ID NO: 274015 - protein, 8 aa, Influenza virus
SLQCRICI

SEQ ID NO: 274016 - protein, 8 aa, Influenza virus
MNPNQKII

SEQ ID NO: 274017 - protein, 8 aa, Influenza virus
NPNQKIIT

SEQ ID NO: 274018 - protein, 8 aa, Influenza virus
PNQKIITI

SEQ ID NO: 274019 - protein, 8 aa, Influenza virus
NQKIITIG

SEQ ID NO: 274020 - protein, 8 aa, Influenza virus
QKIITIGS

SEQ ID NO: 274021 - protein, 8 aa, Influenza virus
KIITIGSV

SEQ ID NO: 274022 - protein, 8 aa, Influenza virus
IITIGSVS

SEQ ID NO: 274023 - protein, 8 aa, Influenza virus
ITIGSVSL

SEQ ID NO: 274024 - protein, 8 aa, Influenza virus
TIGSVSLT

SEQ ID NO: 274025 - protein, 8 aa, Influenza virus
QIAILATT

SEQ ID NO: 274026 - protein, 8 aa, Influenza virus
IAILATTV

SEQ ID NO: 274027 - protein, 8 aa, Influenza virus
AILATTVT

SEQ ID NO: 274028 - protein, 8 aa, Influenza virus
ILATTVTL

SEQ ID NO: 274029 - protein, 8 aa, Influenza virus
LATTVTLH

SEQ ID NO: 274030 - protein, 8 aa, Influenza virus
ATTVTLHF

SEQ ID NO: 274031 - protein, 8 aa, Influenza virus
TTVTLHFK

SEQ ID NO: 274032 - protein, 8 aa, Influenza virus
TVTLHFKQ

SEQ ID NO: 274033 - protein, 8 aa, Influenza virus
VTLHFKQH

SEQ ID NO: 274034 - protein, 8 aa, Influenza virus
TLHFKQHE

SEQ ID NO: 274035 - protein, 8 aa, Influenza virus
LHFKQHEC

SEQ ID NO: 274036 - protein, 8 aa, Influenza virus
HFKQHECD

SEQ ID NO: 274037 - protein, 8 aa, Influenza virus
PCEPIIIE

SEQ ID NO: 274038 - protein, 8 aa, Influenza virus
CEPIIIER

SEQ ID NO: 274039 - protein, 8 aa, Influenza virus
EPIIIERN

SEQ ID NO: 274040 - protein, 8 aa, Influenza virus
TEIVYLNN

SEQ ID NO: 274041 - protein, 8 aa, Influenza virus
EIVYLNNT

SEQ ID NO: 274042 - protein, 8 aa, Influenza virus
IVYLNNTT

SEQ ID NO: 274043 - protein, 8 aa, Influenza virus
YLNNTTIE

SEQ ID NO: 274044 - protein, 8 aa, Influenza virus
YRNWSKPQ

SEQ ID NO: 274045 - protein, 8 aa, Influenza virus
RNWSKPQC

SEQ ID NO: 274046 - protein, 8 aa, Influenza virus
WSKPQCQI

SEQ ID NO: 274047 - protein, 8 aa, Influenza virus
SKPQCQIT

SEQ ID NO: 274048 - protein, 8 aa, Influenza virus
KPQCQITG

SEQ ID NO: 274049 - protein, 8 aa, Influenza virus
PQCQITGF

SEQ ID NO: 274050 - protein, 8 aa, Influenza virus
QCQITGFA

SEQ ID NO: 274051 - protein, 8 aa, Influenza virus
CQITGFAP

SEQ ID NO: 274052 - protein, 8 aa, Influenza virus
QITGFAPF

SEQ ID NO: 274053 - protein, 8 aa, Influenza virus
ITGFAPFS

SEQ ID NO: 274054 - protein, 8 aa, Influenza virus
TGFAPFSK

SEQ ID NO: 274055 - protein, 8 aa, Influenza virus
GFAPFSKD

SEQ ID NO: 274056 - protein, 8 aa, Influenza virus
FAPFSKDN

SEQ ID NO: 274057 - protein, 8 aa, Influenza virus
APFSKDNS

SEQ ID NO: 274058 - protein, 8 aa, Influenza virus
PFSKDNSI

SEQ ID NO: 274059 - protein, 8 aa, Influenza virus
FSKDNSIR

SEQ ID NO: 274060 - protein, 8 aa, Influenza virus
SKDNSIRL

SEQ ID NO: 274061 - protein, 8 aa, Influenza virus
KDNSIRLS

SEQ ID NO: 274062 - protein, 8 aa, Influenza virus
DNSIRLSA

SEQ ID NO: 274063 - protein, 8 aa, Influenza virus
NSIRLSAG

SEQ ID NO: 274064 - protein, 8 aa, Influenza virus
SIRLSAGG

SEQ ID NO: 274065 - protein, 8 aa, Influenza virus
IRLSAGGD

SEQ ID NO: 274066 - protein, 8 aa, Influenza virus
RLSAGGDI

SEQ ID NO: 274067 - protein, 8 aa, Influenza virus
LSAGGDIW

SEQ ID NO: 274068 - protein, 8 aa, Influenza virus
SAGGDIWV

SEQ ID NO: 274069 - protein, 8 aa, Influenza virus
AGGDIWVT

SEQ ID NO: 274070 - protein, 8 aa, Influenza virus
GGDIWVTR

SEQ ID NO: 274071 - protein, 8 aa, Influenza virus
GDIWVTRE

SEQ ID NO: 274072 - protein, 8 aa, Influenza virus
DIWVTREP

SEQ ID NO: 274073 - protein, 8 aa, Influenza virus
IWVTREPY

SEQ ID NO: 274074 - protein, 8 aa, Influenza virus
WVTREPYV

SEQ ID NO: 274075 - protein, 8 aa, Influenza virus
VTREPYVS

SEQ ID NO: 274076 - protein, 8 aa, Influenza virus
TREPYVSC

SEQ ID NO: 274077 - protein, 8 aa, Influenza virus
REPYVSCD

SEQ ID NO: 274078 - protein, 8 aa, Influenza virus
EPYVSCDP

SEQ ID NO: 274079 - protein, 8 aa, Influenza virus
GKCYQFAL

SEQ ID NO: 274080 - protein, 8 aa, Influenza virus
KCYQFALG

SEQ ID NO: 274081 - protein, 8 aa, Influenza virus
CYQFALGQ

SEQ ID NO: 274082 - protein, 8 aa, Influenza virus
YQFALGQG

SEQ ID NO: 274083 - protein, 8 aa, Influenza virus
QFALGQGT

SEQ ID NO: 274084 - protein, 8 aa, Influenza virus
FALGQGTT

SEQ ID NO: 274085 - protein, 8 aa, Influenza virus
ALGQGTTL

SEQ ID NO: 274086 - protein, 8 aa, Influenza virus
LGQGTTLD

SEQ ID NO: 274087 - protein, 8 aa, Influenza virus
GQGTTLDN

SEQ ID NO: 274088 - protein, 8 aa, Influenza virus
QGTTLDNK

SEQ ID NO: 274089 - protein, 8 aa, Influenza virus
GTTLDNKH

SEQ ID NO: 274090 - protein, 8 aa, Influenza virus
TTLDNKHS

SEQ ID NO: 274091 - protein, 8 aa, Influenza virus
TLDNKHSN

SEQ ID NO: 274092 - protein, 8 aa, Influenza virus
LDNKHSNG

SEQ ID NO: 274093 - protein, 8 aa, Influenza virus
DNKHSNGT

SEQ ID NO: 274094 - protein, 8 aa, Influenza virus
NKHSNGTI

SEQ ID NO: 274095 - protein, 8 aa, Influenza virus
KHSNGTIH

SEQ ID NO: 274096 - protein, 8 aa, Influenza virus
HSNGTIHD

SEQ ID NO: 274097 - protein, 8 aa, Influenza virus
SNGTIHDR

SEQ ID NO: 274098 - protein, 8 aa, Influenza virus
TIHDRIPH

SEQ ID NO: 274099 - protein, 8 aa, Influenza virus
IHDRIPHR

SEQ ID NO: 274100 - protein, 8 aa, Influenza virus
HDRIPHRT

SEQ ID NO: 274101 - protein, 8 aa, Influenza virus
DRIPHRTL

SEQ ID NO: 274102 - protein, 8 aa, Influenza virus
RIPHRTLL

SEQ ID NO: 274103 - protein, 8 aa, Influenza virus
IPHRTLLM

SEQ ID NO: 274104 - protein, 8 aa, Influenza virus
PHRTLLMN

SEQ ID NO: 274105 - protein, 8 aa, Influenza virus
HRTLLMNE

SEQ ID NO: 274106 - protein, 8 aa, Influenza virus
RTLLMNEL

SEQ ID NO: 274107 - protein, 8 aa, Influenza virus
TLLMNELG

SEQ ID NO: 274108 - protein, 8 aa, Influenza virus
LLMNELGV

SEQ ID NO: 274109 - protein, 8 aa, Influenza virus
LMNELGVP

SEQ ID NO: 274110 - protein, 8 aa, Influenza virus
MNELGVPF

SEQ ID NO: 274111 - protein, 8 aa, Influenza virus
NELGVPFH

SEQ ID NO: 274112 - protein, 8 aa, Influenza virus
ELGVPFHL

SEQ ID NO: 274113 - protein, 8 aa, Influenza virus
LGVPFHLG

SEQ ID NO: 274114 - protein, 8 aa, Influenza virus
GVPFHLGT

SEQ ID NO: 274115 - protein, 8 aa, Influenza virus
VPFHLGTK

SEQ ID NO: 274116 - protein, 8 aa, Influenza virus
PFHLGTKQ

SEQ ID NO: 274117 - protein, 8 aa, Influenza virus
FHLGTKQV

SEQ ID NO: 274118 - protein, 8 aa, Influenza virus
HLGTKQVC

SEQ ID NO: 274119 - protein, 8 aa, Influenza virus
LGTKQVCV

SEQ ID NO: 274120 - protein, 8 aa, Influenza virus
GTKQVCVA

SEQ ID NO: 274121 - protein, 8 aa, Influenza virus
TKQVCVAW

SEQ ID NO: 274122 - protein, 8 aa, Influenza virus
KQVCVAWS

SEQ ID NO: 274123 - protein, 8 aa, Influenza virus
QVCVAWSS

SEQ ID NO: 274124 - protein, 8 aa, Influenza virus
VCVAWSSS

SEQ ID NO: 274125 - protein, 8 aa, Influenza virus
CVAWSSSS

SEQ ID NO: 274126 - protein, 8 aa, Influenza virus
VAWSSSSC

SEQ ID NO: 274127 - protein, 8 aa, Influenza virus
AWSSSSCH

SEQ ID NO: 274128 - protein, 8 aa, Influenza virus
WSSSSCHD

SEQ ID NO: 274129 - protein, 8 aa, Influenza virus
SSSSCHDG

SEQ ID NO: 274130 - protein, 8 aa, Influenza virus
SSSCHDGK

SEQ ID NO: 274131 - protein, 8 aa, Influenza virus
SSCHDGKA

SEQ ID NO: 274132 - protein, 8 aa, Influenza virus
SCHDGKAW

SEQ ID NO: 274133 - protein, 8 aa, Influenza virus
CHDGKAWL

SEQ ID NO: 274134 - protein, 8 aa, Influenza virus
HDGKAWLH

SEQ ID NO: 274135 - protein, 8 aa, Influenza virus
DGKAWLHV

SEQ ID NO: 274136 - protein, 8 aa, Influenza virus
GKAWLHVC

SEQ ID NO: 274137 - protein, 8 aa, Influenza virus
KAWLHVCV

SEQ ID NO: 274138 - protein, 8 aa, Influenza virus
AWLHVCVT

SEQ ID NO: 274139 - protein, 8 aa, Influenza virus
WLHVCVTG

SEQ ID NO: 274140 - protein, 8 aa, Influenza virus
LHVCVTGD

SEQ ID NO: 274141 - protein, 8 aa, Influenza virus
HVCVTGDD

SEQ ID NO: 274142 - protein, 8 aa, Influenza virus
CVTGDDRN

SEQ ID NO: 274143 - protein, 8 aa, Influenza virus
VTGDDRNA

SEQ ID NO: 274144 - protein, 8 aa, Influenza virus
TGDDRNAT

SEQ ID NO: 274145 - protein, 8 aa, Influenza virus
GDDRNATA

SEQ ID NO: 274146 - protein, 8 aa, Influenza virus
DDRNATAS

SEQ ID NO: 274147 - protein, 8 aa, Influenza virus
DRNATASF

SEQ ID NO: 274148 - protein, 8 aa, Influenza virus
RNATASFI

SEQ ID NO: 274149 - protein, 8 aa, Influenza virus
NATASFIY

SEQ ID NO: 274150 - protein, 8 aa, Influenza virus
ATASFIYD

SEQ ID NO: 274151 - protein, 8 aa, Influenza virus
TASFIYDG

SEQ ID NO: 274152 - protein, 8 aa, Influenza virus
DSIGSWSQ

SEQ ID NO: 274153 - protein, 8 aa, Influenza virus
SIGSWSQN

SEQ ID NO: 274154 - protein, 8 aa, Influenza virus
IGSWSQNI

SEQ ID NO: 274155 - protein, 8 aa, Influenza virus
GSWSQNIL

SEQ ID NO: 274156 - protein, 8 aa, Influenza virus
SWSQNILR

SEQ ID NO: 274157 - protein, 8 aa, Influenza virus
WSQNILRT

SEQ ID NO: 274158 - protein, 8 aa, Influenza virus
SQNILRTQ

SEQ ID NO: 274159 - protein, 8 aa, Influenza virus
QNILRTQE

SEQ ID NO: 274160 - protein, 8 aa, Influenza virus
NILRTQES

SEQ ID NO: 274161 - protein, 8 aa, Influenza virus
ILRTQESE

SEQ ID NO: 274162 - protein, 8 aa, Influenza virus
LRTQESEC

SEQ ID NO: 274163 - protein, 8 aa, Influenza virus
RTQESECV

SEQ ID NO: 274164 - protein, 8 aa, Influenza virus
TQESECVC

SEQ ID NO: 274165 - protein, 8 aa, Influenza virus
QESECVCI

SEQ ID NO: 274166 - protein, 8 aa, Influenza virus
ESECVCIN

SEQ ID NO: 274167 - protein, 8 aa, Influenza virus
SECVCING

SEQ ID NO: 274168 - protein, 8 aa, Influenza virus
ECVCINGT

SEQ ID NO: 274169 - protein, 8 aa, Influenza virus
CVCINGTC

SEQ ID NO: 274170 - protein, 8 aa, Influenza virus
VCINGTCT

SEQ ID NO: 274171 - protein, 8 aa, Influenza virus
CINGTCTV

SEQ ID NO: 274172 - protein, 8 aa, Influenza virus
INGTCTVV

SEQ ID NO: 274173 - protein, 8 aa, Influenza virus
NGTCTVVM

SEQ ID NO: 274174 - protein, 8 aa, Influenza virus
GTCTVVMT

SEQ ID NO: 274175 - protein, 8 aa, Influenza virus
TCTVVMTD

SEQ ID NO: 274176 - protein, 8 aa, Influenza virus
CTVVMTDG

SEQ ID NO: 274177 - protein, 8 aa, Influenza virus
TVVMTDGS

SEQ ID NO: 274178 - protein, 8 aa, Influenza virus
VVMTDGSA

SEQ ID NO: 274179 - protein, 8 aa, Influenza virus
VMTDGSAS

SEQ ID NO: 274180 - protein, 8 aa, Influenza virus
MTDGSASG

SEQ ID NO: 274181 - protein, 8 aa, Influenza virus
TDGSASGR

SEQ ID NO: 274182 - protein, 8 aa, Influenza virus
DGSASGRA

SEQ ID NO: 274183 - protein, 8 aa, Influenza virus
GSASGRAD

SEQ ID NO: 274184 - protein, 8 aa, Influenza virus
SASGRADT

SEQ ID NO: 274185 - protein, 8 aa, Influenza virus
ASGRADTR

SEQ ID NO: 274186 - protein, 8 aa, Influenza virus
SGRADTRI

SEQ ID NO: 274187 - protein, 8 aa, Influenza virus
GRADTRIL

SEQ ID NO: 274188 - protein, 8 aa, Influenza virus
RADTRILF

SEQ ID NO: 274189 - protein, 8 aa, Influenza virus
ADTRILFI

SEQ ID NO: 274190 - protein, 8 aa, Influenza virus
DTRILFIK

SEQ ID NO: 274191 - protein, 8 aa, Influenza virus
TRILFIKE

SEQ ID NO: 274192 - protein, 8 aa, Influenza virus
RILFIKEG

SEQ ID NO: 274193 - protein, 8 aa, Influenza virus
ILFIKEGK

SEQ ID NO: 274194 - protein, 8 aa, Influenza virus
LFIKEGKI

SEQ ID NO: 274195 - protein, 8 aa, Influenza virus
EGKIVHIS

SEQ ID NO: 274196 - protein, 8 aa, Influenza virus
GKIVHISP

SEQ ID NO: 274197 - protein, 8 aa, Influenza virus
KIVHISPL

SEQ ID NO: 274198 - protein, 8 aa, Influenza virus
VHISPLSG

SEQ ID NO: 274199 - protein, 8 aa, Influenza virus
HISPLSGS

SEQ ID NO: 274200 - protein, 8 aa, Influenza virus
ISPLSGSA

SEQ ID NO: 274201 - protein, 8 aa, Influenza virus
SPLSGSAQ

SEQ ID NO: 274202 - protein, 8 aa, Influenza virus
PLSGSAQH

SEQ ID NO: 274203 - protein, 8 aa, Influenza virus
LSGSAQHI

SEQ ID NO: 274204 - protein, 8 aa, Influenza virus
SGSAQHIE

SEQ ID NO: 274205 - protein, 8 aa, Influenza virus
GSAQHIEE

SEQ ID NO: 274206 - protein, 8 aa, Influenza virus
SAQHIEEC

SEQ ID NO: 274207 - protein, 8 aa, Influenza virus
AQHIEECS

SEQ ID NO: 274208 - protein, 8 aa, Influenza virus
QHIEECSC

SEQ ID NO: 274209 - protein, 8 aa, Influenza virus
HIEECSCY

SEQ ID NO: 274210 - protein, 8 aa, Influenza virus
IEECSCYP

SEQ ID NO: 274211 - protein, 8 aa, Influenza virus
EECSCYPR

SEQ ID NO: 274212 - protein, 8 aa, Influenza virus
ECSCYPRY

SEQ ID NO: 274213 - protein, 8 aa, Influenza virus
CSCYPRYP

SEQ ID NO: 274214 - protein, 8 aa, Influenza virus
SCYPRYPD

SEQ ID NO: 274215 - protein, 8 aa, Influenza virus
CYPRYPDV

SEQ ID NO: 274216 - protein, 8 aa, Influenza virus
YPRYPDVR

SEQ ID NO: 274217 - protein, 8 aa, Influenza virus
PRYPDVRC

SEQ ID NO: 274218 - protein, 8 aa, Influenza virus
RYPDVRCI

SEQ ID NO: 274219 - protein, 8 aa, Influenza virus
YPDVRCIC

SEQ ID NO: 274220 - protein, 8 aa, Influenza virus
PDVRCICR

SEQ ID NO: 274221 - protein, 8 aa, Influenza virus
DVRCICRD

SEQ ID NO: 274222 - protein, 8 aa, Influenza virus
VRCICRDN

SEQ ID NO: 274223 - protein, 8 aa, Influenza virus
RCICRDNW

SEQ ID NO: 274224 - protein, 8 aa, Influenza virus
CICRDNWK

SEQ ID NO: 274225 - protein, 8 aa, Influenza virus
ICRDNWKG

SEQ ID NO: 274226 - protein, 8 aa, Influenza virus
CRDNWKGS

SEQ ID NO: 274227 - protein, 8 aa, Influenza virus
RDNWKGSN

SEQ ID NO: 274228 - protein, 8 aa, Influenza virus
DNWKGSNR

SEQ ID NO: 274229 - protein, 8 aa, Influenza virus
NWKGSNRP

SEQ ID NO: 274230 - protein, 8 aa, Influenza virus
WKGSNRPV

SEQ ID NO: 274231 - protein, 8 aa, Influenza virus
GSNRPVID

SEQ ID NO: 274232 - protein, 8 aa, Influenza virus
SNRPVIDI

SEQ ID NO: 274233 - protein, 8 aa, Influenza virus
NRPVIDIN

SEQ ID NO: 274234 - protein, 8 aa, Influenza virus
DINMEDYS

SEQ ID NO: 274235 - protein, 8 aa, Influenza virus
INMEDYSI

SEQ ID NO: 274236 - protein, 8 aa, Influenza virus
NMEDYSID

SEQ ID NO: 274237 - protein, 8 aa, Influenza virus
MEDYSIDS

SEQ ID NO: 274238 - protein, 8 aa, Influenza virus
DYSIDSSY

SEQ ID NO: 274239 - protein, 8 aa, Influenza virus
YSIDSSYV

SEQ ID NO: 274240 - protein, 8 aa, Influenza virus
SIDSSYVC

SEQ ID NO: 274241 - protein, 8 aa, Influenza virus
IDSSYVCS

SEQ ID NO: 274242 - protein, 8 aa, Influenza virus
DSSYVCSG

SEQ ID NO: 274243 - protein, 8 aa, Influenza virus
SSYVCSGL

SEQ ID NO: 274244 - protein, 8 aa, Influenza virus
SYVCSGLV

SEQ ID NO: 274245 - protein, 8 aa, Influenza virus
YVCSGLVG

SEQ ID NO: 274246 - protein, 8 aa, Influenza virus
VCSGLVGD

SEQ ID NO: 274247 - protein, 8 aa, Influenza virus
CSGLVGDT

SEQ ID NO: 274248 - protein, 8 aa, Influenza virus
SGLVGDTP

SEQ ID NO: 274249 - protein, 8 aa, Influenza virus
GLVGDTPR

SEQ ID NO: 274250 - protein, 8 aa, Influenza virus
LVGDTPRN

SEQ ID NO: 274251 - protein, 8 aa, Influenza virus
VGDTPRND

SEQ ID NO: 274252 - protein, 8 aa, Influenza virus
GDTPRNDD

SEQ ID NO: 274253 - protein, 8 aa, Influenza virus
DTPRNDDS

SEQ ID NO: 274254 - protein, 8 aa, Influenza virus
TPRNDDSS

SEQ ID NO: 274255 - protein, 8 aa, Influenza virus
PRNDDSSS

SEQ ID NO: 274256 - protein, 8 aa, Influenza virus
DRSSNSNC

SEQ ID NO: 274257 - protein, 8 aa, Influenza virus
SNSNCRDP

SEQ ID NO: 274258 - protein, 8 aa, Influenza virus
NSNCRDPN

SEQ ID NO: 274259 - protein, 8 aa, Influenza virus
SNCRDPNN

SEQ ID NO: 274260 - protein, 8 aa, Influenza virus
NCRDPNNE

SEQ ID NO: 274261 - protein, 8 aa, Influenza virus
CRDPNNER

SEQ ID NO: 274262 - protein, 8 aa, Influenza virus
RDPNNERG

SEQ ID NO: 274263 - protein, 8 aa, Influenza virus
DPNNERGN

SEQ ID NO: 274264 - protein, 8 aa, Influenza virus
PNNERGNP

SEQ ID NO: 274265 - protein, 8 aa, Influenza virus
NNERGNPG

SEQ ID NO: 274266 - protein, 8 aa, Influenza virus
NERGNPGV

SEQ ID NO: 274267 - protein, 8 aa, Influenza virus
ERGNPGVK

SEQ ID NO: 274268 - protein, 8 aa, Influenza virus
RGNPGVKG

SEQ ID NO: 274269 - protein, 8 aa, Influenza virus
GNPGVKGW

SEQ ID NO: 274270 - protein, 8 aa, Influenza virus
NPGVKGWA

SEQ ID NO: 274271 - protein, 8 aa, Influenza virus
PGVKGWAF

SEQ ID NO: 274272 - protein, 8 aa, Influenza virus
GVKGWAFD

SEQ ID NO: 274273 - protein, 8 aa, Influenza virus
VKGWAFDN

SEQ ID NO: 274274 - protein, 8 aa, Influenza virus
KGWAFDNG

SEQ ID NO: 274275 - protein, 8 aa, Influenza virus
GDDVWMGR

SEQ ID NO: 274276 - protein, 8 aa, Influenza virus
DDVWMGRT

SEQ ID NO: 274277 - protein, 8 aa, Influenza virus
DVWMGRTI

SEQ ID NO: 274278 - protein, 8 aa, Influenza virus
VWMGRTIS

SEQ ID NO: 274279 - protein, 8 aa, Influenza virus
WMGRTISK

SEQ ID NO: 274280 - protein, 8 aa, Influenza virus
KDLRSGYE

SEQ ID NO: 274281 - protein, 8 aa, Influenza virus
DLRSGYET

SEQ ID NO: 274282 - protein, 8 aa, Influenza virus
LRSGYETF

SEQ ID NO: 274283 - protein, 8 aa, Influenza virus
RSGYETFK

SEQ ID NO: 274284 - protein, 8 aa, Influenza virus
SGYETFKV

SEQ ID NO: 274285 - protein, 8 aa, Influenza virus
GYETFKVI

SEQ ID NO: 274286 - protein, 8 aa, Influenza virus
YETFKVIG

SEQ ID NO: 274287 - protein, 8 aa, Influenza virus
ETFKVIGG

SEQ ID NO: 274288 - protein, 8 aa, Influenza virus
TFKVIGGW

SEQ ID NO: 274289 - protein, 8 aa, Influenza virus
FKVIGGWS

SEQ ID NO: 274290 - protein, 8 aa, Influenza virus
KVIGGWST

SEQ ID NO: 274291 - protein, 8 aa, Influenza virus
VIGGWSTP

SEQ ID NO: 274292 - protein, 8 aa, Influenza virus
SKSQVNRQ

SEQ ID NO: 274293 - protein, 8 aa, Influenza virus
RQVIVDNN

SEQ ID NO: 274294 - protein, 8 aa, Influenza virus
NNNWSGYS

SEQ ID NO: 274295 - protein, 8 aa, Influenza virus
NNWSGYSG

SEQ ID NO: 274296 - protein, 8 aa, Influenza virus
NWSGYSGI

SEQ ID NO: 274297 - protein, 8 aa, Influenza virus
WSGYSGIF

SEQ ID NO: 274298 - protein, 8 aa, Influenza virus
SGYSGIFS

SEQ ID NO: 274299 - protein, 8 aa, Influenza virus
GYSGIFSV

SEQ ID NO: 274300 - protein, 8 aa, Influenza virus
YSGIFSVE

SEQ ID NO: 274301 - protein, 8 aa, Influenza virus
SGIFSVEG

SEQ ID NO: 274302 - protein, 8 aa, Influenza virus
GIFSVEGK

SEQ ID NO: 274303 - protein, 8 aa, Influenza virus
KSCINRCF

SEQ ID NO: 274304 - protein, 8 aa, Influenza virus
SCINRCFY

SEQ ID NO: 274305 - protein, 8 aa, Influenza virus
CINRCFYV

SEQ ID NO: 274306 - protein, 8 aa, Influenza virus
INRCFYVE

SEQ ID NO: 274307 - protein, 8 aa, Influenza virus
NRCFYVEL

SEQ ID NO: 274308 - protein, 8 aa, Influenza virus
RCFYVELI

SEQ ID NO: 274309 - protein, 8 aa, Influenza virus
CFYVELIR

SEQ ID NO: 274310 - protein, 8 aa, Influenza virus
FYVELIRG

SEQ ID NO: 274311 - protein, 8 aa, Influenza virus
YVELIRGR

SEQ ID NO: 274312 - protein, 8 aa, Influenza virus
VELIRGRP

SEQ ID NO: 274313 - protein, 8 aa, Influenza virus
ELIRGRPQ

SEQ ID NO: 274314 - protein, 8 aa, Influenza virus
LIRGRPQE

SEQ ID NO: 274315 - protein, 8 aa, Influenza virus
PQETRVWW

SEQ ID NO: 274316 - protein, 8 aa, Influenza virus
QETRVWWT

SEQ ID NO: 274317 - protein, 8 aa, Influenza virus
ETRVWWTS

SEQ ID NO: 274318 - protein, 8 aa, Influenza virus
TRVWWTSN

SEQ ID NO: 274319 - protein, 8 aa, Influenza virus
RVWWTSNS

SEQ ID NO: 274320 - protein, 8 aa, Influenza virus
VWWTSNSI

SEQ ID NO: 274321 - protein, 8 aa, Influenza virus
WWTSNSIV

SEQ ID NO: 274322 - protein, 8 aa, Influenza virus
WTSNSIVV

SEQ ID NO: 274323 - protein, 8 aa, Influenza virus
TSNSIVVF

SEQ ID NO: 274324 - protein, 8 aa, Influenza virus
SNSIVVFC

SEQ ID NO: 274325 - protein, 8 aa, Influenza virus
NSIVVFCG

SEQ ID NO: 274326 - protein, 8 aa, Influenza virus
SIVVFCGT

SEQ ID NO: 274327 - protein, 8 aa, Influenza virus
IVVFCGTS

SEQ ID NO: 274328 - protein, 8 aa, Influenza virus
VVFCGTSG

SEQ ID NO: 274329 - protein, 8 aa, Influenza virus
VFCGTSGT

SEQ ID NO: 274330 - protein, 8 aa, Influenza virus
FCGTSGTY

SEQ ID NO: 274331 - protein, 8 aa, Influenza virus
CGTSGTYG

SEQ ID NO: 274332 - protein, 8 aa, Influenza virus
GTSGTYGT

SEQ ID NO: 274333 - protein, 8 aa, Influenza virus
TSGTYGTG

SEQ ID NO: 274334 - protein, 8 aa, Influenza virus
SGTYGTGS

SEQ ID NO: 274335 - protein, 8 aa, Influenza virus
GTYGTGSW

SEQ ID NO: 274336 - protein, 8 aa, Influenza virus
TYGTGSWP

SEQ ID NO: 274337 - protein, 8 aa, Influenza virus
YGTGSWPD

SEQ ID NO: 274338 - protein, 8 aa, Influenza virus
GTGSWPDG

SEQ ID NO: 274339 - protein, 8 aa, Influenza virus
TGSWPDGA

SEQ ID NO: 274340 - protein, 8 aa, Influenza virus
GSWPDGAN

SEQ ID NO: 274341 - protein, 8 aa, Influenza virus
SWPDGANI

SEQ ID NO: 274342 - protein, 8 aa, Influenza virus
WPDGANIN

SEQ ID NO: 274343 - protein, 8 aa, Influenza virus
PDGANINF

SEQ ID NO: 274344 - protein, 8 aa, Influenza virus
DGANINFM

SEQ ID NO: 274345 - protein, 8 aa, Influenza virus
GANINFMP

SEQ ID NO: 274346 - protein, 8 aa, Influenza virus
ANINFMPI

SEQ ID NO: 274347 - protein, 8 aa, Influenza virus
MLSLIMRT

SEQ ID NO: 274348 - protein, 8 aa, Influenza virus
LSLIMRTV

SEQ ID NO: 274349 - protein, 8 aa, Influenza virus
SLIMRTVI

SEQ ID NO: 274350 - protein, 8 aa, Influenza virus
LIMRTVIA

SEQ ID NO: 274351 - protein, 8 aa, Influenza virus
SMSGFRSN

SEQ ID NO: 274352 - protein, 8 aa, Influenza virus
IFIFILLT

SEQ ID NO: 274353 - protein, 8 aa, Influenza virus
FIFILLTH

SEQ ID NO: 274354 - protein, 8 aa, Influenza virus
RFSYVFCL

SEQ ID NO: 274355 - protein, 8 aa, Influenza virus
NNNNNTAT

SEQ ID NO: 274356 - protein, 8 aa, Influenza virus
NNSTATLC

SEQ ID NO: 274357 - protein, 8 aa, Influenza virus
TATLCLGH

SEQ ID NO: 274358 - protein, 8 aa, Influenza virus
ATLCLGHH

SEQ ID NO: 274359 - protein, 8 aa, Influenza virus
TLCLGHHA

SEQ ID NO: 274360 - protein, 8 aa, Influenza virus
LCLGHHAV

SEQ ID NO: 274361 - protein, 8 aa, Influenza virus
CLGHHAVP

SEQ ID NO: 274362 - protein, 8 aa, Influenza virus
LGHHAVPN

SEQ ID NO: 274363 - protein, 8 aa, Influenza virus
GHHAVPNG

SEQ ID NO: 274364 - protein, 8 aa, Influenza virus
HHAVPNGT

SEQ ID NO: 274365 - protein, 8 aa, Influenza virus
DQIEVTNA

SEQ ID NO: 274366 - protein, 8 aa, Influenza virus
QIEVTNAT

SEQ ID NO: 274367 - protein, 8 aa, Influenza virus
IEVTNATE

SEQ ID NO: 274368 - protein, 8 aa, Influenza virus
EVTNATEL

SEQ ID NO: 274369 - protein, 8 aa, Influenza virus
VTNATELV

SEQ ID NO: 274370 - protein, 8 aa, Influenza virus
TNATELVQ

SEQ ID NO: 274371 - protein, 8 aa, Influenza virus
NATELVQS

SEQ ID NO: 274372 - protein, 8 aa, Influenza virus
WEKNCTLI

SEQ ID NO: 274373 - protein, 8 aa, Influenza virus
CTLIDALL

SEQ ID NO: 274374 - protein, 8 aa, Influenza virus
TLIDALLG

SEQ ID NO: 274375 - protein, 8 aa, Influenza virus
LIDALLGD

SEQ ID NO: 274376 - protein, 8 aa, Influenza virus
IDALLGDP

SEQ ID NO: 274377 - protein, 8 aa, Influenza virus
DALLGDPH

SEQ ID NO: 274378 - protein, 8 aa, Influenza virus
ALLGDPHC

SEQ ID NO: 274379 - protein, 8 aa, Influenza virus
LLGDPHCD

SEQ ID NO: 274380 - protein, 8 aa, Influenza virus
WDLFVERS

SEQ ID NO: 274381 - protein, 8 aa, Influenza virus
SNCYPYDV

SEQ ID NO: 274382 - protein, 8 aa, Influenza virus
CYPYDVPD

SEQ ID NO: 274383 - protein, 8 aa, Influenza virus
SLRSLVAS

SEQ ID NO: 274384 - protein, 8 aa, Influenza virus
LRSLVASS

SEQ ID NO: 274385 - protein, 8 aa, Influenza virus
RSLVASSG

SEQ ID NO: 274386 - protein, 8 aa, Influenza virus
SLVASSGT

SEQ ID NO: 274387 - protein, 8 aa, Influenza virus
LVASSGTL

SEQ ID NO: 274388 - protein, 8 aa, Influenza virus
VASSGTLE

SEQ ID NO: 274389 - protein, 8 aa, Influenza virus
ASSGTLEF

SEQ ID NO: 274390 - protein, 8 aa, Influenza virus
SFFSRLNW

SEQ ID NO: 274391 - protein, 8 aa, Influenza virus
FFSRLNWL

SEQ ID NO: 274392 - protein, 8 aa, Influenza virus
FSRLNWLT

SEQ ID NO: 274393 - protein, 8 aa, Influenza virus
FDKLYIWG

SEQ ID NO: 274394 - protein, 8 aa, Influenza virus
DKLYIWGV

SEQ ID NO: 274395 - protein, 8 aa, Influenza virus
KLYIWGVH

SEQ ID NO: 274396 - protein, 8 aa, Influenza virus
LYIWGVHH

SEQ ID NO: 274397 - protein, 8 aa, Influenza virus
YIWGVHHP

SEQ ID NO: 274398 - protein, 8 aa, Influenza virus
SIYWTIVK

SEQ ID NO: 274399 - protein, 8 aa, Influenza virus
YWTIVKPG

SEQ ID NO: 274400 - protein, 8 aa, Influenza virus
WTIVKPGD

SEQ ID NO: 274401 - protein, 8 aa, Influenza virus
STGNLIAP

SEQ ID NO: 274402 - protein, 8 aa, Influenza virus
TGNLIAPR

SEQ ID NO: 274403 - protein, 8 aa, Influenza virus
GNLIAPRG

SEQ ID NO: 274404 - protein, 8 aa, Influenza virus
NLIAPRGY

SEQ ID NO: 274405 - protein, 8 aa, Influenza virus
LIAPRGYF

SEQ ID NO: 274406 - protein, 8 aa, Influenza virus
IAPRGYFK

SEQ ID NO: 274407 - protein, 8 aa, Influenza virus
APRGYFKI

SEQ ID NO: 274408 - protein, 8 aa, Influenza virus
LNNEIRWP

SEQ ID NO: 274409 - protein, 8 aa, Influenza virus
SECITPNG

SEQ ID NO: 274410 - protein, 8 aa, Influenza virus
ECITPNGS

SEQ ID NO: 274411 - protein, 8 aa, Influenza virus
CITPNGSI

SEQ ID NO: 274412 - protein, 8 aa, Influenza virus
ITPNGSIP

SEQ ID NO: 274413 - protein, 8 aa, Influenza virus
TPNGSIPN

SEQ ID NO: 274414 - protein, 8 aa, Influenza virus
PNGSIPND

SEQ ID NO: 274415 - protein, 8 aa, Influenza virus
NGSIPNDK

SEQ ID NO: 274416 - protein, 8 aa, Influenza virus
GSIPNDKP

SEQ ID NO: 274417 - protein, 8 aa, Influenza virus
SIPNDKPF

SEQ ID NO: 274418 - protein, 8 aa, Influenza virus
IPNDKPFQ

SEQ ID NO: 274419 - protein, 8 aa, Influenza virus
PNDKPFQN

SEQ ID NO: 274420 - protein, 8 aa, Influenza virus
NDKPFQNV

SEQ ID NO: 274421 - protein, 8 aa, Influenza virus
DKPFQNVN

SEQ ID NO: 274422 - protein, 8 aa, Influenza virus
KPFQNVNR

SEQ ID NO: 274423 - protein, 8 aa, Influenza virus
PFQNVNRI

SEQ ID NO: 274424 - protein, 8 aa, Influenza virus
FQNVNRIT

SEQ ID NO: 274425 - protein, 8 aa, Influenza virus
QNVNRITY

SEQ ID NO: 274426 - protein, 8 aa, Influenza virus
NVNRITYG

SEQ ID NO: 274427 - protein, 8 aa, Influenza virus
TYGACPRY

SEQ ID NO: 274428 - protein, 8 aa, Influenza virus
QNTLKLAT

SEQ ID NO: 274429 - protein, 8 aa, Influenza virus
TLKLATGM

SEQ ID NO: 274430 - protein, 8 aa, Influenza virus
LKLATGMR

SEQ ID NO: 274431 - protein, 8 aa, Influenza virus
KLATGMRN

SEQ ID NO: 274432 - protein, 8 aa, Influenza virus
LATGMRNV

SEQ ID NO: 274433 - protein, 8 aa, Influenza virus
ATGMRNVP

SEQ ID NO: 274434 - protein, 8 aa, Influenza virus
TGMRNVPE

SEQ ID NO: 274435 - protein, 8 aa, Influenza virus
GMRNVPEK

SEQ ID NO: 274436 - protein, 8 aa, Influenza virus
MRNVPEKQ

SEQ ID NO: 274437 - protein, 8 aa, Influenza virus
QTRGIFGA

SEQ ID NO: 274438 - protein, 8 aa, Influenza virus
TRGIFGAI

SEQ ID NO: 274439 - protein, 8 aa, Influenza virus
RGIFGAIA

SEQ ID NO: 274440 - protein, 8 aa, Influenza virus
GIFGAIAG

SEQ ID NO: 274441 - protein, 8 aa, Influenza virus
IFGAIAGF

SEQ ID NO: 274442 - protein, 8 aa, Influenza virus
FGAIAGFI

SEQ ID NO: 274443 - protein, 8 aa, Influenza virus
GAIAGFIE

SEQ ID NO: 274444 - protein, 8 aa, Influenza virus
AIAGFIEN

SEQ ID NO: 274445 - protein, 8 aa, Influenza virus
IAGFIENG

SEQ ID NO: 274446 - protein, 8 aa, Influenza virus
AGFIENGW

SEQ ID NO: 274447 - protein, 8 aa, Influenza virus
GFIENGWE

SEQ ID NO: 274448 - protein, 8 aa, Influenza virus
FIENGWEG

SEQ ID NO: 274449 - protein, 8 aa, Influenza virus
IENGWEGM

SEQ ID NO: 274450 - protein, 8 aa, Influenza virus
ENGWEGMV

SEQ ID NO: 274451 - protein, 8 aa, Influenza virus
NGWEGMVD

SEQ ID NO: 274452 - protein, 8 aa, Influenza virus
GWEGMVDG

SEQ ID NO: 274453 - protein, 8 aa, Influenza virus
WEGMVDGW

SEQ ID NO: 274454 - protein, 8 aa, Influenza virus
EGMVDGWY

SEQ ID NO: 274455 - protein, 8 aa, Influenza virus
GMVDGWYG

SEQ ID NO: 274456 - protein, 8 aa, Influenza virus
MVDGWYGF

SEQ ID NO: 274457 - protein, 8 aa, Influenza virus
VDGWYGFR

SEQ ID NO: 274458 - protein, 8 aa, Influenza virus
DGWYGFRH

SEQ ID NO: 274459 - protein, 8 aa, Influenza virus
GWYGFRHQ

SEQ ID NO: 274460 - protein, 8 aa, Influenza virus
GRLVRFRH

SEQ ID NO: 274461 - protein, 8 aa, Influenza virus
RLVRFRHQ

SEQ ID NO: 274462 - protein, 8 aa, Influenza virus
WYGFRHQN

SEQ ID NO: 274463 - protein, 8 aa, Influenza virus
YGFRHQNS

SEQ ID NO: 274464 - protein, 8 aa, Influenza virus
GFRHQNSE

SEQ ID NO: 274465 - protein, 8 aa, Influenza virus
FRHQNSEG

SEQ ID NO: 274466 - protein, 8 aa, Influenza virus
QNSEGTGQ

SEQ ID NO: 274467 - protein, 8 aa, Influenza virus
NSEGTGQA

SEQ ID NO: 274468 - protein, 8 aa, Influenza virus
SEGTGQAA

SEQ ID NO: 274469 - protein, 8 aa, Influenza virus
EGTGQAAD

SEQ ID NO: 274470 - protein, 8 aa, Influenza virus
GTGQAADL

SEQ ID NO: 274471 - protein, 8 aa, Influenza virus
TGQAADLK

SEQ ID NO: 274472 - protein, 8 aa, Influenza virus
GQAADLKS

SEQ ID NO: 274473 - protein, 8 aa, Influenza virus
QAADLKST

SEQ ID NO: 274474 - protein, 8 aa, Influenza virus
AADLKSTQ

SEQ ID NO: 274475 - protein, 8 aa, Influenza virus
ADLKSTQA

SEQ ID NO: 274476 - protein, 8 aa, Influenza virus
DLKSTQAA

SEQ ID NO: 274477 - protein, 8 aa, Influenza virus
LKSTQAAI

SEQ ID NO: 274478 - protein, 8 aa, Influenza virus
KSTQAAID

SEQ ID NO: 274479 - protein, 8 aa, Influenza virus
STQAAIDQ

SEQ ID NO: 274480 - protein, 8 aa, Influenza virus
TQAAIDQI

SEQ ID NO: 274481 - protein, 8 aa, Influenza virus
QINGKLNR

SEQ ID NO: 274482 - protein, 8 aa, Influenza virus
IGKTNEKF

SEQ ID NO: 274483 - protein, 8 aa, Influenza virus
GKTNEKFH

SEQ ID NO: 274484 - protein, 8 aa, Influenza virus
KTNEKFHQ

SEQ ID NO: 274485 - protein, 8 aa, Influenza virus
TNEKFHQI

SEQ ID NO: 274486 - protein, 8 aa, Influenza virus
NEKFHQIE

SEQ ID NO: 274487 - protein, 8 aa, Influenza virus
EKFHQIEK

SEQ ID NO: 274488 - protein, 8 aa, Influenza virus
KFHQIEKE

SEQ ID NO: 274489 - protein, 8 aa, Influenza virus
FHQIEKEF

SEQ ID NO: 274490 - protein, 8 aa, Influenza virus
HQIEKEFS

SEQ ID NO: 274491 - protein, 8 aa, Influenza virus
QIEKEFSE

SEQ ID NO: 274492 - protein, 8 aa, Influenza virus
IEKEFSEV

SEQ ID NO: 274493 - protein, 8 aa, Influenza virus
EKEFSEVE

SEQ ID NO: 274494 - protein, 8 aa, Influenza virus
KEFSEVEG

SEQ ID NO: 274495 - protein, 8 aa, Influenza virus
EFSEVEGR

SEQ ID NO: 274496 - protein, 8 aa, Influenza virus
FSEVEGRI

SEQ ID NO: 274497 - protein, 8 aa, Influenza virus
SEVEGRIQ

SEQ ID NO: 274498 - protein, 8 aa, Influenza virus
EVEGRIQD

SEQ ID NO: 274499 - protein, 8 aa, Influenza virus
VEGRIQDL

SEQ ID NO: 274500 - protein, 8 aa, Influenza virus
EGRIQDLE

SEQ ID NO: 274501 - protein, 8 aa, Influenza virus
GRIQDLEK

SEQ ID NO: 274502 - protein, 8 aa, Influenza virus
RIQDLEKY

SEQ ID NO: 274503 - protein, 8 aa, Influenza virus
IQDLEKYV

SEQ ID NO: 274504 - protein, 8 aa, Influenza virus
QDLEKYVE

SEQ ID NO: 274505 - protein, 8 aa, Influenza virus
DLEKYVED

SEQ ID NO: 274506 - protein, 8 aa, Influenza virus
LEKYVEDT

SEQ ID NO: 274507 - protein, 8 aa, Influenza virus
EKYVEDTK

SEQ ID NO: 274508 - protein, 8 aa, Influenza virus
KYVEDTKI

SEQ ID NO: 274509 - protein, 8 aa, Influenza virus
YVEDTKID

SEQ ID NO: 274510 - protein, 8 aa, Influenza virus
VEDTKIDL

SEQ ID NO: 274511 - protein, 8 aa, Influenza virus
EDTKIDLW

SEQ ID NO: 274512 - protein, 8 aa, Influenza virus
DTKIDLWS

SEQ ID NO: 274513 - protein, 8 aa, Influenza virus
TKIDLWSY

SEQ ID NO: 274514 - protein, 8 aa, Influenza virus
KIDLWSYN

SEQ ID NO: 274515 - protein, 8 aa, Influenza virus
IDLWSYNA

SEQ ID NO: 274516 - protein, 8 aa, Influenza virus
DLWSYNAE

SEQ ID NO: 274517 - protein, 8 aa, Influenza virus
LWSYNAEL

SEQ ID NO: 274518 - protein, 8 aa, Influenza virus
WSYNAELL

SEQ ID NO: 274519 - protein, 8 aa, Influenza virus
SYNAELLV

SEQ ID NO: 274520 - protein, 8 aa, Influenza virus
YNAELLVA

SEQ ID NO: 274521 - protein, 8 aa, Influenza virus
NAELLVAL

SEQ ID NO: 274522 - protein, 8 aa, Influenza virus
AELLVALE

SEQ ID NO: 274523 - protein, 8 aa, Influenza virus
ELLVALEN

SEQ ID NO: 274524 - protein, 8 aa, Influenza virus
LLVALENQ

SEQ ID NO: 274525 - protein, 8 aa, Influenza virus
LVALENQH

SEQ ID NO: 274526 - protein, 8 aa, Influenza virus
VALENQHT

SEQ ID NO: 274527 - protein, 8 aa, Influenza virus
ALENQHTI

SEQ ID NO: 274528 - protein, 8 aa, Influenza virus
LENQHTID

SEQ ID NO: 274529 - protein, 8 aa, Influenza virus
ENQHTIDL

SEQ ID NO: 274530 - protein, 8 aa, Influenza virus
NQHTIDLT

SEQ ID NO: 274531 - protein, 8 aa, Influenza virus
QHTIDLTD

SEQ ID NO: 274532 - protein, 8 aa, Influenza virus
HTIDLTDS

SEQ ID NO: 274533 - protein, 8 aa, Influenza virus
TIDLTDSE

SEQ ID NO: 274534 - protein, 8 aa, Influenza virus
IDLTDSEM

SEQ ID NO: 274535 - protein, 8 aa, Influenza virus
DLTDSEMN

SEQ ID NO: 274536 - protein, 8 aa, Influenza virus
LTDSEMNK

SEQ ID NO: 274537 - protein, 8 aa, Influenza virus
TDSEMNKL

SEQ ID NO: 274538 - protein, 8 aa, Influenza virus
DSEMNKLF

SEQ ID NO: 274539 - protein, 8 aa, Influenza virus
SEMNKLFE

SEQ ID NO: 274540 - protein, 8 aa, Influenza virus
EMNKLFEK

SEQ ID NO: 274541 - protein, 8 aa, Influenza virus
MNKLFEKT

SEQ ID NO: 274542 - protein, 8 aa, Influenza virus
TKKQLREN

SEQ ID NO: 274543 - protein, 8 aa, Influenza virus
KKQLRENA

SEQ ID NO: 274544 - protein, 8 aa, Influenza virus
KQLRENAE

SEQ ID NO: 274545 - protein, 8 aa, Influenza virus
QLRENAED

SEQ ID NO: 274546 - protein, 8 aa, Influenza virus
LRENAEDM

SEQ ID NO: 274547 - protein, 8 aa, Influenza virus
RENAEDMG

SEQ ID NO: 274548 - protein, 8 aa, Influenza virus
ENAEDMGN

SEQ ID NO: 274549 - protein, 8 aa, Influenza virus
NAEDMGNG

SEQ ID NO: 274550 - protein, 8 aa, Influenza virus
AEDMGNGC

SEQ ID NO: 274551 - protein, 8 aa, Influenza virus
EDMGNGCF

SEQ ID NO: 274552 - protein, 8 aa, Influenza virus
GNGCFKIY

SEQ ID NO: 274553 - protein, 8 aa, Influenza virus
NGCFKIYH

SEQ ID NO: 274554 - protein, 8 aa, Influenza virus
GCFKIYHK

SEQ ID NO: 274555 - protein, 8 aa, Influenza virus
CFKIYHKC

SEQ ID NO: 274556 - protein, 8 aa, Influenza virus
FKIYHKCD

SEQ ID NO: 274557 - protein, 8 aa, Influenza virus
KIYHKCDN

SEQ ID NO: 274558 - protein, 8 aa, Influenza virus
IYHKCDNA

SEQ ID NO: 274559 - protein, 8 aa, Influenza virus
YHKCDNAC

SEQ ID NO: 274560 - protein, 8 aa, Influenza virus
GSIRNGTY

SEQ ID NO: 274561 - protein, 8 aa, Influenza virus
SIRNGTYD

SEQ ID NO: 274562 - protein, 8 aa, Influenza virus
IRNGTYDH

SEQ ID NO: 274563 - protein, 8 aa, Influenza virus
YRDEALNN

SEQ ID NO: 274564 - protein, 8 aa, Influenza virus
RDEALNNR

SEQ ID NO: 274565 - protein, 8 aa, Influenza virus
DEALNNRF

SEQ ID NO: 274566 - protein, 8 aa, Influenza virus
EALNNRFQ

SEQ ID NO: 274567 - protein, 8 aa, Influenza virus
GYKDWILW

SEQ ID NO: 274568 - protein, 8 aa, Influenza virus
YKDWILWI

SEQ ID NO: 274569 - protein, 8 aa, Influenza virus
KDWILWIS

SEQ ID NO: 274570 - protein, 8 aa, Influenza virus
DWILWISF

SEQ ID NO: 274571 - protein, 8 aa, Influenza virus
WILWISFA

SEQ ID NO: 274572 - protein, 8 aa, Influenza virus
ILWISFAI

SEQ ID NO: 274573 - protein, 8 aa, Influenza virus
LWISFAIS

SEQ ID NO: 274574 - protein, 8 aa, Influenza virus
WISFAISC

SEQ ID NO: 274575 - protein, 8 aa, Influenza virus
ISFAISCF

SEQ ID NO: 274576 - protein, 8 aa, Influenza virus
SFAISCFL

SEQ ID NO: 274577 - protein, 8 aa, Influenza virus
FAISCFLL

SEQ ID NO: 274578 - protein, 8 aa, Influenza virus
AISCFLLC

SEQ ID NO: 274579 - protein, 8 aa, Influenza virus
LGFIMWAC

SEQ ID NO: 274580 - protein, 8 aa, Influenza virus
GFIMWACQ

SEQ ID NO: 274581 - protein, 8 aa, Influenza virus
FIMWACQK

SEQ ID NO: 274582 - protein, 8 aa, Influenza virus
IMWACQKG

SEQ ID NO: 274583 - protein, 8 aa, Influenza virus
MWACQKGN

SEQ ID NO: 274584 - protein, 8 aa, Influenza virus
WACQKGNI

SEQ ID NO: 274585 - protein, 8 aa, Influenza virus
ACQKGNIR

SEQ ID NO: 274586 - protein, 8 aa, Influenza virus
CQKGNIRC

SEQ ID NO: 274587 - protein, 8 aa, Influenza virus
QKGNIRCN

SEQ ID NO: 274588 - protein, 8 aa, Influenza virus
KGNIRCNI

SEQ ID NO: 274589 - protein, 8 aa, Influenza virus
GNIRCNIC

SEQ ID NO: 274590 - protein, 8 aa, Influenza virus
NIRCNICI

SEQ ID NO: 274591 - protein, 8 aa, Influenza virus
HSMSGFRS

SEQ ID NO: 274592 - protein, 8 aa, Influenza virus
MKTIIIVL

SEQ ID NO: 274593 - protein, 8 aa, Influenza virus
NNNNNTAT

SEQ ID NO: 274594 - protein, 8 aa, Influenza virus
NNSTATLC

SEQ ID NO: 274595 - protein, 8 aa, Influenza virus
TATLCLGH

SEQ ID NO: 274596 - protein, 8 aa, Influenza virus
ATLCLGHH

SEQ ID NO: 274597 - protein, 8 aa, Influenza virus
TLCLGHHA

SEQ ID NO: 274598 - protein, 8 aa, Influenza virus
LCLGHHAV

SEQ ID NO: 274599 - protein, 8 aa, Influenza virus
CLGHHAVP

SEQ ID NO: 274600 - protein, 8 aa, Influenza virus
LGHHAVPN

SEQ ID NO: 274601 - protein, 8 aa, Influenza virus
GHHAVPNG

SEQ ID NO: 274602 - protein, 8 aa, Influenza virus
HHAVPNGT

SEQ ID NO: 274603 - protein, 8 aa, Influenza virus
HAVPNGTI

SEQ ID NO: 274604 - protein, 8 aa, Influenza virus
AVPNGTIV

SEQ ID NO: 274605 - protein, 8 aa, Influenza virus
VPNGTIVK

SEQ ID NO: 274606 - protein, 8 aa, Influenza virus
PNGTIVKT

SEQ ID NO: 274607 - protein, 8 aa, Influenza virus
NGTIVKTI

SEQ ID NO: 274608 - protein, 8 aa, Influenza virus
GTIVKTIT

SEQ ID NO: 274609 - protein, 8 aa, Influenza virus
DQIEVTNA

SEQ ID NO: 274610 - protein, 8 aa, Influenza virus
QIEVTNAT

SEQ ID NO: 274611 - protein, 8 aa, Influenza virus
IEVTNATE

SEQ ID NO: 274612 - protein, 8 aa, Influenza virus
EVTNATEL

SEQ ID NO: 274613 - protein, 8 aa, Influenza virus
VTNATELV

SEQ ID NO: 274614 - protein, 8 aa, Influenza virus
TNATELVQ

SEQ ID NO: 274615 - protein, 8 aa, Influenza virus
NATELVQS

SEQ ID NO: 274616 - protein, 8 aa, Influenza virus
KNCTLIDA

SEQ ID NO: 274617 - protein, 8 aa, Influenza virus
CTLIDALL

SEQ ID NO: 274618 - protein, 8 aa, Influenza virus
TLIDALLG

SEQ ID NO: 274619 - protein, 8 aa, Influenza virus
LIDALLGD

SEQ ID NO: 274620 - protein, 8 aa, Influenza virus
IDALLGDP

SEQ ID NO: 274621 - protein, 8 aa, Influenza virus
DALLGDPQ

SEQ ID NO: 274622 - protein, 8 aa, Influenza virus
ALLGDPQC

SEQ ID NO: 274623 - protein, 8 aa, Influenza virus
LLGDPQCD

SEQ ID NO: 274624 - protein, 8 aa, Influenza virus
WDLFVERS

SEQ ID NO: 274625 - protein, 8 aa, Influenza virus
SNCYPYDV

SEQ ID NO: 274626 - protein, 8 aa, Influenza virus
CYPYDVPD

SEQ ID NO: 274627 - protein, 8 aa, Influenza virus
YPYDVPDY

SEQ ID NO: 274628 - protein, 8 aa, Influenza virus
SLRSLVAS

SEQ ID NO: 274629 - protein, 8 aa, Influenza virus
LRSLVASS

SEQ ID NO: 274630 - protein, 8 aa, Influenza virus
RSLVASSG

SEQ ID NO: 274631 - protein, 8 aa, Influenza virus
SLVASSGT

SEQ ID NO: 274632 - protein, 8 aa, Influenza virus
LVASSGTL

SEQ ID NO: 274633 - protein, 8 aa, Influenza virus
VASSGTLE

SEQ ID NO: 274634 - protein, 8 aa, Influenza virus
ASSGTLEF

SEQ ID NO: 274635 - protein, 8 aa, Influenza virus
SSGTLEFN

SEQ ID NO: 274636 - protein, 8 aa, Influenza virus
SFFSRLNW

SEQ ID NO: 274637 - protein, 8 aa, Influenza virus
FFSRLNWL

SEQ ID NO: 274638 - protein, 8 aa, Influenza virus
FSRLNWLT

SEQ ID NO: 274639 - protein, 8 aa, Influenza virus
FDKLYIWG

SEQ ID NO: 274640 - protein, 8 aa, Influenza virus
DKLYIWGV

SEQ ID NO: 274641 - protein, 8 aa, Influenza virus
KLYIWGVH

SEQ ID NO: 274642 - protein, 8 aa, Influenza virus
LYIWGVHH

SEQ ID NO: 274643 - protein, 8 aa, Influenza virus
YIWGVHHP

SEQ ID NO: 274644 - protein, 8 aa, Influenza virus
WGVHHPGT

SEQ ID NO: 274645 - protein, 8 aa, Influenza virus
ISIYWTIV

SEQ ID NO: 274646 - protein, 8 aa, Influenza virus
SIYWTIVK

SEQ ID NO: 274647 - protein, 8 aa, Influenza virus
IYWTIVKP

SEQ ID NO: 274648 - protein, 8 aa, Influenza virus
YWTIVKPG

SEQ ID NO: 274649 - protein, 8 aa, Influenza virus
WTIVKPGD

SEQ ID NO: 274650 - protein, 8 aa, Influenza virus
STGNLIAP

SEQ ID NO: 274651 - protein, 8 aa, Influenza virus
TGNLIAPR

SEQ ID NO: 274652 - protein, 8 aa, Influenza virus
GNLIAPRG

SEQ ID NO: 274653 - protein, 8 aa, Influenza virus
NLIAPRGY

SEQ ID NO: 274654 - protein, 8 aa, Influenza virus
LIAPRGYF

SEQ ID NO: 274655 - protein, 8 aa, Influenza virus
IAPRGYFK

SEQ ID NO: 274656 - protein, 8 aa, Influenza virus
APRGYFKI

SEQ ID NO: 274657 - protein, 8 aa, Influenza virus
GKSSIMRS

SEQ ID NO: 274658 - protein, 8 aa, Influenza virus
KSSIMRSD

SEQ ID NO: 274659 - protein, 8 aa, Influenza virus
LNNEIRWP

SEQ ID NO: 274660 - protein, 8 aa, Influenza virus
SSIMRSDA

SEQ ID NO: 274661 - protein, 8 aa, Influenza virus
SECITPNG

SEQ ID NO: 274662 - protein, 8 aa, Influenza virus
ECITPNGS

SEQ ID NO: 274663 - protein, 8 aa, Influenza virus
CITPNGSI

SEQ ID NO: 274664 - protein, 8 aa, Influenza virus
ITPNGSIP

SEQ ID NO: 274665 - protein, 8 aa, Influenza virus
TPNGSIPN

SEQ ID NO: 274666 - protein, 8 aa, Influenza virus
PNGSIPND

SEQ ID NO: 274667 - protein, 8 aa, Influenza virus
NGSIPNDK

SEQ ID NO: 274668 - protein, 8 aa, Influenza virus
GSIPNDKP

SEQ ID NO: 274669 - protein, 8 aa, Influenza virus
SIPNDKPF

SEQ ID NO: 274670 - protein, 8 aa, Influenza virus
IPNDKPFQ

SEQ ID NO: 274671 - protein, 8 aa, Influenza virus
PNDKPFQN

SEQ ID NO: 274672 - protein, 8 aa, Influenza virus
NDKPFQNV

SEQ ID NO: 274673 - protein, 8 aa, Influenza virus
DKPFQNVN

SEQ ID NO: 274674 - protein, 8 aa, Influenza virus
KPFQNVNR

SEQ ID NO: 274675 - protein, 8 aa, Influenza virus
PFQNVNRI

SEQ ID NO: 274676 - protein, 8 aa, Influenza virus
FQNVNRIT

SEQ ID NO: 274677 - protein, 8 aa, Influenza virus
QNVNRITY

SEQ ID NO: 274678 - protein, 8 aa, Influenza virus
NVNRITYG

SEQ ID NO: 274679 - protein, 8 aa, Influenza virus
VNRITYGA

SEQ ID NO: 274680 - protein, 8 aa, Influenza virus
NRITYGAC

SEQ ID NO: 274681 - protein, 8 aa, Influenza virus
RITYGACP

SEQ ID NO: 274682 - protein, 8 aa, Influenza virus
ITYGACPR

SEQ ID NO: 274683 - protein, 8 aa, Influenza virus
TYGACPRY

SEQ ID NO: 274684 - protein, 8 aa, Influenza virus
YGACPRYV

SEQ ID NO: 274685 - protein, 8 aa, Influenza virus
YVKQNTLK

SEQ ID NO: 274686 - protein, 8 aa, Influenza virus
VKQNTLKL

SEQ ID NO: 274687 - protein, 8 aa, Influenza virus
KQNTLKLA

SEQ ID NO: 274688 - protein, 8 aa, Influenza virus
QNTLKLAT

SEQ ID NO: 274689 - protein, 8 aa, Influenza virus
NTLKLATG

SEQ ID NO: 274690 - protein, 8 aa, Influenza virus
TLKLATGM

SEQ ID NO: 274691 - protein, 8 aa, Influenza virus
LKLATGMR

SEQ ID NO: 274692 - protein, 8 aa, Influenza virus
KLATGMRN

SEQ ID NO: 274693 - protein, 8 aa, Influenza virus
LATGMRNV

SEQ ID NO: 274694 - protein, 8 aa, Influenza virus
ATGMRNVP

SEQ ID NO: 274695 - protein, 8 aa, Influenza virus
TGMRNVPE

SEQ ID NO: 274696 - protein, 8 aa, Influenza virus
GMRNVPEK

SEQ ID NO: 274697 - protein, 8 aa, Influenza virus
MRNVPEKQ

SEQ ID NO: 274698 - protein, 8 aa, Influenza virus
RNVPEKQT

SEQ ID NO: 274699 - protein, 8 aa, Influenza virus
NVPEKQTR

SEQ ID NO: 274700 - protein, 8 aa, Influenza virus
VPEKQTRG

SEQ ID NO: 274701 - protein, 8 aa, Influenza virus
PEKQTRGI

SEQ ID NO: 274702 - protein, 8 aa, Influenza virus
EKQTRGIF

SEQ ID NO: 274703 - protein, 8 aa, Influenza virus
KQTRGIFG

SEQ ID NO: 274704 - protein, 8 aa, Influenza virus
QTRGIFGA

SEQ ID NO: 274705 - protein, 8 aa, Influenza virus
TRGIFGAI

SEQ ID NO: 274706 - protein, 8 aa, Influenza virus
RGIFGAIA

SEQ ID NO: 274707 - protein, 8 aa, Influenza virus
GIFGAIAG

SEQ ID NO: 274708 - protein, 8 aa, Influenza virus
IFGAIAGF

SEQ ID NO: 274709 - protein, 8 aa, Influenza virus
FGAIAGFI

SEQ ID NO: 274710 - protein, 8 aa, Influenza virus
GAIAGFIE

SEQ ID NO: 274711 - protein, 8 aa, Influenza virus
AIAGFIEN

SEQ ID NO: 274712 - protein, 8 aa, Influenza virus
IAGFIENG

SEQ ID NO: 274713 - protein, 8 aa, Influenza virus
AGFIENGW

SEQ ID NO: 274714 - protein, 8 aa, Influenza virus
GFIENGWE

SEQ ID NO: 274715 - protein, 8 aa, Influenza virus
FIENGWEG

SEQ ID NO: 274716 - protein, 8 aa, Influenza virus
IENGWEGM

SEQ ID NO: 274717 - protein, 8 aa, Influenza virus
ENGWEGMV

SEQ ID NO: 274718 - protein, 8 aa, Influenza virus
NGWEGMVD

SEQ ID NO: 274719 - protein, 8 aa, Influenza virus
GWEGMVDG

SEQ ID NO: 274720 - protein, 8 aa, Influenza virus
WEGMVDGW

SEQ ID NO: 274721 - protein, 8 aa, Influenza virus
EGMVDGWY

SEQ ID NO: 274722 - protein, 8 aa, Influenza virus
GMVDGWYG

SEQ ID NO: 274723 - protein, 8 aa, Influenza virus
MVDGWYGF

SEQ ID NO: 274724 - protein, 8 aa, Influenza virus
VDGWYGFR

SEQ ID NO: 274725 - protein, 8 aa, Influenza virus
DGWYGFRH

SEQ ID NO: 274726 - protein, 8 aa, Influenza virus
GWYGFRHQ

SEQ ID NO: 274727 - protein, 8 aa, Influenza virus
GRLVRFRH

SEQ ID NO: 274728 - protein, 8 aa, Influenza virus
RLVRFRHQ

SEQ ID NO: 274729 - protein, 8 aa, Influenza virus
WYGFRHQN

SEQ ID NO: 274730 - protein, 8 aa, Influenza virus
YGFRHQNS

SEQ ID NO: 274731 - protein, 8 aa, Influenza virus
GFRHQNSE

SEQ ID NO: 274732 - protein, 8 aa, Influenza virus
FRHQNSEG

SEQ ID NO: 274733 - protein, 8 aa, Influenza virus
RHQNSEGT

SEQ ID NO: 274734 - protein, 8 aa, Influenza virus
HQNSEGTG

SEQ ID NO: 274735 - protein, 8 aa, Influenza virus
QNSEGTGQ

SEQ ID NO: 274736 - protein, 8 aa, Influenza virus
NSEGTGQA

SEQ ID NO: 274737 - protein, 8 aa, Influenza virus
SEGTGQAA

SEQ ID NO: 274738 - protein, 8 aa, Influenza virus
EGTGQAAD

SEQ ID NO: 274739 - protein, 8 aa, Influenza virus
GTGQAADL

SEQ ID NO: 274740 - protein, 8 aa, Influenza virus
TGQAADLK

SEQ ID NO: 274741 - protein, 8 aa, Influenza virus
GQAADLKS

SEQ ID NO: 274742 - protein, 8 aa, Influenza virus
QAADLKST

SEQ ID NO: 274743 - protein, 8 aa, Influenza virus
AADLKSTQ

SEQ ID NO: 274744 - protein, 8 aa, Influenza virus
ADLKSTQA

SEQ ID NO: 274745 - protein, 8 aa, Influenza virus
DLKSTQAA

SEQ ID NO: 274746 - protein, 8 aa, Influenza virus
LKSTQAAI

SEQ ID NO: 274747 - protein, 8 aa, Influenza virus
KSTQAAIN

SEQ ID NO: 274748 - protein, 8 aa, Influenza virus
STQAAINQ

SEQ ID NO: 274749 - protein, 8 aa, Influenza virus
TQAAINQI

SEQ ID NO: 274750 - protein, 8 aa, Influenza virus
NQINGKLN

SEQ ID NO: 274751 - protein, 8 aa, Influenza virus
QINGKLNR

SEQ ID NO: 274752 - protein, 8 aa, Influenza virus
IGKTNEKF

SEQ ID NO: 274753 - protein, 8 aa, Influenza virus
GKTNEKFH

SEQ ID NO: 274754 - protein, 8 aa, Influenza virus
KTNEKFHQ

SEQ ID NO: 274755 - protein, 8 aa, Influenza virus
TNEKFHQI

SEQ ID NO: 274756 - protein, 8 aa, Influenza virus
NEKFHQIE

SEQ ID NO: 274757 - protein, 8 aa, Influenza virus
EKFHQIEK

SEQ ID NO: 274758 - protein, 8 aa, Influenza virus
KFHQIEKE

SEQ ID NO: 274759 - protein, 8 aa, Influenza virus
FHQIEKEF

SEQ ID NO: 274760 - protein, 8 aa, Influenza virus
HQIEKEFS

SEQ ID NO: 274761 - protein, 8 aa, Influenza virus
QIEKEFSE

SEQ ID NO: 274762 - protein, 8 aa, Influenza virus
IEKEFSEV

SEQ ID NO: 274763 - protein, 8 aa, Influenza virus
EKEFSEVE

SEQ ID NO: 274764 - protein, 8 aa, Influenza virus
KEFSEVEG

SEQ ID NO: 274765 - protein, 8 aa, Influenza virus
EFSEVEGR

SEQ ID NO: 274766 - protein, 8 aa, Influenza virus
FSEVEGRI

SEQ ID NO: 274767 - protein, 8 aa, Influenza virus
SEVEGRIQ

SEQ ID NO: 274768 - protein, 8 aa, Influenza virus
EVEGRIQD

SEQ ID NO: 274769 - protein, 8 aa, Influenza virus
VEGRIQDL

SEQ ID NO: 274770 - protein, 8 aa, Influenza virus
EGRIQDLE

SEQ ID NO: 274771 - protein, 8 aa, Influenza virus
GRIQDLEK

SEQ ID NO: 274772 - protein, 8 aa, Influenza virus
RIQDLEKY

SEQ ID NO: 274773 - protein, 8 aa, Influenza virus
IQDLEKYV

SEQ ID NO: 274774 - protein, 8 aa, Influenza virus
QDLEKYVE

SEQ ID NO: 274775 - protein, 8 aa, Influenza virus
DLEKYVED

SEQ ID NO: 274776 - protein, 8 aa, Influenza virus
LEKYVEDT

SEQ ID NO: 274777 - protein, 8 aa, Influenza virus
EKYVEDTK

SEQ ID NO: 274778 - protein, 8 aa, Influenza virus
KYVEDTKI

SEQ ID NO: 274779 - protein, 8 aa, Influenza virus
YVEDTKID

SEQ ID NO: 274780 - protein, 8 aa, Influenza virus
VEDTKIDL

SEQ ID NO: 274781 - protein, 8 aa, Influenza virus
EDTKIDLW

SEQ ID NO: 274782 - protein, 8 aa, Influenza virus
DTKIDLWS

SEQ ID NO: 274783 - protein, 8 aa, Influenza virus
TKIDLWSY

SEQ ID NO: 274784 - protein, 8 aa, Influenza virus
KIDLWSYN

SEQ ID NO: 274785 - protein, 8 aa, Influenza virus
IDLWSYNA

SEQ ID NO: 274786 - protein, 8 aa, Influenza virus
DLWSYNAE

SEQ ID NO: 274787 - protein, 8 aa, Influenza virus
LWSYNAEL

SEQ ID NO: 274788 - protein, 8 aa, Influenza virus
WSYNAELL

SEQ ID NO: 274789 - protein, 8 aa, Influenza virus
SYNAELLV

SEQ ID NO: 274790 - protein, 8 aa, Influenza virus
YNAELLVA

SEQ ID NO: 274791 - protein, 8 aa, Influenza virus
NAELLVAL

SEQ ID NO: 274792 - protein, 8 aa, Influenza virus
AELLVALE

SEQ ID NO: 274793 - protein, 8 aa, Influenza virus
ELLVALEN

SEQ ID NO: 274794 - protein, 8 aa, Influenza virus
LLVALENQ

SEQ ID NO: 274795 - protein, 8 aa, Influenza virus
LVALENQH

SEQ ID NO: 274796 - protein, 8 aa, Influenza virus
VALENQHT

SEQ ID NO: 274797 - protein, 8 aa, Influenza virus
ALENQHTI

SEQ ID NO: 274798 - protein, 8 aa, Influenza virus
LENQHTID

SEQ ID NO: 274799 - protein, 8 aa, Influenza virus
ENQHTIDL

SEQ ID NO: 274800 - protein, 8 aa, Influenza virus
NQHTIDLT

SEQ ID NO: 274801 - protein, 8 aa, Influenza virus
QHTIDLTD

SEQ ID NO: 274802 - protein, 8 aa, Influenza virus
HTIDLTDS

SEQ ID NO: 274803 - protein, 8 aa, Influenza virus
TIDLTDSE

SEQ ID NO: 274804 - protein, 8 aa, Influenza virus
IDLTDSEM

SEQ ID NO: 274805 - protein, 8 aa, Influenza virus
DLTDSEMN

SEQ ID NO: 274806 - protein, 8 aa, Influenza virus
LTDSEMNK

SEQ ID NO: 274807 - protein, 8 aa, Influenza virus
TDSEMNKL

SEQ ID NO: 274808 - protein, 8 aa, Influenza virus
DSEMNKLF

SEQ ID NO: 274809 - protein, 8 aa, Influenza virus
SEMNKLFE

SEQ ID NO: 274810 - protein, 8 aa, Influenza virus
EMNKLFER

SEQ ID NO: 274811 - protein, 8 aa, Influenza virus
MNKLFERT

SEQ ID NO: 274812 - protein, 8 aa, Influenza virus
TKKQLREN

SEQ ID NO: 274813 - protein, 8 aa, Influenza virus
KKQLRENA

SEQ ID NO: 274814 - protein, 8 aa, Influenza virus
KQLRENAE

SEQ ID NO: 274815 - protein, 8 aa, Influenza virus
QLRENAED

SEQ ID NO: 274816 - protein, 8 aa, Influenza virus
LRENAEDM

SEQ ID NO: 274817 - protein, 8 aa, Influenza virus
RENAEDMG

SEQ ID NO: 274818 - protein, 8 aa, Influenza virus
ENAEDMGN

SEQ ID NO: 274819 - protein, 8 aa, Influenza virus
NAEDMGNG

SEQ ID NO: 274820 - protein, 8 aa, Influenza virus
AEDMGNGC

SEQ ID NO: 274821 - protein, 8 aa, Influenza virus
EDMGNGCF

SEQ ID NO: 274822 - protein, 8 aa, Influenza virus
DMGNGCFK

SEQ ID NO: 274823 - protein, 8 aa, Influenza virus
MGNGCFKI

SEQ ID NO: 274824 - protein, 8 aa, Influenza virus
GNGCFKIY

SEQ ID NO: 274825 - protein, 8 aa, Influenza virus
NGCFKIYH

SEQ ID NO: 274826 - protein, 8 aa, Influenza virus
GCFKIYHK

SEQ ID NO: 274827 - protein, 8 aa, Influenza virus
CFKIYHKC

SEQ ID NO: 274828 - protein, 8 aa, Influenza virus
FKIYHKCD

SEQ ID NO: 274829 - protein, 8 aa, Influenza virus
KIYHKCDN

SEQ ID NO: 274830 - protein, 8 aa, Influenza virus
IYHKCDNA

SEQ ID NO: 274831 - protein, 8 aa, Influenza virus
YHKCDNAC

SEQ ID NO: 274832 - protein, 8 aa, Influenza virus
HKCDNACI

SEQ ID NO: 274833 - protein, 8 aa, Influenza virus
CIGSIRNG

SEQ ID NO: 274834 - protein, 8 aa, Influenza virus
IGSIRNGT

SEQ ID NO: 274835 - protein, 8 aa, Influenza virus
GSIRNGTY

SEQ ID NO: 274836 - protein, 8 aa, Influenza virus
SIRNGTYD

SEQ ID NO: 274837 - protein, 8 aa, Influenza virus
IRNGTYDH

SEQ ID NO: 274838 - protein, 8 aa, Influenza virus
RNGTYDHD

SEQ ID NO: 274839 - protein, 8 aa, Influenza virus
YRDEALNN

SEQ ID NO: 274840 - protein, 8 aa, Influenza virus
RDEALNNR

SEQ ID NO: 274841 - protein, 8 aa, Influenza virus
DEALNNRF

SEQ ID NO: 274842 - protein, 8 aa, Influenza virus
EALNNRFQ

SEQ ID NO: 274843 - protein, 8 aa, Influenza virus
ALNNRFQI

SEQ ID NO: 274844 - protein, 8 aa, Influenza virus
LNNRFQIK

SEQ ID NO: 274845 - protein, 8 aa, Influenza virus
NNRFQIKG

SEQ ID NO: 274846 - protein, 8 aa, Influenza virus
NRFQIKGV

SEQ ID NO: 274847 - protein, 8 aa, Influenza virus
LKSGYKDW

SEQ ID NO: 274848 - protein, 8 aa, Influenza virus
GYKDWILW

SEQ ID NO: 274849 - protein, 8 aa, Influenza virus
YKDWILWI

SEQ ID NO: 274850 - protein, 8 aa, Influenza virus
KDWILWIS

SEQ ID NO: 274851 - protein, 8 aa, Influenza virus
DWILWISF

SEQ ID NO: 274852 - protein, 8 aa, Influenza virus
WILWISFA

SEQ ID NO: 274853 - protein, 8 aa, Influenza virus
ILWISFAI

SEQ ID NO: 274854 - protein, 8 aa, Influenza virus
LWISFAIS

SEQ ID NO: 274855 - protein, 8 aa, Influenza virus
WISFAISC

SEQ ID NO: 274856 - protein, 8 aa, Influenza virus
ISFAISCF

SEQ ID NO: 274857 - protein, 8 aa, Influenza virus
SFAISCFL

SEQ ID NO: 274858 - protein, 8 aa, Influenza virus
FAISCFLL

SEQ ID NO: 274859 - protein, 8 aa, Influenza virus
AISCFLLC

SEQ ID NO: 274860 - protein, 8 aa, Influenza virus
LGFIMWAC

SEQ ID NO: 274861 - protein, 8 aa, Influenza virus
GFIMWACQ

SEQ ID NO: 274862 - protein, 8 aa, Influenza virus
FIMWACQK

SEQ ID NO: 274863 - protein, 8 aa, Influenza virus
IMWACQKG

SEQ ID NO: 274864 - protein, 8 aa, Influenza virus
MWACQKGN

SEQ ID NO: 274865 - protein, 8 aa, Influenza virus
WACQKGNI

SEQ ID NO: 274866 - protein, 8 aa, Influenza virus
ACQKGNIR

SEQ ID NO: 274867 - protein, 8 aa, Influenza virus
CQKGNIRC

SEQ ID NO: 274868 - protein, 8 aa, Influenza virus
QKGNIRCN

SEQ ID NO: 274869 - protein, 8 aa, Influenza virus
KGNIRCNI

SEQ ID NO: 274870 - protein, 8 aa, Influenza virus
GNIRCNIC

SEQ ID NO: 274871 - protein, 8 aa, Influenza virus
NIRCNICI

SEQ ID NO: 274872 - protein, 8 aa, Influenza virus
AKAGVKMN

SEQ ID NO: 274873 - protein, 8 aa, Influenza virus
KAGVKMNP

SEQ ID NO: 274874 - protein, 8 aa, Influenza virus
AGVKMNPN

SEQ ID NO: 274875 - protein, 8 aa, Influenza virus
GVKMNPNQ

SEQ ID NO: 274876 - protein, 8 aa, Influenza virus
VKMNPNQK

SEQ ID NO: 274877 - protein, 8 aa, Influenza virus
KMNPNQKI

SEQ ID NO: 274878 - protein, 8 aa, Influenza virus
MNPNQKII

SEQ ID NO: 274879 - protein, 8 aa, Influenza virus
NPNQKIIT

SEQ ID NO: 274880 - protein, 8 aa, Influenza virus
PNQKIITI

SEQ ID NO: 274881 - protein, 8 aa, Influenza virus
QKIITIGS

SEQ ID NO: 274882 - protein, 8 aa, Influenza virus
KIITIGSV

SEQ ID NO: 274883 - protein, 8 aa, Influenza virus
TTVTLHFK

SEQ ID NO: 274884 - protein, 8 aa, Influenza virus
TVTLHFKQ

SEQ ID NO: 274885 - protein, 8 aa, Influenza virus
EKEKEICS

SEQ ID NO: 274886 - protein, 8 aa, Influenza virus
KEKEICSV

SEQ ID NO: 274887 - protein, 8 aa, Influenza virus
YRNWSKPQ

SEQ ID NO: 274888 - protein, 8 aa, Influenza virus
RNWSKPQC

SEQ ID NO: 274889 - protein, 8 aa, Influenza virus
ITGFAPFS

SEQ ID NO: 274890 - protein, 8 aa, Influenza virus
TGFAPFSK

SEQ ID NO: 274891 - protein, 8 aa, Influenza virus
GFAPFSKD

SEQ ID NO: 274892 - protein, 8 aa, Influenza virus
FAPFSKDN

SEQ ID NO: 274893 - protein, 8 aa, Influenza virus
APFSKDNS

SEQ ID NO: 274894 - protein, 8 aa, Influenza virus
PFSKDNSI

SEQ ID NO: 274895 - protein, 8 aa, Influenza virus
FSKDNSIR

SEQ ID NO: 274896 - protein, 8 aa, Influenza virus
SKDNSIRL

SEQ ID NO: 274897 - protein, 8 aa, Influenza virus
KDNSIRLS

SEQ ID NO: 274898 - protein, 8 aa, Influenza virus
DNSIRLSA

SEQ ID NO: 274899 - protein, 8 aa, Influenza virus
NSIRLSAG

SEQ ID NO: 274900 - protein, 8 aa, Influenza virus
SIRLSAGG

SEQ ID NO: 274901 - protein, 8 aa, Influenza virus
IRLSAGGD

SEQ ID NO: 274902 - protein, 8 aa, Influenza virus
RLSAGGDI

SEQ ID NO: 274903 - protein, 8 aa, Influenza virus
LSAGGDIW

SEQ ID NO: 274904 - protein, 8 aa, Influenza virus
SAGGDIWV

SEQ ID NO: 274905 - protein, 8 aa, Influenza virus
AGGDIWVT

SEQ ID NO: 274906 - protein, 8 aa, Influenza virus
GGDIWVTR

SEQ ID NO: 274907 - protein, 8 aa, Influenza virus
GDIWVTRE

SEQ ID NO: 274908 - protein, 8 aa, Influenza virus
DIWVTREP

SEQ ID NO: 274909 - protein, 8 aa, Influenza virus
IWVTREPY

SEQ ID NO: 274910 - protein, 8 aa, Influenza virus
WVTREPYV

SEQ ID NO: 274911 - protein, 8 aa, Influenza virus
VTREPYVS

SEQ ID NO: 274912 - protein, 8 aa, Influenza virus
TREPYVSC

SEQ ID NO: 274913 - protein, 8 aa, Influenza virus
REPYVSCD

SEQ ID NO: 274914 - protein, 8 aa, Influenza virus
DKCYQFAL

SEQ ID NO: 274915 - protein, 8 aa, Influenza virus
KCYQFALG

SEQ ID NO: 274916 - protein, 8 aa, Influenza virus
CYQFALGQ

SEQ ID NO: 274917 - protein, 8 aa, Influenza virus
YQFALGQG

SEQ ID NO: 274918 - protein, 8 aa, Influenza virus
QFALGQGT

SEQ ID NO: 274919 - protein, 8 aa, Influenza virus
FALGQGTT

SEQ ID NO: 274920 - protein, 8 aa, Influenza virus
ALGQGTTL

SEQ ID NO: 274921 - protein, 8 aa, Influenza virus
LGQGTTLN

SEQ ID NO: 274922 - protein, 8 aa, Influenza virus
GQGTTLNN

SEQ ID NO: 274923 - protein, 8 aa, Influenza virus
RTPYRTLL

SEQ ID NO: 274924 - protein, 8 aa, Influenza virus
TPYRTLLM

SEQ ID NO: 274925 - protein, 8 aa, Influenza virus
PYRTLLMN

SEQ ID NO: 274926 - protein, 8 aa, Influenza virus
YRTLLMNE

SEQ ID NO: 274927 - protein, 8 aa, Influenza virus
RTLLMNEL

SEQ ID NO: 274928 - protein, 8 aa, Influenza virus
TLLMNELG

SEQ ID NO: 274929 - protein, 8 aa, Influenza virus
LLMNELGV

SEQ ID NO: 274930 - protein, 8 aa, Influenza virus
LMNELGVP

SEQ ID NO: 274931 - protein, 8 aa, Influenza virus
MNELGVPF

SEQ ID NO: 274932 - protein, 8 aa, Influenza virus
NELGVPFH

SEQ ID NO: 274933 - protein, 8 aa, Influenza virus
ELGVPFHL

SEQ ID NO: 274934 - protein, 8 aa, Influenza virus
LGVPFHLG

SEQ ID NO: 274935 - protein, 8 aa, Influenza virus
GVPFHLGT

SEQ ID NO: 274936 - protein, 8 aa, Influenza virus
VPFHLGTK

SEQ ID NO: 274937 - protein, 8 aa, Influenza virus
PFHLGTKQ

SEQ ID NO: 274938 - protein, 8 aa, Influenza virus
FHLGTKQV

SEQ ID NO: 274939 - protein, 8 aa, Influenza virus
HLGTKQVC

SEQ ID NO: 274940 - protein, 8 aa, Influenza virus
LGTKQVCI

SEQ ID NO: 274941 - protein, 8 aa, Influenza virus
GTKQVCIA

SEQ ID NO: 274942 - protein, 8 aa, Influenza virus
TKQVCIAW

SEQ ID NO: 274943 - protein, 8 aa, Influenza virus
KQVCIAWS

SEQ ID NO: 274944 - protein, 8 aa, Influenza virus
QVCIAWSS

SEQ ID NO: 274945 - protein, 8 aa, Influenza virus
VCIAWSSS

SEQ ID NO: 274946 - protein, 8 aa, Influenza virus
CIAWSSSS

SEQ ID NO: 274947 - protein, 8 aa, Influenza virus
IAWSSSSC

SEQ ID NO: 274948 - protein, 8 aa, Influenza virus
AWSSSSCH

SEQ ID NO: 274949 - protein, 8 aa, Influenza virus
WSSSSCHD

SEQ ID NO: 274950 - protein, 8 aa, Influenza virus
SSSSCHDG

SEQ ID NO: 274951 - protein, 8 aa, Influenza virus
SSSCHDGK

SEQ ID NO: 274952 - protein, 8 aa, Influenza virus
SSCHDGKA

SEQ ID NO: 274953 - protein, 8 aa, Influenza virus
SCHDGKAW

SEQ ID NO: 274954 - protein, 8 aa, Influenza virus
CHDGKAWL

SEQ ID NO: 274955 - protein, 8 aa, Influenza virus
HDGKAWLH

SEQ ID NO: 274956 - protein, 8 aa, Influenza virus
DGKAWLHV

SEQ ID NO: 274957 - protein, 8 aa, Influenza virus
GKAWLHVC

SEQ ID NO: 274958 - protein, 8 aa, Influenza virus
KAWLHVCV

SEQ ID NO: 274959 - protein, 8 aa, Influenza virus
AWLHVCVT

SEQ ID NO: 274960 - protein, 8 aa, Influenza virus
WLHVCVTG

SEQ ID NO: 274961 - protein, 8 aa, Influenza virus
DKNATASF

SEQ ID NO: 274962 - protein, 8 aa, Influenza virus
KNATASFI

SEQ ID NO: 274963 - protein, 8 aa, Influenza virus
NATASFIY

SEQ ID NO: 274964 - protein, 8 aa, Influenza virus
ATASFIYN

SEQ ID NO: 274965 - protein, 8 aa, Influenza virus
TASFIYNG

SEQ ID NO: 274966 - protein, 8 aa, Influenza virus
LVDSIGSW

SEQ ID NO: 274967 - protein, 8 aa, Influenza virus
VDSIGSWS

SEQ ID NO: 274968 - protein, 8 aa, Influenza virus
EILRTQES

SEQ ID NO: 274969 - protein, 8 aa, Influenza virus
ILRTQESE

SEQ ID NO: 274970 - protein, 8 aa, Influenza virus
LRTQESEC

SEQ ID NO: 274971 - protein, 8 aa, Influenza virus
RTQESECV

SEQ ID NO: 274972 - protein, 8 aa, Influenza virus
TQESECVC

SEQ ID NO: 274973 - protein, 8 aa, Influenza virus
QESECVCI

SEQ ID NO: 274974 - protein, 8 aa, Influenza virus
ESECVCIN

SEQ ID NO: 274975 - protein, 8 aa, Influenza virus
SECVCING

SEQ ID NO: 274976 - protein, 8 aa, Influenza virus
ECVCINGT

SEQ ID NO: 274977 - protein, 8 aa, Influenza virus
CVCINGTC

SEQ ID NO: 274978 - protein, 8 aa, Influenza virus
VCINGTCT

SEQ ID NO: 274979 - protein, 8 aa, Influenza virus
CINGTCTV

SEQ ID NO: 274980 - protein, 8 aa, Influenza virus
INGTCTVV

SEQ ID NO: 274981 - protein, 8 aa, Influenza virus
NGTCTVVM

SEQ ID NO: 274982 - protein, 8 aa, Influenza virus
GTCTVVMT

SEQ ID NO: 274983 - protein, 8 aa, Influenza virus
TCTVVMTD

SEQ ID NO: 274984 - protein, 8 aa, Influenza virus
CTVVMTDG

SEQ ID NO: 274985 - protein, 8 aa, Influenza virus
TVVMTDGS

SEQ ID NO: 274986 - protein, 8 aa, Influenza virus
VVMTDGSA

SEQ ID NO: 274987 - protein, 8 aa, Influenza virus
VMTDGSAS

SEQ ID NO: 274988 - protein, 8 aa, Influenza virus
MTDGSASG

SEQ ID NO: 274989 - protein, 8 aa, Influenza virus
LFIEEGKI

SEQ ID NO: 274990 - protein, 8 aa, Influenza virus
EYYFVKEG

SEQ ID NO: 274991 - protein, 8 aa, Influenza virus
YYFVKEGK

SEQ ID NO: 274992 - protein, 8 aa, Influenza virus
YFVKEGKI

SEQ ID NO: 274993 - protein, 8 aa, Influenza virus
LSGSAQHV

SEQ ID NO: 274994 - protein, 8 aa, Influenza virus
SGSAQHVE

SEQ ID NO: 274995 - protein, 8 aa, Influenza virus
GSAQHVEE

SEQ ID NO: 274996 - protein, 8 aa, Influenza virus
SAQHVEEC

SEQ ID NO: 274997 - protein, 8 aa, Influenza virus
AQHVEECS

SEQ ID NO: 274998 - protein, 8 aa, Influenza virus
QHVEECSC

SEQ ID NO: 274999 - protein, 8 aa, Influenza virus
HVEECSCY

SEQ ID NO: 275000 - protein, 8 aa, Influenza virus
VEECSCYP

SEQ ID NO: 275001 - protein, 8 aa, Influenza virus
EECSCYPR

SEQ ID NO: 275002 - protein, 8 aa, Influenza virus
ECSCYPRY

SEQ ID NO: 275003 - protein, 8 aa, Influenza virus
CSCYPRYP

SEQ ID NO: 275004 - protein, 8 aa, Influenza virus
SCYPRYPG

SEQ ID NO: 275005 - protein, 8 aa, Influenza virus
GVRCVCRD

SEQ ID NO: 275006 - protein, 8 aa, Influenza virus
VRCVCRDN

SEQ ID NO: 275007 - protein, 8 aa, Influenza virus
RCVCRDNW

SEQ ID NO: 275008 - protein, 8 aa, Influenza virus
CVCRDNWK

SEQ ID NO: 275009 - protein, 8 aa, Influenza virus
VCRDNWKG

SEQ ID NO: 275010 - protein, 8 aa, Influenza virus
CRDNWKGS

SEQ ID NO: 275011 - protein, 8 aa, Influenza virus
RDNWKGSN

SEQ ID NO: 275012 - protein, 8 aa, Influenza virus
DNWKGSNR

SEQ ID NO: 275013 - protein, 8 aa, Influenza virus
NWKGSNRP

SEQ ID NO: 275014 - protein, 8 aa, Influenza virus
WKGSNRPI

SEQ ID NO: 275015 - protein, 8 aa, Influenza virus
KGSNRPIV

SEQ ID NO: 275016 - protein, 8 aa, Influenza virus
GSNRPIVD

SEQ ID NO: 275017 - protein, 8 aa, Influenza virus
SNRPIVDI

SEQ ID NO: 275018 - protein, 8 aa, Influenza virus
NRPIVDIN

SEQ ID NO: 275019 - protein, 8 aa, Influenza virus
SSYVCSGL

SEQ ID NO: 275020 - protein, 8 aa, Influenza virus
SYVCSGLV

SEQ ID NO: 275021 - protein, 8 aa, Influenza virus
YVCSGLVG

SEQ ID NO: 275022 - protein, 8 aa, Influenza virus
VCSGLVGD

SEQ ID NO: 275023 - protein, 8 aa, Influenza virus
CSGLVGDT

SEQ ID NO: 275024 - protein, 8 aa, Influenza virus
SGLVGDTP

SEQ ID NO: 275025 - protein, 8 aa, Influenza virus
GLVGDTPR

SEQ ID NO: 275026 - protein, 8 aa, Influenza virus
LVGDTPRK

SEQ ID NO: 275027 - protein, 8 aa, Influenza virus
HGVKGWAF

SEQ ID NO: 275028 - protein, 8 aa, Influenza virus
GVKGWAFD

SEQ ID NO: 275029 - protein, 8 aa, Influenza virus
VKGWAFDD

SEQ ID NO: 275030 - protein, 8 aa, Influenza virus
KGWAFDDG

SEQ ID NO: 275031 - protein, 8 aa, Influenza virus
GNDVWMGR

SEQ ID NO: 275032 - protein, 8 aa, Influenza virus
NDVWMGRT

SEQ ID NO: 275033 - protein, 8 aa, Influenza virus
DVWMGRTI

SEQ ID NO: 275034 - protein, 8 aa, Influenza virus
VWMGRTIS

SEQ ID NO: 275035 - protein, 8 aa, Influenza virus
WMGRTISE

SEQ ID NO: 275036 - protein, 8 aa, Influenza virus
LRSGYETF

SEQ ID NO: 275037 - protein, 8 aa, Influenza virus
RSGYETFK

SEQ ID NO: 275038 - protein, 8 aa, Influenza virus
SGYETFKV

SEQ ID NO: 275039 - protein, 8 aa, Influenza virus
GYETFKVI

SEQ ID NO: 275040 - protein, 8 aa, Influenza virus
QINRQVIV

SEQ ID NO: 275041 - protein, 8 aa, Influenza virus
RSGYSGIF

SEQ ID NO: 275042 - protein, 8 aa, Influenza virus
SGYSGIFS

SEQ ID NO: 275043 - protein, 8 aa, Influenza virus
GYSGIFSV

SEQ ID NO: 275044 - protein, 8 aa, Influenza virus
YSGIFSVE

SEQ ID NO: 275045 - protein, 8 aa, Influenza virus
SGIFSVEG

SEQ ID NO: 275046 - protein, 8 aa, Influenza virus
GIFSVEGK

SEQ ID NO: 275047 - protein, 8 aa, Influenza virus
FSVEGKSC

SEQ ID NO: 275048 - protein, 8 aa, Influenza virus
KSCINRCF

SEQ ID NO: 275049 - protein, 8 aa, Influenza virus
SCINRCFY

SEQ ID NO: 275050 - protein, 8 aa, Influenza virus
CINRCFYV

SEQ ID NO: 275051 - protein, 8 aa, Influenza virus
INRCFYVE

SEQ ID NO: 275052 - protein, 8 aa, Influenza virus
NRCFYVEL

SEQ ID NO: 275053 - protein, 8 aa, Influenza virus
RCFYVELI

SEQ ID NO: 275054 - protein, 8 aa, Influenza virus
CFYVELIR

SEQ ID NO: 275055 - protein, 8 aa, Influenza virus
FYVELIRG

SEQ ID NO: 275056 - protein, 8 aa, Influenza virus
YVELIRGR

SEQ ID NO: 275057 - protein, 8 aa, Influenza virus
EVLWTSNS

SEQ ID NO: 275058 - protein, 8 aa, Influenza virus
VLWTSNSI

SEQ ID NO: 275059 - protein, 8 aa, Influenza virus
LWTSNSIV

SEQ ID NO: 275060 - protein, 8 aa, Influenza virus
WTSNSIVV

SEQ ID NO: 275061 - protein, 8 aa, Influenza virus
TSNSIVVF

SEQ ID NO: 275062 - protein, 8 aa, Influenza virus
SNSIVVFC

SEQ ID NO: 275063 - protein, 8 aa, Influenza virus
NSIVVFCG

SEQ ID NO: 275064 - protein, 8 aa, Influenza virus
SIVVFCGT

SEQ ID NO: 275065 - protein, 8 aa, Influenza virus
IVVFCGTS

SEQ ID NO: 275066 - protein, 8 aa, Influenza virus
VVFCGTSG

SEQ ID NO: 275067 - protein, 8 aa, Influenza virus
VFCGTSGT

SEQ ID NO: 275068 - protein, 8 aa, Influenza virus
FCGTSGTY

SEQ ID NO: 275069 - protein, 8 aa, Influenza virus
CGTSGTYG

SEQ ID NO: 275070 - protein, 8 aa, Influenza virus
GTSGTYGT

SEQ ID NO: 275071 - protein, 8 aa, Influenza virus
TSGTYGTG

SEQ ID NO: 275072 - protein, 8 aa, Influenza virus
SGTYGTGS

SEQ ID NO: 275073 - protein, 8 aa, Influenza virus
GTYGTGSW

SEQ ID NO: 275074 - protein, 8 aa, Influenza virus
TYGTGSWP

SEQ ID NO: 275075 - protein, 8 aa, Influenza virus
YGTGSWPD

SEQ ID NO: 275076 - protein, 8 aa, Influenza virus
GTGSWPDG

SEQ ID NO: 275077 - protein, 8 aa, Influenza virus
TGSWPDGA

SEQ ID NO: 275078 - protein, 8 aa, Influenza virus
GSWPDGAD

SEQ ID NO: 275079 - protein, 8 aa, Influenza virus
SWPDGADI

SEQ ID NO: 275080 - protein, 8 aa, Influenza virus
DINLHAYI

SEQ ID NO: 275081 - protein, 8 aa, Influenza virus
INLHAYIS

SEQ ID NO: 275082 - protein, 8 aa, Influenza virus
NLHAYISF

SEQ ID NO: 275083 - protein, 8 aa, Influenza virus
LHAYISFR

SEQ ID NO: 275084 - protein, 8 aa, Influenza virus
HAYISFRN

SEQ ID NO: 275085 - protein, 8 aa, Influenza virus
AYISFRNL

SEQ ID NO: 275086 - protein, 8 aa, Influenza virus
YTGNPVIC

SEQ ID NO: 275087 - protein, 8 aa, Influenza virus
TGNPVICL

SEQ ID NO: 275088 - protein, 8 aa, Influenza virus
GNPVICLG

SEQ ID NO: 275089 - protein, 8 aa, Influenza virus
NPVICLGH

SEQ ID NO: 275090 - protein, 8 aa, Influenza virus
PVICLGHH

SEQ ID NO: 275091 - protein, 8 aa, Influenza virus
VICLGHHA

SEQ ID NO: 275092 - protein, 8 aa, Influenza virus
WICMGHHA

SEQ ID NO: 275093 - protein, 8 aa, Influenza virus
ICLGHHAV

SEQ ID NO: 275094 - protein, 8 aa, Influenza virus
GHHAVPNG

SEQ ID NO: 275095 - protein, 8 aa, Influenza virus
HHAVPNGT

SEQ ID NO: 275096 - protein, 8 aa, Influenza virus
VPNGTMVK

SEQ ID NO: 275097 - protein, 8 aa, Influenza virus
PNGTMVKT

SEQ ID NO: 275098 - protein, 8 aa, Influenza virus
NGTMVKTL

SEQ ID NO: 275099 - protein, 8 aa, Influenza virus
GTMVKTLT

SEQ ID NO: 275100 - protein, 8 aa, Influenza virus
TMVKTLTD

SEQ ID NO: 275101 - protein, 8 aa, Influenza virus
VKTLTDDQ

SEQ ID NO: 275102 - protein, 8 aa, Influenza virus
IEVVTAQE

SEQ ID NO: 275103 - protein, 8 aa, Influenza virus
EVVTAQEL

SEQ ID NO: 275104 - protein, 8 aa, Influenza virus
VVTAQELV

SEQ ID NO: 275105 - protein, 8 aa, Influenza virus
VTAQELVE

SEQ ID NO: 275106 - protein, 8 aa, Influenza virus
TAQELVES

SEQ ID NO: 275107 - protein, 8 aa, Influenza virus
AQELVESQ

SEQ ID NO: 275108 - protein, 8 aa, Influenza virus
PELCPSPL

SEQ ID NO: 275109 - protein, 8 aa, Influenza virus
ELCPSPLR

SEQ ID NO: 275110 - protein, 8 aa, Influenza virus
LCPSPLRL

SEQ ID NO: 275111 - protein, 8 aa, Influenza virus
CPSPLRLV

SEQ ID NO: 275112 - protein, 8 aa, Influenza virus
PSPLRLVD

SEQ ID NO: 275113 - protein, 8 aa, Influenza virus
SPLRLVDG

SEQ ID NO: 275114 - protein, 8 aa, Influenza virus
PLRLVDGQ

SEQ ID NO: 275115 - protein, 8 aa, Influenza virus
CDIVNGAL

SEQ ID NO: 275116 - protein, 8 aa, Influenza virus
DIVNGALG

SEQ ID NO: 275117 - protein, 8 aa, Influenza virus
IVNGALGS

SEQ ID NO: 275118 - protein, 8 aa, Influenza virus
VNGALGSP

SEQ ID NO: 275119 - protein, 8 aa, Influenza virus
NGALGSPG

SEQ ID NO: 275120 - protein, 8 aa, Influenza virus
GALGSPGC

SEQ ID NO: 275121 - protein, 8 aa, Influenza virus
ALGSPGCD

SEQ ID NO: 275122 - protein, 8 aa, Influenza virus
LGSPGCDH

SEQ ID NO: 275123 - protein, 8 aa, Influenza virus
GSPGCDHL

SEQ ID NO: 275124 - protein, 8 aa, Influenza virus
EWDVFIER

SEQ ID NO: 275125 - protein, 8 aa, Influenza virus
WDVFIERP

SEQ ID NO: 275126 - protein, 8 aa, Influenza virus
DTCYPFDV

SEQ ID NO: 275127 - protein, 8 aa, Influenza virus
TCYPFDVP

SEQ ID NO: 275128 - protein, 8 aa, Influenza virus
CYPFDVPD

SEQ ID NO: 275129 - protein, 8 aa, Influenza virus
YPFDVPDY

SEQ ID NO: 275130 - protein, 8 aa, Influenza virus
PFDVPDYQ

SEQ ID NO: 275131 - protein, 8 aa, Influenza virus
FDVPDYQS

SEQ ID NO: 275132 - protein, 8 aa, Influenza virus
DVPDYQSL

SEQ ID NO: 275133 - protein, 8 aa, Influenza virus
VPDYQSLR

SEQ ID NO: 275134 - protein, 8 aa, Influenza virus
PDYQSLRS

SEQ ID NO: 275135 - protein, 8 aa, Influenza virus
DYQSLRSI

SEQ ID NO: 275136 - protein, 8 aa, Influenza virus
YQSLRSIL

SEQ ID NO: 275137 - protein, 8 aa, Influenza virus
QSLRSILA

SEQ ID NO: 275138 - protein, 8 aa, Influenza virus
SLRSILAN

SEQ ID NO: 275139 - protein, 8 aa, Influenza virus
LRSILANN

SEQ ID NO: 275140 - protein, 8 aa, Influenza virus
RSILANNG

SEQ ID NO: 275141 - protein, 8 aa, Influenza virus
SILANNGK

SEQ ID NO: 275142 - protein, 8 aa, Influenza virus
ILANNGKF

SEQ ID NO: 275143 - protein, 8 aa, Influenza virus
LANNGKFE

SEQ ID NO: 275144 - protein, 8 aa, Influenza virus
ANNGKFEF

SEQ ID NO: 275145 - protein, 8 aa, Influenza virus
NNGKFEFI

SEQ ID NO: 275146 - protein, 8 aa, Influenza virus
NGKFEFIA

SEQ ID NO: 275147 - protein, 8 aa, Influenza virus
GKFEFIAE

SEQ ID NO: 275148 - protein, 8 aa, Influenza virus
KFEFIAEE

SEQ ID NO: 275149 - protein, 8 aa, Influenza virus
FEFIAEEF

SEQ ID NO: 275150 - protein, 8 aa, Influenza virus
FIAEEFQW

SEQ ID NO: 275151 - protein, 8 aa, Influenza virus
TVKQNGKS

SEQ ID NO: 275152 - protein, 8 aa, Influenza virus
VKQNGKSG

SEQ ID NO: 275153 - protein, 8 aa, Influenza virus
KQNGKSGA

SEQ ID NO: 275154 - protein, 8 aa, Influenza virus
QNGKSGAC

SEQ ID NO: 275155 - protein, 8 aa, Influenza virus
NGKSGACK

SEQ ID NO: 275156 - protein, 8 aa, Influenza virus
GKSGACKR

SEQ ID NO: 275157 - protein, 8 aa, Influenza virus
KSGACKRA

SEQ ID NO: 275158 - protein, 8 aa, Influenza virus
SGACKRAN

SEQ ID NO: 275159 - protein, 8 aa, Influenza virus
RANVNDFF

SEQ ID NO: 275160 - protein, 8 aa, Influenza virus
NDFFNRLN

SEQ ID NO: 275161 - protein, 8 aa, Influenza virus
DFFNRLNW

SEQ ID NO: 275162 - protein, 8 aa, Influenza virus
FFNRLNWL

SEQ ID NO: 275163 - protein, 8 aa, Influenza virus
RLNWLTKS

SEQ ID NO: 275164 - protein, 8 aa, Influenza virus
LNWLTKSD

SEQ ID NO: 275165 - protein, 8 aa, Influenza virus
AYPLQNLT

SEQ ID NO: 275166 - protein, 8 aa, Influenza virus
YPLQNLTK

SEQ ID NO: 275167 - protein, 8 aa, Influenza virus
PLQNLTKV

SEQ ID NO: 275168 - protein, 8 aa, Influenza virus
LQNLTKVN

SEQ ID NO: 275169 - protein, 8 aa, Influenza virus
QNLTKVNN

SEQ ID NO: 275170 - protein, 8 aa, Influenza virus
NLTKVNNG

SEQ ID NO: 275171 - protein, 8 aa, Influenza virus
LTKVNNGD

SEQ ID NO: 275172 - protein, 8 aa, Influenza virus
TKVNNGDY

SEQ ID NO: 275173 - protein, 8 aa, Influenza virus
NNGDYARL

SEQ ID NO: 275174 - protein, 8 aa, Influenza virus
NGDYARLY

SEQ ID NO: 275175 - protein, 8 aa, Influenza virus
GDYARLYI

SEQ ID NO: 275176 - protein, 8 aa, Influenza virus
DYARLYIW

SEQ ID NO: 275177 - protein, 8 aa, Influenza virus
YARLYIWG

SEQ ID NO: 275178 - protein, 8 aa, Influenza virus
ARLYIWGV

SEQ ID NO: 275179 - protein, 8 aa, Influenza virus
RLYIWGVH

SEQ ID NO: 275180 - protein, 8 aa, Influenza virus
LYIWGVHH

SEQ ID NO: 275181 - protein, 8 aa, Influenza virus
YIWGVHHP

SEQ ID NO: 275182 - protein, 8 aa, Influenza virus
IWGVHHPS

SEQ ID NO: 275183 - protein, 8 aa, Influenza virus
WGVHHPST

SEQ ID NO: 275184 - protein, 8 aa, Influenza virus
GVHHPSTD

SEQ ID NO: 275185 - protein, 8 aa, Influenza virus
VHHPSTDT

SEQ ID NO: 275186 - protein, 8 aa, Influenza virus
HHPSTDTE

SEQ ID NO: 275187 - protein, 8 aa, Influenza virus
HPSTDTEQ

SEQ ID NO: 275188 - protein, 8 aa, Influenza virus
LYKNNPGR

SEQ ID NO: 275189 - protein, 8 aa, Influenza virus
YKNNPGRV

SEQ ID NO: 275190 - protein, 8 aa, Influenza virus
KNNPGRVT

SEQ ID NO: 275191 - protein, 8 aa, Influenza virus
NNPGRVTV

SEQ ID NO: 275192 - protein, 8 aa, Influenza virus
NPGRVTVS

SEQ ID NO: 275193 - protein, 8 aa, Influenza virus
PGRVTVST

SEQ ID NO: 275194 - protein, 8 aa, Influenza virus
GRVTVSTK

SEQ ID NO: 275195 - protein, 8 aa, Influenza virus
QTSVVPNI

SEQ ID NO: 275196 - protein, 8 aa, Influenza virus
TSVVPNIG

SEQ ID NO: 275197 - protein, 8 aa, Influenza virus
SVVPNIGS

SEQ ID NO: 275198 - protein, 8 aa, Influenza virus
RPWVRGQS

SEQ ID NO: 275199 - protein, 8 aa, Influenza virus
PWVRGQSG

SEQ ID NO: 275200 - protein, 8 aa, Influenza virus
WVRGQSGR

SEQ ID NO: 275201 - protein, 8 aa, Influenza virus
VRGQSGRI

SEQ ID NO: 275202 - protein, 8 aa, Influenza virus
RGQSGRIS

SEQ ID NO: 275203 - protein, 8 aa, Influenza virus
GQSGRISF

SEQ ID NO: 275204 - protein, 8 aa, Influenza virus
QSGRISFY

SEQ ID NO: 275205 - protein, 8 aa, Influenza virus
SGRISFYW

SEQ ID NO: 275206 - protein, 8 aa, Influenza virus
GRISFYWT

SEQ ID NO: 275207 - protein, 8 aa, Influenza virus
RISFYWTI

SEQ ID NO: 275208 - protein, 8 aa, Influenza virus
ISFYWTIV

SEQ ID NO: 275209 - protein, 8 aa, Influenza virus
SFYWTIVE

SEQ ID NO: 275210 - protein, 8 aa, Influenza virus
FYWTIVEP

SEQ ID NO: 275211 - protein, 8 aa, Influenza virus
YWTIVEPG

SEQ ID NO: 275212 - protein, 8 aa, Influenza virus
WTIVEPGD

SEQ ID NO: 275213 - protein, 8 aa, Influenza virus
PGDLIVFN

SEQ ID NO: 275214 - protein, 8 aa, Influenza virus
GDLIVFNT

SEQ ID NO: 275215 - protein, 8 aa, Influenza virus
DLIVFNTI

SEQ ID NO: 275216 - protein, 8 aa, Influenza virus
LIVFNTIG

SEQ ID NO: 275217 - protein, 8 aa, Influenza virus
IVFNTIGN

SEQ ID NO: 275218 - protein, 8 aa, Influenza virus
VFNTIGNL

SEQ ID NO: 275219 - protein, 8 aa, Influenza virus
FNTIGNLI

SEQ ID NO: 275220 - protein, 8 aa, Influenza virus
NTIGNLIA

SEQ ID NO: 275221 - protein, 8 aa, Influenza virus
TIGNLIAP

SEQ ID NO: 275222 - protein, 8 aa, Influenza virus
IGNLIAPR

SEQ ID NO: 275223 - protein, 8 aa, Influenza virus
GNLIAPRG

SEQ ID NO: 275224 - protein, 8 aa, Influenza virus
NLIAPRGH

SEQ ID NO: 275225 - protein, 8 aa, Influenza virus
LIAPRGHY

SEQ ID NO: 275226 - protein, 8 aa, Influenza virus
IAPRGHYK

SEQ ID NO: 275227 - protein, 8 aa, Influenza virus
APRGHYKL

SEQ ID NO: 275228 - protein, 8 aa, Influenza virus
IGSCVSKC

SEQ ID NO: 275229 - protein, 8 aa, Influenza virus
GSCVSKCH

SEQ ID NO: 275230 - protein, 8 aa, Influenza virus
SCVSKCHT

SEQ ID NO: 275231 - protein, 8 aa, Influenza virus
SKCHTDRG

SEQ ID NO: 275232 - protein, 8 aa, Influenza virus
KCHTDRGS

SEQ ID NO: 275233 - protein, 8 aa, Influenza virus
KPFQNISR

SEQ ID NO: 275234 - protein, 8 aa, Influenza virus
PFQNISRI

SEQ ID NO: 275235 - protein, 8 aa, Influenza virus
FQNISRIS

SEQ ID NO: 275236 - protein, 8 aa, Influenza virus
GDCPKYVK

SEQ ID NO: 275237 - protein, 8 aa, Influenza virus
DCPKYVKQ

SEQ ID NO: 275238 - protein, 8 aa, Influenza virus
CPKYVKQG

SEQ ID NO: 275239 - protein, 8 aa, Influenza virus
PKYVKQGS

SEQ ID NO: 275240 - protein, 8 aa, Influenza virus
KYVKQGSL

SEQ ID NO: 275241 - protein, 8 aa, Influenza virus
YVKQGSLK

SEQ ID NO: 275242 - protein, 8 aa, Influenza virus
VKQGSLKL

SEQ ID NO: 275243 - protein, 8 aa, Influenza virus
KQGSLKLA

SEQ ID NO: 275244 - protein, 8 aa, Influenza virus
QGSLKLAT

SEQ ID NO: 275245 - protein, 8 aa, Influenza virus
GSLKLATG

SEQ ID NO: 275246 - protein, 8 aa, Influenza virus
SLKLATGM

SEQ ID NO: 275247 - protein, 8 aa, Influenza virus
LKLATGMR

SEQ ID NO: 275248 - protein, 8 aa, Influenza virus
KLATGMRN

SEQ ID NO: 275249 - protein, 8 aa, Influenza virus
LATGMRNI

SEQ ID NO: 275250 - protein, 8 aa, Influenza virus
ATGMRNIP

SEQ ID NO: 275251 - protein, 8 aa, Influenza virus
TGMRNIPE

SEQ ID NO: 275252 - protein, 8 aa, Influenza virus
GMRNIPEK

SEQ ID NO: 275253 - protein, 8 aa, Influenza virus
RGLFGAIA

SEQ ID NO: 275254 - protein, 8 aa, Influenza virus
GLFGAIAG

SEQ ID NO: 275255 - protein, 8 aa, Influenza virus
LFGAIAGF

SEQ ID NO: 275256 - protein, 8 aa, Influenza virus
FGAIAGFI

SEQ ID NO: 275257 - protein, 8 aa, Influenza virus
GAIAGFIE

SEQ ID NO: 275258 - protein, 8 aa, Influenza virus
AIAGFIEN

SEQ ID NO: 275259 - protein, 8 aa, Influenza virus
IAGFIENG

SEQ ID NO: 275260 - protein, 8 aa, Influenza virus
AGFIENGW

SEQ ID NO: 275261 - protein, 8 aa, Influenza virus
GFIENGWQ

SEQ ID NO: 275262 - protein, 8 aa, Influenza virus
FIENGWQG

SEQ ID NO: 275263 - protein, 8 aa, Influenza virus
IENGWQGL

SEQ ID NO: 275264 - protein, 8 aa, Influenza virus
ENGWQGLI

SEQ ID NO: 275265 - protein, 8 aa, Influenza virus
NGWQGLID

SEQ ID NO: 275266 - protein, 8 aa, Influenza virus
GWQGLIDG

SEQ ID NO: 275267 - protein, 8 aa, Influenza virus
WQGLIDGW

SEQ ID NO: 275268 - protein, 8 aa, Influenza virus
QGLIDGWY

SEQ ID NO: 275269 - protein, 8 aa, Influenza virus
GLIDGWYG

SEQ ID NO: 275270 - protein, 8 aa, Influenza virus
LIDGWYGF

SEQ ID NO: 275271 - protein, 8 aa, Influenza virus
IDGWYGFR

SEQ ID NO: 275272 - protein, 8 aa, Influenza virus
DGWYGFRH

SEQ ID NO: 275273 - protein, 8 aa, Influenza virus
GWYGFRHQ

SEQ ID NO: 275274 - protein, 8 aa, Influenza virus
WYGFRHQN

SEQ ID NO: 275275 - protein, 8 aa, Influenza virus
YGFRHQNA

SEQ ID NO: 275276 - protein, 8 aa, Influenza virus
GFRHQNAE

SEQ ID NO: 275277 - protein, 8 aa, Influenza virus
FRHQNAEG

SEQ ID NO: 275278 - protein, 8 aa, Influenza virus
RHQNAEGT

SEQ ID NO: 275279 - protein, 8 aa, Influenza virus
HQNAEGTG

SEQ ID NO: 275280 - protein, 8 aa, Influenza virus
QNAEGTGT

SEQ ID NO: 275281 - protein, 8 aa, Influenza virus
NAEGTGTA

SEQ ID NO: 275282 - protein, 8 aa, Influenza virus
AEGTGTAA

SEQ ID NO: 275283 - protein, 8 aa, Influenza virus
EGTGTAAD

SEQ ID NO: 275284 - protein, 8 aa, Influenza virus
GTGTAADL

SEQ ID NO: 275285 - protein, 8 aa, Influenza virus
TGTAADLK

SEQ ID NO: 275286 - protein, 8 aa, Influenza virus
GTAADLKS

SEQ ID NO: 275287 - protein, 8 aa, Influenza virus
TAADLKST

SEQ ID NO: 275288 - protein, 8 aa, Influenza virus
AADLKSTQ

SEQ ID NO: 275289 - protein, 8 aa, Influenza virus
ADLKSTQA

SEQ ID NO: 275290 - protein, 8 aa, Influenza virus
DLKSTQAA

SEQ ID NO: 275291 - protein, 8 aa, Influenza virus
LKSTQAAI

SEQ ID NO: 275292 - protein, 8 aa, Influenza virus
KSTQAAID

SEQ ID NO: 275293 - protein, 8 aa, Influenza virus
STQAAIDQ

SEQ ID NO: 275294 - protein, 8 aa, Influenza virus
TQAAIDQI

SEQ ID NO: 275295 - protein, 8 aa, Influenza virus
QAAIDQIN

SEQ ID NO: 275296 - protein, 8 aa, Influenza virus
AAIDQING

SEQ ID NO: 275297 - protein, 8 aa, Influenza virus
AIDQINGK

SEQ ID NO: 275298 - protein, 8 aa, Influenza virus
IDQINGKL

SEQ ID NO: 275299 - protein, 8 aa, Influenza virus
DQINGKLN

SEQ ID NO: 275300 - protein, 8 aa, Influenza virus
QINGKLNR

SEQ ID NO: 275301 - protein, 8 aa, Influenza virus
INGKLNRL

SEQ ID NO: 275302 - protein, 8 aa, Influenza virus
NGKLNRLI

SEQ ID NO: 275303 - protein, 8 aa, Influenza virus
GKLNRLIE

SEQ ID NO: 275304 - protein, 8 aa, Influenza virus
KLNRLIEK

SEQ ID NO: 275305 - protein, 8 aa, Influenza virus
LNRLIEKT

SEQ ID NO: 275306 - protein, 8 aa, Influenza virus
NRLIEKTN

SEQ ID NO: 275307 - protein, 8 aa, Influenza virus
RLIEKTNE

SEQ ID NO: 275308 - protein, 8 aa, Influenza virus
LIEKTNEK

SEQ ID NO: 275309 - protein, 8 aa, Influenza virus
IEKTNEKY

SEQ ID NO: 275310 - protein, 8 aa, Influenza virus
EKTNEKYH

SEQ ID NO: 275311 - protein, 8 aa, Influenza virus
KTNEKYHQ

SEQ ID NO: 275312 - protein, 8 aa, Influenza virus
TNEKYHQI

SEQ ID NO: 275313 - protein, 8 aa, Influenza virus
NEKYHQIE

SEQ ID NO: 275314 - protein, 8 aa, Influenza virus
EKYHQIEK

SEQ ID NO: 275315 - protein, 8 aa, Influenza virus
KYHQIEKE

SEQ ID NO: 275316 - protein, 8 aa, Influenza virus
YHQIEKEF

SEQ ID NO: 275317 - protein, 8 aa, Influenza virus
HQIEKEFE

SEQ ID NO: 275318 - protein, 8 aa, Influenza virus
QIEKEFEQ

SEQ ID NO: 275319 - protein, 8 aa, Influenza virus
IEKEFEQV

SEQ ID NO: 275320 - protein, 8 aa, Influenza virus
EKEFEQVE

SEQ ID NO: 275321 - protein, 8 aa, Influenza virus
KEFEQVEG

SEQ ID NO: 275322 - protein, 8 aa, Influenza virus
EFEQVEGR

SEQ ID NO: 275323 - protein, 8 aa, Influenza virus
FEQVEGRI

SEQ ID NO: 275324 - protein, 8 aa, Influenza virus
EQVEGRIQ

SEQ ID NO: 275325 - protein, 8 aa, Influenza virus
QVEGRIQD

SEQ ID NO: 275326 - protein, 8 aa, Influenza virus
VEGRIQDL

SEQ ID NO: 275327 - protein, 8 aa, Influenza virus
EGRIQDLE

SEQ ID NO: 275328 - protein, 8 aa, Influenza virus
QDLEKYVE

SEQ ID NO: 275329 - protein, 8 aa, Influenza virus
DLEKYVED

SEQ ID NO: 275330 - protein, 8 aa, Influenza virus
LEKYVEDT

SEQ ID NO: 275331 - protein, 8 aa, Influenza virus
EKYVEDTK

SEQ ID NO: 275332 - protein, 8 aa, Influenza virus
KYVEDTKI

SEQ ID NO: 275333 - protein, 8 aa, Influenza virus
YVEDTKID

SEQ ID NO: 275334 - protein, 8 aa, Influenza virus
VEDTKIDL

SEQ ID NO: 275335 - protein, 8 aa, Influenza virus
EDTKIDLW

SEQ ID NO: 275336 - protein, 8 aa, Influenza virus
DTKIDLWS

SEQ ID NO: 275337 - protein, 8 aa, Influenza virus
TKIDLWSY

SEQ ID NO: 275338 - protein, 8 aa, Influenza virus
KIDLWSYN

SEQ ID NO: 275339 - protein, 8 aa, Influenza virus
IDLWSYNA

SEQ ID NO: 275340 - protein, 8 aa, Influenza virus
DLWSYNAE

SEQ ID NO: 275341 - protein, 8 aa, Influenza virus
LWSYNAEL

SEQ ID NO: 275342 - protein, 8 aa, Influenza virus
WSYNAELL

SEQ ID NO: 275343 - protein, 8 aa, Influenza virus
SYNAELLV

SEQ ID NO: 275344 - protein, 8 aa, Influenza virus
YNAELLVA

SEQ ID NO: 275345 - protein, 8 aa, Influenza virus
NAELLVAL

SEQ ID NO: 275346 - protein, 8 aa, Influenza virus
AELLVALE

SEQ ID NO: 275347 - protein, 8 aa, Influenza virus
ELLVALEN

SEQ ID NO: 275348 - protein, 8 aa, Influenza virus
LLVALENQ

SEQ ID NO: 275349 - protein, 8 aa, Influenza virus
LVALENQH

SEQ ID NO: 275350 - protein, 8 aa, Influenza virus
VALENQHT

SEQ ID NO: 275351 - protein, 8 aa, Influenza virus
ALENQHTI

SEQ ID NO: 275352 - protein, 8 aa, Influenza virus
LENQHTID

SEQ ID NO: 275353 - protein, 8 aa, Influenza virus
ENQHTIDV

SEQ ID NO: 275354 - protein, 8 aa, Influenza virus
NQHTIDVT

SEQ ID NO: 275355 - protein, 8 aa, Influenza virus
QHTIDVTD

SEQ ID NO: 275356 - protein, 8 aa, Influenza virus
HTIDVTDS

SEQ ID NO: 275357 - protein, 8 aa, Influenza virus
TIDVTDSE

SEQ ID NO: 275358 - protein, 8 aa, Influenza virus
IDVTDSEM

SEQ ID NO: 275359 - protein, 8 aa, Influenza virus
DVTDSEMN

SEQ ID NO: 275360 - protein, 8 aa, Influenza virus
VTDSEMNK

SEQ ID NO: 275361 - protein, 8 aa, Influenza virus
TDSEMNKL

SEQ ID NO: 275362 - protein, 8 aa, Influenza virus
DSEMNKLF

SEQ ID NO: 275363 - protein, 8 aa, Influenza virus
SEMNKLFE

SEQ ID NO: 275364 - protein, 8 aa, Influenza virus
EMNKLFER

SEQ ID NO: 275365 - protein, 8 aa, Influenza virus
MNKLFERV

SEQ ID NO: 275366 - protein, 8 aa, Influenza virus
NKLFERVR

SEQ ID NO: 275367 - protein, 8 aa, Influenza virus
KLFERVRR

SEQ ID NO: 275368 - protein, 8 aa, Influenza virus
LFERVRRQ

SEQ ID NO: 275369 - protein, 8 aa, Influenza virus
FERVRRQL

SEQ ID NO: 275370 - protein, 8 aa, Influenza virus
ERVRRQLR

SEQ ID NO: 275371 - protein, 8 aa, Influenza virus
RVRRQLRE

SEQ ID NO: 275372 - protein, 8 aa, Influenza virus
VRRQLREN

SEQ ID NO: 275373 - protein, 8 aa, Influenza virus
RRQLRENA

SEQ ID NO: 275374 - protein, 8 aa, Influenza virus
RQLRENAE

SEQ ID NO: 275375 - protein, 8 aa, Influenza virus
QLRENAED

SEQ ID NO: 275376 - protein, 8 aa, Influenza virus
LRENAEDK

SEQ ID NO: 275377 - protein, 8 aa, Influenza virus
RENAEDKG

SEQ ID NO: 275378 - protein, 8 aa, Influenza virus
ENAEDKGN

SEQ ID NO: 275379 - protein, 8 aa, Influenza virus
NAEDKGNG

SEQ ID NO: 275380 - protein, 8 aa, Influenza virus
AEDKGNGC

SEQ ID NO: 275381 - protein, 8 aa, Influenza virus
EDKGNGCF

SEQ ID NO: 275382 - protein, 8 aa, Influenza virus
DKGNGCFE

SEQ ID NO: 275383 - protein, 8 aa, Influenza virus
KGNGCFEI

SEQ ID NO: 275384 - protein, 8 aa, Influenza virus
GNGCFEIF

SEQ ID NO: 275385 - protein, 8 aa, Influenza virus
NGCFEIFH

SEQ ID NO: 275386 - protein, 8 aa, Influenza virus
GCFEIFHQ

SEQ ID NO: 275387 - protein, 8 aa, Influenza virus
CFEIFHQC

SEQ ID NO: 275388 - protein, 8 aa, Influenza virus
FEIFHQCD

SEQ ID NO: 275389 - protein, 8 aa, Influenza virus
EIFHQCDN

SEQ ID NO: 275390 - protein, 8 aa, Influenza virus
CDNNCIES

SEQ ID NO: 275391 - protein, 8 aa, Influenza virus
DNNCIESI

SEQ ID NO: 275392 - protein, 8 aa, Influenza virus
NNCIESIR

SEQ ID NO: 275393 - protein, 8 aa, Influenza virus
NCIESIRN

SEQ ID NO: 275394 - protein, 8 aa, Influenza virus
CIESIRNG

SEQ ID NO: 275395 - protein, 8 aa, Influenza virus
IESIRNGT

SEQ ID NO: 275396 - protein, 8 aa, Influenza virus
ESIRNGTY

SEQ ID NO: 275397 - protein, 8 aa, Influenza virus
SIRNGTYD

SEQ ID NO: 275398 - protein, 8 aa, Influenza virus
IRNGTYDH

SEQ ID NO: 275399 - protein, 8 aa, Influenza virus
RNGTYDHD

SEQ ID NO: 275400 - protein, 8 aa, Influenza virus
TYDHDIYR

SEQ ID NO: 275401 - protein, 8 aa, Influenza virus
HDIYRDEA

SEQ ID NO: 275402 - protein, 8 aa, Influenza virus
DIYRDEAI

SEQ ID NO: 275403 - protein, 8 aa, Influenza virus
IYRDEAIN

SEQ ID NO: 275404 - protein, 8 aa, Influenza virus
YRDEAINN

SEQ ID NO: 275405 - protein, 8 aa, Influenza virus
RDEAINNR

SEQ ID NO: 275406 - protein, 8 aa, Influenza virus
DEAINNRF

SEQ ID NO: 275407 - protein, 8 aa, Influenza virus
EAINNRFQ

SEQ ID NO: 275408 - protein, 8 aa, Influenza virus
AINNRFQI

SEQ ID NO: 275409 - protein, 8 aa, Influenza virus
INNRFQIQ

SEQ ID NO: 275410 - protein, 8 aa, Influenza virus
NNRFQIQG

SEQ ID NO: 275411 - protein, 8 aa, Influenza virus
NRFQIQGV

SEQ ID NO: 275412 - protein, 8 aa, Influenza virus
RFQIQGVK

SEQ ID NO: 275413 - protein, 8 aa, Influenza virus
FQIQGVKL

SEQ ID NO: 275414 - protein, 8 aa, Influenza virus
QIQGVKLT

SEQ ID NO: 275415 - protein, 8 aa, Influenza virus
IQGVKLTQ

SEQ ID NO: 275416 - protein, 8 aa, Influenza virus
QGVKLTQG

SEQ ID NO: 275417 - protein, 8 aa, Influenza virus
GVKLTQGY

SEQ ID NO: 275418 - protein, 8 aa, Influenza virus
VKLTQGYK

SEQ ID NO: 275419 - protein, 8 aa, Influenza virus
KLTQGYKD

SEQ ID NO: 275420 - protein, 8 aa, Influenza virus
LTQGYKDI

SEQ ID NO: 275421 - protein, 8 aa, Influenza virus
TQGYKDII

SEQ ID NO: 275422 - protein, 8 aa, Influenza virus
QGYKDIIL

SEQ ID NO: 275423 - protein, 8 aa, Influenza virus
GYKDIILW

SEQ ID NO: 275424 - protein, 8 aa, Influenza virus
YKDIILWI

SEQ ID NO: 275425 - protein, 8 aa, Influenza virus
KDIILWIS

SEQ ID NO: 275426 - protein, 8 aa, Influenza virus
DIILWISF

SEQ ID NO: 275427 - protein, 8 aa, Influenza virus
IILWISFS

SEQ ID NO: 275428 - protein, 8 aa, Influenza virus
ILWISFSI

SEQ ID NO: 275429 - protein, 8 aa, Influenza virus
LWISFSIS

SEQ ID NO: 275430 - protein, 8 aa, Influenza virus
WISFSISC

SEQ ID NO: 275431 - protein, 8 aa, Influenza virus
ISFSISCF

SEQ ID NO: 275432 - protein, 8 aa, Influenza virus
SFSISCFL

SEQ ID NO: 275433 - protein, 8 aa, Influenza virus
FSISCFLL

SEQ ID NO: 275434 - protein, 8 aa, Influenza virus
VTTRQASP

SEQ ID NO: 275435 - protein, 8 aa, Influenza virus
TTRQASPS

SEQ ID NO: 275436 - protein, 8 aa, Influenza virus
TRQASPSC

SEQ ID NO: 275437 - protein, 8 aa, Influenza virus
RQASPSCL

SEQ ID NO: 275438 - protein, 8 aa, Influenza virus
QASPSCLV

SEQ ID NO: 275439 - protein, 8 aa, Influenza virus
ASPSCLVV

SEQ ID NO: 275440 - protein, 8 aa, Influenza virus
SISCFLLV

SEQ ID NO: 275441 - protein, 8 aa, Influenza virus
ISCFLLVA

SEQ ID NO: 275442 - protein, 8 aa, Influenza virus
SCFLLVAL

SEQ ID NO: 275443 - protein, 8 aa, Influenza virus
CFLLVALL

SEQ ID NO: 275444 - protein, 8 aa, Influenza virus
FLLVALLL

SEQ ID NO: 275445 - protein, 8 aa, Influenza virus
ALLLAFIL

SEQ ID NO: 275446 - protein, 8 aa, Influenza virus
LLLAFILW

SEQ ID NO: 275447 - protein, 8 aa, Influenza virus
LLAFILWA

SEQ ID NO: 275448 - protein, 8 aa, Influenza virus
LAFILWAC

SEQ ID NO: 275449 - protein, 8 aa, Influenza virus
AFILWACQ

SEQ ID NO: 275450 - protein, 8 aa, Influenza virus
FILWACQN

SEQ ID NO: 275451 - protein, 8 aa, Influenza virus
ILWACQNG

SEQ ID NO: 275452 - protein, 8 aa, Influenza virus
LWACQNGN

SEQ ID NO: 275453 - protein, 8 aa, Influenza virus
WACQNGNI

SEQ ID NO: 275454 - protein, 8 aa, Influenza virus
ACQNGNIR

SEQ ID NO: 275455 - protein, 8 aa, Influenza virus
CQNGNIRC

SEQ ID NO: 275456 - protein, 8 aa, Influenza virus
QNGNIRCQ

SEQ ID NO: 275457 - protein, 8 aa, Influenza virus
NGNIRCQI

SEQ ID NO: 275458 - protein, 8 aa, Influenza virus
GNIRCQIC

SEQ ID NO: 275459 - protein, 8 aa, Influenza virus
NIRCQICI

SEQ ID NO: 275460 - protein, 8 aa, Influenza virus
SVKMEKIV

SEQ ID NO: 275461 - protein, 8 aa, Influenza virus
VKMEKIVL

SEQ ID NO: 275462 - protein, 8 aa, Influenza virus
KMEKIVLL

SEQ ID NO: 275463 - protein, 8 aa, Influenza virus
SDQICIGY

SEQ ID NO: 275464 - protein, 8 aa, Influenza virus
DQICIGYH

SEQ ID NO: 275465 - protein, 8 aa, Influenza virus
QICIGYHA

SEQ ID NO: 275466 - protein, 8 aa, Influenza virus
ICIGYHAN

SEQ ID NO: 275467 - protein, 8 aa, Influenza virus
CIGYHANN

SEQ ID NO: 275468 - protein, 8 aa, Influenza virus
IGYHANNS

SEQ ID NO: 275469 - protein, 8 aa, Influenza virus
GYHANNST

SEQ ID NO: 275470 - protein, 8 aa, Influenza virus
YHANNSTE

SEQ ID NO: 275471 - protein, 8 aa, Influenza virus
HANNSTEQ

SEQ ID NO: 275472 - protein, 8 aa, Influenza virus
STEQVDTI

SEQ ID NO: 275473 - protein, 8 aa, Influenza virus
EQVDTIME

SEQ ID NO: 275474 - protein, 8 aa, Influenza virus
QVDTIMEK

SEQ ID NO: 275475 - protein, 8 aa, Influenza virus
VDTIMEKN

SEQ ID NO: 275476 - protein, 8 aa, Influenza virus
DTIMEKNV

SEQ ID NO: 275477 - protein, 8 aa, Influenza virus
TIMEKNVT

SEQ ID NO: 275478 - protein, 8 aa, Influenza virus
IMEKNVTV

SEQ ID NO: 275479 - protein, 8 aa, Influenza virus
MEKNVTVT

SEQ ID NO: 275480 - protein, 8 aa, Influenza virus
EKNVTVTH

SEQ ID NO: 275481 - protein, 8 aa, Influenza virus
KNVTVTHA

SEQ ID NO: 275482 - protein, 8 aa, Influenza virus
NVTVTHAQ

SEQ ID NO: 275483 - protein, 8 aa, Influenza virus
VTVTHAQD

SEQ ID NO: 275484 - protein, 8 aa, Influenza virus
TVTHAQDI

SEQ ID NO: 275485 - protein, 8 aa, Influenza virus
VTHAQDIL

SEQ ID NO: 275486 - protein, 8 aa, Influenza virus
THAQDILE

SEQ ID NO: 275487 - protein, 8 aa, Influenza virus
HAQDILEK

SEQ ID NO: 275488 - protein, 8 aa, Influenza virus
GVKPLILR

SEQ ID NO: 275489 - protein, 8 aa, Influenza virus
KPLILRDC

SEQ ID NO: 275490 - protein, 8 aa, Influenza virus
PLILRDCS

SEQ ID NO: 275491 - protein, 8 aa, Influenza virus
LILRDCSV

SEQ ID NO: 275492 - protein, 8 aa, Influenza virus
ILRDCSVA

SEQ ID NO: 275493 - protein, 8 aa, Influenza virus
LRDCSVAG

SEQ ID NO: 275494 - protein, 8 aa, Influenza virus
RDCSVAGW

SEQ ID NO: 275495 - protein, 8 aa, Influenza virus
DCSVAGWL

SEQ ID NO: 275496 - protein, 8 aa, Influenza virus
CSVAGWLL

SEQ ID NO: 275497 - protein, 8 aa, Influenza virus
SVAGWLLG

SEQ ID NO: 275498 - protein, 8 aa, Influenza virus
VAGWLLGN

SEQ ID NO: 275499 - protein, 8 aa, Influenza virus
AGWLLGNP

SEQ ID NO: 275500 - protein, 8 aa, Influenza virus
GWLLGNPM

SEQ ID NO: 275501 - protein, 8 aa, Influenza virus
WLLGNPMC

SEQ ID NO: 275502 - protein, 8 aa, Influenza virus
LLGNPMCD

SEQ ID NO: 275503 - protein, 8 aa, Influenza virus
LGNPMCDE

SEQ ID NO: 275504 - protein, 8 aa, Influenza virus
GNPMCDEF

SEQ ID NO: 275505 - protein, 8 aa, Influenza virus
NVPEWSYI

SEQ ID NO: 275506 - protein, 8 aa, Influenza virus
VPEWSYIV

SEQ ID NO: 275507 - protein, 8 aa, Influenza virus
PEWSYIVE

SEQ ID NO: 275508 - protein, 8 aa, Influenza virus
EWSYIVEK

SEQ ID NO: 275509 - protein, 8 aa, Influenza virus
DYEELKHL

SEQ ID NO: 275510 - protein, 8 aa, Influenza virus
ADHPPKVA

SEQ ID NO: 275511 - protein, 8 aa, Influenza virus
NGRSSFFR

SEQ ID NO: 275512 - protein, 8 aa, Influenza virus
SFFRNVVW

SEQ ID NO: 275513 - protein, 8 aa, Influenza virus
FFRNVVWL

SEQ ID NO: 275514 - protein, 8 aa, Influenza virus
LLVLWGIH

SEQ ID NO: 275515 - protein, 8 aa, Influenza virus
LVLWGIHH

SEQ ID NO: 275516 - protein, 8 aa, Influenza virus
YISVGTST

SEQ ID NO: 275517 - protein, 8 aa, Influenza virus
ISVGTSTL

SEQ ID NO: 275518 - protein, 8 aa, Influenza virus
SVGTSTLN

SEQ ID NO: 275519 - protein, 8 aa, Influenza virus
VGTSTLNQ

SEQ ID NO: 275520 - protein, 8 aa, Influenza virus
GTSTLNQR

SEQ ID NO: 275521 - protein, 8 aa, Influenza virus
TSTLNQRL

SEQ ID NO: 275522 - protein, 8 aa, Influenza virus
FESNGNFI

SEQ ID NO: 275523 - protein, 8 aa, Influenza virus
ESNGNFIA

SEQ ID NO: 275524 - protein, 8 aa, Influenza virus
SNGNFIAP

SEQ ID NO: 275525 - protein, 8 aa, Influenza virus
NGNFIAPE

SEQ ID NO: 275526 - protein, 8 aa, Influenza virus
GNFIAPEY

SEQ ID NO: 275527 - protein, 8 aa, Influenza virus
NFIAPEYA

SEQ ID NO: 275528 - protein, 8 aa, Influenza virus
FIAPEYAY

SEQ ID NO: 275529 - protein, 8 aa, Influenza virus
IAPEYAYK

SEQ ID NO: 275530 - protein, 8 aa, Influenza virus
APEYAYKI

SEQ ID NO: 275531 - protein, 8 aa, Influenza virus
PSVKLPMG

SEQ ID NO: 275532 - protein, 8 aa, Influenza virus
CQTPMGAI

SEQ ID NO: 275533 - protein, 8 aa, Influenza virus
QTPMGAIN

SEQ ID NO: 275534 - protein, 8 aa, Influenza virus
GAIGAIDS

SEQ ID NO: 275535 - protein, 8 aa, Influenza virus
AIGAIDSS

SEQ ID NO: 275536 - protein, 8 aa, Influenza virus
IGAIDSSM

SEQ ID NO: 275537 - protein, 8 aa, Influenza virus
GAINSSMP

SEQ ID NO: 275538 - protein, 8 aa, Influenza virus
NSSMPFHN

SEQ ID NO: 275539 - protein, 8 aa, Influenza virus
SSMPFHNI

SEQ ID NO: 275540 - protein, 8 aa, Influenza virus
SMPFHNIH

SEQ ID NO: 275541 - protein, 8 aa, Influenza virus
MPFHNIHP

SEQ ID NO: 275542 - protein, 8 aa, Influenza virus
PFHNIHPL

SEQ ID NO: 275543 - protein, 8 aa, Influenza virus
FHNIHPLT

SEQ ID NO: 275544 - protein, 8 aa, Influenza virus
HNIHPLTI

SEQ ID NO: 275545 - protein, 8 aa, Influenza virus
NIHPLTIG

SEQ ID NO: 275546 - protein, 8 aa, Influenza virus
IHPLTIGE

SEQ ID NO: 275547 - protein, 8 aa, Influenza virus
HPLTIGEC

SEQ ID NO: 275548 - protein, 8 aa, Influenza virus
PLTIGECP

SEQ ID NO: 275549 - protein, 8 aa, Influenza virus
LTIGECPK

SEQ ID NO: 275550 - protein, 8 aa, Influenza virus
TIGECPKY

SEQ ID NO: 275551 - protein, 8 aa, Influenza virus
IGECPKYV

SEQ ID NO: 275552 - protein, 8 aa, Influenza virus
GECPKYVK

SEQ ID NO: 275553 - protein, 8 aa, Influenza virus
ECPKYVKS

SEQ ID NO: 275554 - protein, 8 aa, Influenza virus
LVLATGLR

SEQ ID NO: 275555 - protein, 8 aa, Influenza virus
VLATGLRN

SEQ ID NO: 275556 - protein, 8 aa, Influenza virus
REREGGRR

SEQ ID NO: 275557 - protein, 8 aa, Influenza virus
EREGGRRR

SEQ ID NO: 275558 - protein, 8 aa, Influenza virus
RRKKRGLF

SEQ ID NO: 275559 - protein, 8 aa, Influenza virus
KKKRGLFG

SEQ ID NO: 275560 - protein, 8 aa, Influenza virus
KKRGLFGA

SEQ ID NO: 275561 - protein, 8 aa, Influenza virus
TRRQKRGL

SEQ ID NO: 275562 - protein, 8 aa, Influenza virus
RRQKRGLF

SEQ ID NO: 275563 - protein, 8 aa, Influenza virus
RQKRGLFG

SEQ ID NO: 275564 - protein, 8 aa, Influenza virus
QKRGLFGA

SEQ ID NO: 275565 - protein, 8 aa, Influenza virus
KRGLFGAI

SEQ ID NO: 275566 - protein, 8 aa, Influenza virus
RRGLFGAI

SEQ ID NO: 275567 - protein, 8 aa, Influenza virus
RGLFGAIA

SEQ ID NO: 275568 - protein, 8 aa, Influenza virus
GLFGAIAG

SEQ ID NO: 275569 - protein, 8 aa, Influenza virus
LFGAIAGF

SEQ ID NO: 275570 - protein, 8 aa, Influenza virus
FGAIAGFI

SEQ ID NO: 275571 - protein, 8 aa, Influenza virus
GAIAGFIE

SEQ ID NO: 275572 - protein, 8 aa, Influenza virus
AIAGFIEG

SEQ ID NO: 275573 - protein, 8 aa, Influenza virus
IAGFIEGG

SEQ ID NO: 275574 - protein, 8 aa, Influenza virus
AGFIEGGW

SEQ ID NO: 275575 - protein, 8 aa, Influenza virus
GFIEGGWQ

SEQ ID NO: 275576 - protein, 8 aa, Influenza virus
FIEGGWQG

SEQ ID NO: 275577 - protein, 8 aa, Influenza virus
IEGGWQGM

SEQ ID NO: 275578 - protein, 8 aa, Influenza virus
EGGWQGMV

SEQ ID NO: 275579 - protein, 8 aa, Influenza virus
GGWQGMVD

SEQ ID NO: 275580 - protein, 8 aa, Influenza virus
GWQGMVDG

SEQ ID NO: 275581 - protein, 8 aa, Influenza virus
WQGMVDGW

SEQ ID NO: 275582 - protein, 8 aa, Influenza virus
QGMVDGWY

SEQ ID NO: 275583 - protein, 8 aa, Influenza virus
GMVDGWYG

SEQ ID NO: 275584 - protein, 8 aa, Influenza virus
MVDGWYGY

SEQ ID NO: 275585 - protein, 8 aa, Influenza virus
VDGWYGYH

SEQ ID NO: 275586 - protein, 8 aa, Influenza virus
DGWYGYHH

SEQ ID NO: 275587 - protein, 8 aa, Influenza virus
GWYGYHHS

SEQ ID NO: 275588 - protein, 8 aa, Influenza virus
WYGYHHSN

SEQ ID NO: 275589 - protein, 8 aa, Influenza virus
NEQGSGYA

SEQ ID NO: 275590 - protein, 8 aa, Influenza virus
EQGSGYAA

SEQ ID NO: 275591 - protein, 8 aa, Influenza virus
QGSGYAAD

SEQ ID NO: 275592 - protein, 8 aa, Influenza virus
GSGYAADK

SEQ ID NO: 275593 - protein, 8 aa, Influenza virus
SGYAADKE

SEQ ID NO: 275594 - protein, 8 aa, Influenza virus
GYAADKES

SEQ ID NO: 275595 - protein, 8 aa, Influenza virus
YAADKEST

SEQ ID NO: 275596 - protein, 8 aa, Influenza virus
AADKESTQ

SEQ ID NO: 275597 - protein, 8 aa, Influenza virus
ADKESTQK

SEQ ID NO: 275598 - protein, 8 aa, Influenza virus
DKESTQKA

SEQ ID NO: 275599 - protein, 8 aa, Influenza virus
ESTQKAID

SEQ ID NO: 275600 - protein, 8 aa, Influenza virus
STQKAIDG

SEQ ID NO: 275601 - protein, 8 aa, Influenza virus
DGVTNKVN

SEQ ID NO: 275602 - protein, 8 aa, Influenza virus
GVTNKVNS

SEQ ID NO: 275603 - protein, 8 aa, Influenza virus
VTNKVNSI

SEQ ID NO: 275604 - protein, 8 aa, Influenza virus
TNKVNSII

SEQ ID NO: 275605 - protein, 8 aa, Influenza virus
NKVNSIID

SEQ ID NO: 275606 - protein, 8 aa, Influenza virus
KVNSIIDK

SEQ ID NO: 275607 - protein, 8 aa, Influenza virus
VNSIIDKM

SEQ ID NO: 275608 - protein, 8 aa, Influenza virus
NSIIDKMN

SEQ ID NO: 275609 - protein, 8 aa, Influenza virus
SIIDKMNT

SEQ ID NO: 275610 - protein, 8 aa, Influenza virus
IIDKMNTQ

SEQ ID NO: 275611 - protein, 8 aa, Influenza virus
IDKMNTQF

SEQ ID NO: 275612 - protein, 8 aa, Influenza virus
LERRIENL

SEQ ID NO: 275613 - protein, 8 aa, Influenza virus
ERRIENLN

SEQ ID NO: 275614 - protein, 8 aa, Influenza virus
NLNKKMED

SEQ ID NO: 275615 - protein, 8 aa, Influenza virus
LNKKMEDG

SEQ ID NO: 275616 - protein, 8 aa, Influenza virus
NKKMEDGF

SEQ ID NO: 275617 - protein, 8 aa, Influenza virus
EDGFLDVW

SEQ ID NO: 275618 - protein, 8 aa, Influenza virus
GFLDVWTY

SEQ ID NO: 275619 - protein, 8 aa, Influenza virus
FLDVWTYN

SEQ ID NO: 275620 - protein, 8 aa, Influenza virus
LDVWTYNA

SEQ ID NO: 275621 - protein, 8 aa, Influenza virus
DVWTYNAE

SEQ ID NO: 275622 - protein, 8 aa, Influenza virus
VWTYNAEL

SEQ ID NO: 275623 - protein, 8 aa, Influenza virus
WTYNAELL

SEQ ID NO: 275624 - protein, 8 aa, Influenza virus
TYNAELLV

SEQ ID NO: 275625 - protein, 8 aa, Influenza virus
YNAELLVL

SEQ ID NO: 275626 - protein, 8 aa, Influenza virus
NAELLVLM

SEQ ID NO: 275627 - protein, 8 aa, Influenza virus
AELLVLME

SEQ ID NO: 275628 - protein, 8 aa, Influenza virus
ELLVLMEN

SEQ ID NO: 275629 - protein, 8 aa, Influenza virus
LLVLMENE

SEQ ID NO: 275630 - protein, 8 aa, Influenza virus
LVLMENER

SEQ ID NO: 275631 - protein, 8 aa, Influenza virus
VLMENERT

SEQ ID NO: 275632 - protein, 8 aa, Influenza virus
LMENERTL

SEQ ID NO: 275633 - protein, 8 aa, Influenza virus
MENERTLD

SEQ ID NO: 275634 - protein, 8 aa, Influenza virus
ENERTLDF

SEQ ID NO: 275635 - protein, 8 aa, Influenza virus
NERTLDFH

SEQ ID NO: 275636 - protein, 8 aa, Influenza virus
ERTLDFHD

SEQ ID NO: 275637 - protein, 8 aa, Influenza virus
RTLDFHDS

SEQ ID NO: 275638 - protein, 8 aa, Influenza virus
TLDFHDSN

SEQ ID NO: 275639 - protein, 8 aa, Influenza virus
LDFHDSNV

SEQ ID NO: 275640 - protein, 8 aa, Influenza virus
DFHDSNVK

SEQ ID NO: 275641 - protein, 8 aa, Influenza virus
FHDSNVKN

SEQ ID NO: 275642 - protein, 8 aa, Influenza virus
HDSNVKNL

SEQ ID NO: 275643 - protein, 8 aa, Influenza virus
DSNVKNLY

SEQ ID NO: 275644 - protein, 8 aa, Influenza virus
SNVKNLYD

SEQ ID NO: 275645 - protein, 8 aa, Influenza virus
NVKNLYDK

SEQ ID NO: 275646 - protein, 8 aa, Influenza virus
VKNLYDKV

SEQ ID NO: 275647 - protein, 8 aa, Influenza virus
KNLYDKVR

SEQ ID NO: 275648 - protein, 8 aa, Influenza virus
NLYDKVRL

SEQ ID NO: 275649 - protein, 8 aa, Influenza virus
LYDKVRLQ

SEQ ID NO: 275650 - protein, 8 aa, Influenza virus
YDKVRLQL

SEQ ID NO: 275651 - protein, 8 aa, Influenza virus
KVRLQLRD

SEQ ID NO: 275652 - protein, 8 aa, Influenza virus
VRLQLRDN

SEQ ID NO: 275653 - protein, 8 aa, Influenza virus
RLQLRDNA

SEQ ID NO: 275654 - protein, 8 aa, Influenza virus
LQLRDNAK

SEQ ID NO: 275655 - protein, 8 aa, Influenza virus
QLRDNAKE

SEQ ID NO: 275656 - protein, 8 aa, Influenza virus
LRDNAKEL

SEQ ID NO: 275657 - protein, 8 aa, Influenza virus
RDNAKELG

SEQ ID NO: 275658 - protein, 8 aa, Influenza virus
DNAKELGN

SEQ ID NO: 275659 - protein, 8 aa, Influenza virus
NAKELGNG

SEQ ID NO: 275660 - protein, 8 aa, Influenza virus
AKELGNGC

SEQ ID NO: 275661 - protein, 8 aa, Influenza virus
KELGNGCF

SEQ ID NO: 275662 - protein, 8 aa, Influenza virus
ELGNGCFE

SEQ ID NO: 275663 - protein, 8 aa, Influenza virus
LGNGCFEF

SEQ ID NO: 275664 - protein, 8 aa, Influenza virus
GNGCFEFY

SEQ ID NO: 275665 - protein, 8 aa, Influenza virus
NGCFEFYH

SEQ ID NO: 275666 - protein, 8 aa, Influenza virus
GCFEFYHK

SEQ ID NO: 275667 - protein, 8 aa, Influenza virus
CFEFYHKC

SEQ ID NO: 275668 - protein, 8 aa, Influenza virus
FEFYHKCD

SEQ ID NO: 275669 - protein, 8 aa, Influenza virus
EFYHKCDN

SEQ ID NO: 275670 - protein, 8 aa, Influenza virus
CMESVRNG

SEQ ID NO: 275671 - protein, 8 aa, Influenza virus
MESVRNGT

SEQ ID NO: 275672 - protein, 8 aa, Influenza virus
ESVRNGTY

SEQ ID NO: 275673 - protein, 8 aa, Influenza virus
TYQILSIY

SEQ ID NO: 275674 - protein, 8 aa, Influenza virus
YQILSIYS

SEQ ID NO: 275675 - protein, 8 aa, Influenza virus
QILSIYST

SEQ ID NO: 275676 - protein, 8 aa, Influenza virus
ILSIYSTV

SEQ ID NO: 275677 - protein, 8 aa, Influenza virus
LSIYSTVA

SEQ ID NO: 275678 - protein, 8 aa, Influenza virus
SIYSTVAS

SEQ ID NO: 275679 - protein, 8 aa, Influenza virus
IYSTVASS

SEQ ID NO: 275680 - protein, 8 aa, Influenza virus
YSTVASSL

SEQ ID NO: 275681 - protein, 8 aa, Influenza virus
ASSLALAI

SEQ ID NO: 275682 - protein, 8 aa, Influenza virus
EFPSTGNH

SEQ ID NO: 275683 - protein, 8 aa, Influenza virus
FPSTGNHG

SEQ ID NO: 275684 - protein, 8 aa, Influenza virus
PSTGNHGS

SEQ ID NO: 275685 - protein, 8 aa, Influenza virus
STGNHGSL

SEQ ID NO: 275686 - protein, 8 aa, Influenza virus
TGNHGSLV

SEQ ID NO: 275687 - protein, 8 aa, Influenza virus
GNHGSLVL

SEQ ID NO: 275688 - protein, 8 aa, Influenza virus
NHGSLVLS

SEQ ID NO: 275689 - protein, 8 aa, Influenza virus
HGSLVLSL

SEQ ID NO: 275690 - protein, 8 aa, Influenza virus
SSLALAIM

SEQ ID NO: 275691 - protein, 8 aa, Influenza virus
LAIMVAGL

SEQ ID NO: 275692 - protein, 8 aa, Influenza virus
AGLSLWMC

SEQ ID NO: 275693 - protein, 8 aa, Influenza virus
GLSLWMCS

SEQ ID NO: 275694 - protein, 8 aa, Influenza virus
LSLWMCSN

SEQ ID NO: 275695 - protein, 8 aa, Influenza virus
SLWMCSNG

SEQ ID NO: 275696 - protein, 8 aa, Influenza virus
LWMCSNGS

SEQ ID NO: 275697 - protein, 8 aa, Influenza virus
WMCSNGSL

SEQ ID NO: 275698 - protein, 8 aa, Influenza virus
MCSNGSLQ

SEQ ID NO: 275699 - protein, 8 aa, Influenza virus
CSNGSLQC

SEQ ID NO: 275700 - protein, 8 aa, Influenza virus
SNGSLQCR

SEQ ID NO: 275701 - protein, 8 aa, Influenza virus
NGSLQCRI

SEQ ID NO: 275702 - protein, 8 aa, Influenza virus
GSLQCRIC

SEQ ID NO: 275703 - protein, 8 aa, Influenza virus
SLQCRICI

SEQ ID NO: 275704 - protein, 8 aa, Influenza virus
AFKFVSSD

SEQ ID NO: 275705 - protein, 8 aa, Influenza virus
KFVSSDCS

SEQ ID NO: 275706 - protein, 8 aa, Influenza virus
FVNSDCSK

SEQ ID NO: 275707 - protein, 8 aa, Influenza virus
SVKMEKIV

SEQ ID NO: 275708 - protein, 8 aa, Influenza virus
VKMEKIVL

SEQ ID NO: 275709 - protein, 8 aa, Influenza virus
KMEKIVLL

SEQ ID NO: 275710 - protein, 8 aa, Influenza virus
SDQICIGY

SEQ ID NO: 275711 - protein, 8 aa, Influenza virus
DQICIGYH

SEQ ID NO: 275712 - protein, 8 aa, Influenza virus
QICIGYHA

SEQ ID NO: 275713 - protein, 8 aa, Influenza virus
ICIGYHAN

SEQ ID NO: 275714 - protein, 8 aa, Influenza virus
CIGYHANN

SEQ ID NO: 275715 - protein, 8 aa, Influenza virus
IGYHANNS

SEQ ID NO: 275716 - protein, 8 aa, Influenza virus
GYHANNST

SEQ ID NO: 275717 - protein, 8 aa, Influenza virus
YHANNSTE

SEQ ID NO: 275718 - protein, 8 aa, Influenza virus
HANNSTEQ

SEQ ID NO: 275719 - protein, 8 aa, Influenza virus
ANNSTEQV

SEQ ID NO: 275720 - protein, 8 aa, Influenza virus
NNSTEQVD

SEQ ID NO: 275721 - protein, 8 aa, Influenza virus
NSTEQVDT

SEQ ID NO: 275722 - protein, 8 aa, Influenza virus
STEQVDTI

SEQ ID NO: 275723 - protein, 8 aa, Influenza virus
TEQVDTIM

SEQ ID NO: 275724 - protein, 8 aa, Influenza virus
EQVDTIME

SEQ ID NO: 275725 - protein, 8 aa, Influenza virus
QVDTIMEK

SEQ ID NO: 275726 - protein, 8 aa, Influenza virus
VDTIMEKN

SEQ ID NO: 275727 - protein, 8 aa, Influenza virus
DTIMEKNV

SEQ ID NO: 275728 - protein, 8 aa, Influenza virus
TIMEKNVT

SEQ ID NO: 275729 - protein, 8 aa, Influenza virus
IMEKNVTV

SEQ ID NO: 275730 - protein, 8 aa, Influenza virus
MEKNVTVT

SEQ ID NO: 275731 - protein, 8 aa, Influenza virus
EKNVTVTH

SEQ ID NO: 275732 - protein, 8 aa, Influenza virus
KNVTVTHA

SEQ ID NO: 275733 - protein, 8 aa, Influenza virus
NVTVTHAQ

SEQ ID NO: 275734 - protein, 8 aa, Influenza virus
VTVTHAQD

SEQ ID NO: 275735 - protein, 8 aa, Influenza virus
TVTHAQDI

SEQ ID NO: 275736 - protein, 8 aa, Influenza virus
VTHAQDIL

SEQ ID NO: 275737 - protein, 8 aa, Influenza virus
THAQDILE

SEQ ID NO: 275738 - protein, 8 aa, Influenza virus
HAQDILEK

SEQ ID NO: 275739 - protein, 8 aa, Influenza virus
DILEKTHN

SEQ ID NO: 275740 - protein, 8 aa, Influenza virus
ILEKTHNG

SEQ ID NO: 275741 - protein, 8 aa, Influenza virus
HNGKLCDL

SEQ ID NO: 275742 - protein, 8 aa, Influenza virus
LDGVKPLI

SEQ ID NO: 275743 - protein, 8 aa, Influenza virus
DGVKPLIL

SEQ ID NO: 275744 - protein, 8 aa, Influenza virus
GVKPLILR

SEQ ID NO: 275745 - protein, 8 aa, Influenza virus
VKPLILRD

SEQ ID NO: 275746 - protein, 8 aa, Influenza virus
KPLILRDC

SEQ ID NO: 275747 - protein, 8 aa, Influenza virus
PLILRDCS

SEQ ID NO: 275748 - protein, 8 aa, Influenza virus
LILRDCSV

SEQ ID NO: 275749 - protein, 8 aa, Influenza virus
ILRDCSVA

SEQ ID NO: 275750 - protein, 8 aa, Influenza virus
LRDCSVAG

SEQ ID NO: 275751 - protein, 8 aa, Influenza virus
RDCSVAGW

SEQ ID NO: 275752 - protein, 8 aa, Influenza virus
DCSVAGWL

SEQ ID NO: 275753 - protein, 8 aa, Influenza virus
CSVAGWLL

SEQ ID NO: 275754 - protein, 8 aa, Influenza virus
SVAGWLLG

SEQ ID NO: 275755 - protein, 8 aa, Influenza virus
VAGWLLGN

SEQ ID NO: 275756 - protein, 8 aa, Influenza virus
AGWLLGNP

SEQ ID NO: 275757 - protein, 8 aa, Influenza virus
GWLLGNPM

SEQ ID NO: 275758 - protein, 8 aa, Influenza virus
WLLGNPMC

SEQ ID NO: 275759 - protein, 8 aa, Influenza virus
LLGNPMCD

SEQ ID NO: 275760 - protein, 8 aa, Influenza virus
LGNPMCDE

SEQ ID NO: 275761 - protein, 8 aa, Influenza virus
GNPMCDEF

SEQ ID NO: 275762 - protein, 8 aa, Influenza virus
NVPEWSYI

SEQ ID NO: 275763 - protein, 8 aa, Influenza virus
VPEWSYIV

SEQ ID NO: 275764 - protein, 8 aa, Influenza virus
PEWSYIVE

SEQ ID NO: 275765 - protein, 8 aa, Influenza virus
EWSYIVEK

SEQ ID NO: 275766 - protein, 8 aa, Influenza virus
WSYIVEKA

SEQ ID NO: 275767 - protein, 8 aa, Influenza virus
FNDYEELK

SEQ ID NO: 275768 - protein, 8 aa, Influenza virus
NDYEELKH

SEQ ID NO: 275769 - protein, 8 aa, Influenza virus
DYEELKHL

SEQ ID NO: 275770 - protein, 8 aa, Influenza virus
YEELKHLL

SEQ ID NO: 275771 - protein, 8 aa, Influenza virus
EELKHLLS

SEQ ID NO: 275772 - protein, 8 aa, Influenza virus
ELKHLLSR

SEQ ID NO: 275773 - protein, 8 aa, Influenza virus
LKHLLSRI

SEQ ID NO: 275774 - protein, 8 aa, Influenza virus
KHLLSRIN

SEQ ID NO: 275775 - protein, 8 aa, Influenza virus
ADHPPKVA

SEQ ID NO: 275776 - protein, 8 aa, Influenza virus
SFFRNVVW

SEQ ID NO: 275777 - protein, 8 aa, Influenza virus
FFRNVVWL

SEQ ID NO: 275778 - protein, 8 aa, Influenza virus
EDLLVLWG

SEQ ID NO: 275779 - protein, 8 aa, Influenza virus
LLVLWGIH

SEQ ID NO: 275780 - protein, 8 aa, Influenza virus
LVLWGIHH

SEQ ID NO: 275781 - protein, 8 aa, Influenza virus
LWGIHHPN

SEQ ID NO: 275782 - protein, 8 aa, Influenza virus
WGIHHPND

SEQ ID NO: 275783 - protein, 8 aa, Influenza virus
TYISVGTS

SEQ ID NO: 275784 - protein, 8 aa, Influenza virus
YISVGTST

SEQ ID NO: 275785 - protein, 8 aa, Influenza virus
ISVGTSTL

SEQ ID NO: 275786 - protein, 8 aa, Influenza virus
SVGTSTLN

SEQ ID NO: 275787 - protein, 8 aa, Influenza virus
VGTSTLNQ

SEQ ID NO: 275788 - protein, 8 aa, Influenza virus
GTSTLNQR

SEQ ID NO: 275789 - protein, 8 aa, Influenza virus
TSTLNQRL

SEQ ID NO: 275790 - protein, 8 aa, Influenza virus
KVNGQSGR

SEQ ID NO: 275791 - protein, 8 aa, Influenza virus
INFESNGN

SEQ ID NO: 275792 - protein, 8 aa, Influenza virus
NFESNGNF

SEQ ID NO: 275793 - protein, 8 aa, Influenza virus
FESNGNFI

SEQ ID NO: 275794 - protein, 8 aa, Influenza virus
ESNGNFIA

SEQ ID NO: 275795 - protein, 8 aa, Influenza virus
SNGNFIAP

SEQ ID NO: 275796 - protein, 8 aa, Influenza virus
NGNFIAPE

SEQ ID NO: 275797 - protein, 8 aa, Influenza virus
GNFIAPEY

SEQ ID NO: 275798 - protein, 8 aa, Influenza virus
NFIAPEYA

SEQ ID NO: 275799 - protein, 8 aa, Influenza virus
FIAPEYAY

SEQ ID NO: 275800 - protein, 8 aa, Influenza virus
IAPEYAYK

SEQ ID NO: 275801 - protein, 8 aa, Influenza virus
APEYAYKI

SEQ ID NO: 275802 - protein, 8 aa, Influenza virus
PEYAYKIV

SEQ ID NO: 275803 - protein, 8 aa, Influenza virus
EYAYKIVK

SEQ ID NO: 275804 - protein, 8 aa, Influenza virus
YAYKIVKK

SEQ ID NO: 275805 - protein, 8 aa, Influenza virus
AYKIVKKG

SEQ ID NO: 275806 - protein, 8 aa, Influenza virus
YKIVKKGD

SEQ ID NO: 275807 - protein, 8 aa, Influenza virus
KIVKKGDS

SEQ ID NO: 275808 - protein, 8 aa, Influenza virus
CNTKCQTP

SEQ ID NO: 275809 - protein, 8 aa, Influenza virus
PSVKLPMG

SEQ ID NO: 275810 - protein, 8 aa, Influenza virus
CQTPIGAI

SEQ ID NO: 275811 - protein, 8 aa, Influenza virus
QTPIGAIN

SEQ ID NO: 275812 - protein, 8 aa, Influenza virus
TPIGAINS

SEQ ID NO: 275813 - protein, 8 aa, Influenza virus
PIGAINSS

SEQ ID NO: 275814 - protein, 8 aa, Influenza virus
IGAINSSM

SEQ ID NO: 275815 - protein, 8 aa, Influenza virus
GAIGAIDS

SEQ ID NO: 275816 - protein, 8 aa, Influenza virus
AIGAIDSS

SEQ ID NO: 275817 - protein, 8 aa, Influenza virus
IGAIDSSM

SEQ ID NO: 275818 - protein, 8 aa, Influenza virus
GAINSSMP

SEQ ID NO: 275819 - protein, 8 aa, Influenza virus
AINSSMPF

SEQ ID NO: 275820 - protein, 8 aa, Influenza virus
INSSMPFH

SEQ ID NO: 275821 - protein, 8 aa, Influenza virus
NSSMPFHN

SEQ ID NO: 275822 - protein, 8 aa, Influenza virus
SSMPFHNI

SEQ ID NO: 275823 - protein, 8 aa, Influenza virus
SMPFHNIH

SEQ ID NO: 275824 - protein, 8 aa, Influenza virus
MPFHNIHP

SEQ ID NO: 275825 - protein, 8 aa, Influenza virus
PFHNIHPL

SEQ ID NO: 275826 - protein, 8 aa, Influenza virus
FHNIHPLT

SEQ ID NO: 275827 - protein, 8 aa, Influenza virus
HNIHPLTI

SEQ ID NO: 275828 - protein, 8 aa, Influenza virus
NIHPLTIG

SEQ ID NO: 275829 - protein, 8 aa, Influenza virus
IHPLTIGE

SEQ ID NO: 275830 - protein, 8 aa, Influenza virus
HPLTIGEC

SEQ ID NO: 275831 - protein, 8 aa, Influenza virus
PLTIGECP

SEQ ID NO: 275832 - protein, 8 aa, Influenza virus
LTIGECPK

SEQ ID NO: 275833 - protein, 8 aa, Influenza virus
TIGECPKY

SEQ ID NO: 275834 - protein, 8 aa, Influenza virus
IGECPKYV

SEQ ID NO: 275835 - protein, 8 aa, Influenza virus
GECPKYVK

SEQ ID NO: 275836 - protein, 8 aa, Influenza virus
ECPKYVKS

SEQ ID NO: 275837 - protein, 8 aa, Influenza virus
CPKYVKSN

SEQ ID NO: 275838 - protein, 8 aa, Influenza virus
RLVLATGL

SEQ ID NO: 275839 - protein, 8 aa, Influenza virus
LVLATGLR

SEQ ID NO: 275840 - protein, 8 aa, Influenza virus
VLATGLRN

SEQ ID NO: 275841 - protein, 8 aa, Influenza virus
LATGLRNS

SEQ ID NO: 275842 - protein, 8 aa, Influenza virus
REREGGRR

SEQ ID NO: 275843 - protein, 8 aa, Influenza virus
EREGGRRR

SEQ ID NO: 275844 - protein, 8 aa, Influenza virus
RKKRGLFG

SEQ ID NO: 275845 - protein, 8 aa, Influenza virus
KKRGLFGA

SEQ ID NO: 275846 - protein, 8 aa, Influenza virus
KKRGLFGA

SEQ ID NO: 275847 - protein, 8 aa, Influenza virus
KRGLFGAI

SEQ ID NO: 275848 - protein, 8 aa, Influenza virus
RGLFGAIA

SEQ ID NO: 275849 - protein, 8 aa, Influenza virus
GLFGAIAG

SEQ ID NO: 275850 - protein, 8 aa, Influenza virus
LFGAIAGF

SEQ ID NO: 275851 - protein, 8 aa, Influenza virus
FGAIAGFI

SEQ ID NO: 275852 - protein, 8 aa, Influenza virus
GAIAGFIE

SEQ ID NO: 275853 - protein, 8 aa, Influenza virus
AIAGFIEG

SEQ ID NO: 275854 - protein, 8 aa, Influenza virus
IAGFIEGG

SEQ ID NO: 275855 - protein, 8 aa, Influenza virus
AGFIEGGW

SEQ ID NO: 275856 - protein, 8 aa, Influenza virus
GFIEGGWQ

SEQ ID NO: 275857 - protein, 8 aa, Influenza virus
FIEGGWQG

SEQ ID NO: 275858 - protein, 8 aa, Influenza virus
IEGGWQGM

SEQ ID NO: 275859 - protein, 8 aa, Influenza virus
EGGWQGMV

SEQ ID NO: 275860 - protein, 8 aa, Influenza virus
GGWQGMVD

SEQ ID NO: 275861 - protein, 8 aa, Influenza virus
GWQGMVDG

SEQ ID NO: 275862 - protein, 8 aa, Influenza virus
WQGMVDGW

SEQ ID NO: 275863 - protein, 8 aa, Influenza virus
QGMVDGWY

SEQ ID NO: 275864 - protein, 8 aa, Influenza virus
GMVDGWYG

SEQ ID NO: 275865 - protein, 8 aa, Influenza virus
MVDGWYGY

SEQ ID NO: 275866 - protein, 8 aa, Influenza virus
VDGWYGYH

SEQ ID NO: 275867 - protein, 8 aa, Influenza virus
DGWYGYHH

SEQ ID NO: 275868 - protein, 8 aa, Influenza virus
GWYGYHHS

SEQ ID NO: 275869 - protein, 8 aa, Influenza virus
WYGYHHSN

SEQ ID NO: 275870 - protein, 8 aa, Influenza virus
YGYHHSNE

SEQ ID NO: 275871 - protein, 8 aa, Influenza virus
GYHHSNEQ

SEQ ID NO: 275872 - protein, 8 aa, Influenza virus
YHHSNEQG

SEQ ID NO: 275873 - protein, 8 aa, Influenza virus
HHSNEQGS

SEQ ID NO: 275874 - protein, 8 aa, Influenza virus
HSNEQGSG

SEQ ID NO: 275875 - protein, 8 aa, Influenza virus
SNEQGSGY

SEQ ID NO: 275876 - protein, 8 aa, Influenza virus
NEQGSGYA

SEQ ID NO: 275877 - protein, 8 aa, Influenza virus
EQGSGYAA

SEQ ID NO: 275878 - protein, 8 aa, Influenza virus
QGSGYAAD

SEQ ID NO: 275879 - protein, 8 aa, Influenza virus
GSGYAADK

SEQ ID NO: 275880 - protein, 8 aa, Influenza virus
SGYAADKE

SEQ ID NO: 275881 - protein, 8 aa, Influenza virus
GYAADKES

SEQ ID NO: 275882 - protein, 8 aa, Influenza virus
YAADKEST

SEQ ID NO: 275883 - protein, 8 aa, Influenza virus
AADKESTQ

SEQ ID NO: 275884 - protein, 8 aa, Influenza virus
ADKESTQK

SEQ ID NO: 275885 - protein, 8 aa, Influenza virus
DKESTQKA

SEQ ID NO: 275886 - protein, 8 aa, Influenza virus
KESTQKAI

SEQ ID NO: 275887 - protein, 8 aa, Influenza virus
ESTQKAID

SEQ ID NO: 275888 - protein, 8 aa, Influenza virus
STQKAIDG

SEQ ID NO: 275889 - protein, 8 aa, Influenza virus
TQKAIDGV

SEQ ID NO: 275890 - protein, 8 aa, Influenza virus
QKAIDGVT

SEQ ID NO: 275891 - protein, 8 aa, Influenza virus
KAIDGVTN

SEQ ID NO: 275892 - protein, 8 aa, Influenza virus
AIDGVTNK

SEQ ID NO: 275893 - protein, 8 aa, Influenza virus
IDGVTNKV

SEQ ID NO: 275894 - protein, 8 aa, Influenza virus
DGVTNKVN

SEQ ID NO: 275895 - protein, 8 aa, Influenza virus
GVTNKVNS

SEQ ID NO: 275896 - protein, 8 aa, Influenza virus
VTNKVNSI

SEQ ID NO: 275897 - protein, 8 aa, Influenza virus
TNKVNSII

SEQ ID NO: 275898 - protein, 8 aa, Influenza virus
NKVNSIID

SEQ ID NO: 275899 - protein, 8 aa, Influenza virus
KVNSIIDK

SEQ ID NO: 275900 - protein, 8 aa, Influenza virus
VNSIIDKM

SEQ ID NO: 275901 - protein, 8 aa, Influenza virus
NSIIDKMN

SEQ ID NO: 275902 - protein, 8 aa, Influenza virus
SIIDKMNT

SEQ ID NO: 275903 - protein, 8 aa, Influenza virus
IIDKMNTQ

SEQ ID NO: 275904 - protein, 8 aa, Influenza virus
IDKMNTQF

SEQ ID NO: 275905 - protein, 8 aa, Influenza virus
DKMNTQFE

SEQ ID NO: 275906 - protein, 8 aa, Influenza virus
KMNTQFEA

SEQ ID NO: 275907 - protein, 8 aa, Influenza virus
MNTQFEAV

SEQ ID NO: 275908 - protein, 8 aa, Influenza virus
NTQFEAVG

SEQ ID NO: 275909 - protein, 8 aa, Influenza virus
TQFEAVGR

SEQ ID NO: 275910 - protein, 8 aa, Influenza virus
QFEAVGRE

SEQ ID NO: 275911 - protein, 8 aa, Influenza virus
FEAVGREF

SEQ ID NO: 275912 - protein, 8 aa, Influenza virus
EAVGREFN

SEQ ID NO: 275913 - protein, 8 aa, Influenza virus
EFNNLERR

SEQ ID NO: 275914 - protein, 8 aa, Influenza virus
LERRIENL

SEQ ID NO: 275915 - protein, 8 aa, Influenza virus
ERRIENLN

SEQ ID NO: 275916 - protein, 8 aa, Influenza virus
RRIENLNK

SEQ ID NO: 275917 - protein, 8 aa, Influenza virus
RIENLNKK

SEQ ID NO: 275918 - protein, 8 aa, Influenza virus
IENLNKKM

SEQ ID NO: 275919 - protein, 8 aa, Influenza virus
ENLNKKME

SEQ ID NO: 275920 - protein, 8 aa, Influenza virus
NLNKKMED

SEQ ID NO: 275921 - protein, 8 aa, Influenza virus
LNKKMEDG

SEQ ID NO: 275922 - protein, 8 aa, Influenza virus
NKKMEDGF

SEQ ID NO: 275923 - protein, 8 aa, Influenza virus
KKMEDGFL

SEQ ID NO: 275924 - protein, 8 aa, Influenza virus
KMEDGFLD

SEQ ID NO: 275925 - protein, 8 aa, Influenza virus
MEDGFLDV

SEQ ID NO: 275926 - protein, 8 aa, Influenza virus
EDGFLDVW

SEQ ID NO: 275927 - protein, 8 aa, Influenza virus
DGFLDVWT

SEQ ID NO: 275928 - protein, 8 aa, Influenza virus
GFLDVWTY

SEQ ID NO: 275929 - protein, 8 aa, Influenza virus
FLDVWTYN

SEQ ID NO: 275930 - protein, 8 aa, Influenza virus
LDVWTYNA

SEQ ID NO: 275931 - protein, 8 aa, Influenza virus
DVWTYNAE

SEQ ID NO: 275932 - protein, 8 aa, Influenza virus
VWTYNAEL

SEQ ID NO: 275933 - protein, 8 aa, Influenza virus
WTYNAELL

SEQ ID NO: 275934 - protein, 8 aa, Influenza virus
TYNAELLV

SEQ ID NO: 275935 - protein, 8 aa, Influenza virus
YNAELLVL

SEQ ID NO: 275936 - protein, 8 aa, Influenza virus
NAELLVLM

SEQ ID NO: 275937 - protein, 8 aa, Influenza virus
AELLVLME

SEQ ID NO: 275938 - protein, 8 aa, Influenza virus
ELLVLMEN

SEQ ID NO: 275939 - protein, 8 aa, Influenza virus
LLVLMENE

SEQ ID NO: 275940 - protein, 8 aa, Influenza virus
LVLMENER

SEQ ID NO: 275941 - protein, 8 aa, Influenza virus
VLMENERT

SEQ ID NO: 275942 - protein, 8 aa, Influenza virus
LMENERTL

SEQ ID NO: 275943 - protein, 8 aa, Influenza virus
MENERTLD

SEQ ID NO: 275944 - protein, 8 aa, Influenza virus
ENERTLDF

SEQ ID NO: 275945 - protein, 8 aa, Influenza virus
NERTLDFH

SEQ ID NO: 275946 - protein, 8 aa, Influenza virus
ERTLDFHD

SEQ ID NO: 275947 - protein, 8 aa, Influenza virus
RTLDFHDS

SEQ ID NO: 275948 - protein, 8 aa, Influenza virus
TLDFHDSN

SEQ ID NO: 275949 - protein, 8 aa, Influenza virus
LDFHDSNV

SEQ ID NO: 275950 - protein, 8 aa, Influenza virus
DFHDSNVK

SEQ ID NO: 275951 - protein, 8 aa, Influenza virus
FHDSNVKN

SEQ ID NO: 275952 - protein, 8 aa, Influenza virus
HDSNVKNL

SEQ ID NO: 275953 - protein, 8 aa, Influenza virus
DSNVKNLY

SEQ ID NO: 275954 - protein, 8 aa, Influenza virus
SNVKNLYD

SEQ ID NO: 275955 - protein, 8 aa, Influenza virus
NVKNLYDK

SEQ ID NO: 275956 - protein, 8 aa, Influenza virus
VKNLYDKV

SEQ ID NO: 275957 - protein, 8 aa, Influenza virus
KNLYDKVR

SEQ ID NO: 275958 - protein, 8 aa, Influenza virus
NLYDKVRL

SEQ ID NO: 275959 - protein, 8 aa, Influenza virus
LYDKVRLQ

SEQ ID NO: 275960 - protein, 8 aa, Influenza virus
YDKVRLQL

SEQ ID NO: 275961 - protein, 8 aa, Influenza virus
DKVRLQLR

SEQ ID NO: 275962 - protein, 8 aa, Influenza virus
KVRLQLRD

SEQ ID NO: 275963 - protein, 8 aa, Influenza virus
VRLQLRDN

SEQ ID NO: 275964 - protein, 8 aa, Influenza virus
RLQLRDNA

SEQ ID NO: 275965 - protein, 8 aa, Influenza virus
LQLRDNAK

SEQ ID NO: 275966 - protein, 8 aa, Influenza virus
QLRDNAKE

SEQ ID NO: 275967 - protein, 8 aa, Influenza virus
LRDNAKEL

SEQ ID NO: 275968 - protein, 8 aa, Influenza virus
RDNAKELG

SEQ ID NO: 275969 - protein, 8 aa, Influenza virus
DNAKELGN

SEQ ID NO: 275970 - protein, 8 aa, Influenza virus
NAKELGNG

SEQ ID NO: 275971 - protein, 8 aa, Influenza virus
AKELGNGC

SEQ ID NO: 275972 - protein, 8 aa, Influenza virus
KELGNGCF

SEQ ID NO: 275973 - protein, 8 aa, Influenza virus
ELGNGCFE

SEQ ID NO: 275974 - protein, 8 aa, Influenza virus
LGNGCFEF

SEQ ID NO: 275975 - protein, 8 aa, Influenza virus
GNGCFEFY

SEQ ID NO: 275976 - protein, 8 aa, Influenza virus
NGCFEFYH

SEQ ID NO: 275977 - protein, 8 aa, Influenza virus
GCFEFYHK

SEQ ID NO: 275978 - protein, 8 aa, Influenza virus
CFEFYHKC

SEQ ID NO: 275979 - protein, 8 aa, Influenza virus
FEFYHKCD

SEQ ID NO: 275980 - protein, 8 aa, Influenza virus
EFYHKCDN

SEQ ID NO: 275981 - protein, 8 aa, Influenza virus
CMESVRNG

SEQ ID NO: 275982 - protein, 8 aa, Influenza virus
MESVRNGT

SEQ ID NO: 275983 - protein, 8 aa, Influenza virus
ESVRNGTY

SEQ ID NO: 275984 - protein, 8 aa, Influenza virus
SVRNGTYD

SEQ ID NO: 275985 - protein, 8 aa, Influenza virus
VRNGTYDY

SEQ ID NO: 275986 - protein, 8 aa, Influenza virus
RNGTYDYP

SEQ ID NO: 275987 - protein, 8 aa, Influenza virus
NGTYDYPQ

SEQ ID NO: 275988 - protein, 8 aa, Influenza virus
GTYDYPQY

SEQ ID NO: 275989 - protein, 8 aa, Influenza virus
GTYQILSI

SEQ ID NO: 275990 - protein, 8 aa, Influenza virus
TYQILSIY

SEQ ID NO: 275991 - protein, 8 aa, Influenza virus
YQILSIYS

SEQ ID NO: 275992 - protein, 8 aa, Influenza virus
QILSIYST

SEQ ID NO: 275993 - protein, 8 aa, Influenza virus
ILSIYSTV

SEQ ID NO: 275994 - protein, 8 aa, Influenza virus
LSIYSTVA

SEQ ID NO: 275995 - protein, 8 aa, Influenza virus
SIYSTVAS

SEQ ID NO: 275996 - protein, 8 aa, Influenza virus
IYSTVASS

SEQ ID NO: 275997 - protein, 8 aa, Influenza virus
YSTVASSL

SEQ ID NO: 275998 - protein, 8 aa, Influenza virus
STVASSLA

SEQ ID NO: 275999 - protein, 8 aa, Influenza virus
TVASSLAL

SEQ ID NO: 276000 - protein, 8 aa, Influenza virus
VASSLALA

SEQ ID NO: 276001 - protein, 8 aa, Influenza virus
ASSLALAI

SEQ ID NO: 276002 - protein, 8 aa, Influenza virus
EFPSTGNH

SEQ ID NO: 276003 - protein, 8 aa, Influenza virus
FPSTGNHG

SEQ ID NO: 276004 - protein, 8 aa, Influenza virus
PSTGNHGS

SEQ ID NO: 276005 - protein, 8 aa, Influenza virus
STGNHGSL

SEQ ID NO: 276006 - protein, 8 aa, Influenza virus
TGNHGSLV

SEQ ID NO: 276007 - protein, 8 aa, Influenza virus
GNHGSLVL

SEQ ID NO: 276008 - protein, 8 aa, Influenza virus
NHGSLVLS

SEQ ID NO: 276009 - protein, 8 aa, Influenza virus
HGSLVLSL

SEQ ID NO: 276010 - protein, 8 aa, Influenza virus
SSLALAIM

SEQ ID NO: 276011 - protein, 8 aa, Influenza virus
LAIMVAGL

SEQ ID NO: 276012 - protein, 8 aa, Influenza virus
AGLSLWMC

SEQ ID NO: 276013 - protein, 8 aa, Influenza virus
GLSLWMCS

SEQ ID NO: 276014 - protein, 8 aa, Influenza virus
LSLWMCSN

SEQ ID NO: 276015 - protein, 8 aa, Influenza virus
SLWMCSNG

SEQ ID NO: 276016 - protein, 8 aa, Influenza virus
LWMCSNGS

SEQ ID NO: 276017 - protein, 8 aa, Influenza virus
WMCSNGSL

SEQ ID NO: 276018 - protein, 8 aa, Influenza virus
MCSNGSLQ

SEQ ID NO: 276019 - protein, 8 aa, Influenza virus
CSNGSLQC

SEQ ID NO: 276020 - protein, 8 aa, Influenza virus
SNGSLQCR

SEQ ID NO: 276021 - protein, 8 aa, Influenza virus
NGSLQCRI

SEQ ID NO: 276022 - protein, 8 aa, Influenza virus
GSLQCRIC

SEQ ID NO: 276023 - protein, 8 aa, Influenza virus
SLQCRICI

SEQ ID NO: 276024 - protein, 8 aa, Influenza virus
AFKFVSSD

SEQ ID NO: 276025 - protein, 8 aa, Influenza virus
KFVSSDCS

SEQ ID NO: 276026 - protein, 8 aa, Influenza virus
FVNSDCSK

SEQ ID NO: 276027 - protein, 8 aa, Influenza virus
LVFREQKQ

SEQ ID NO: 276028 - protein, 8 aa, Influenza virus
GLREQKQE

SEQ ID NO: 276029 - protein, 8 aa, Influenza virus
LREQKQEF

SEQ ID NO: 276030 - protein, 8 aa, Influenza virus
REQKQEFK

SEQ ID NO: 276031 - protein, 8 aa, Influenza virus
EQKQEFKM

SEQ ID NO: 276032 - protein, 8 aa, Influenza virus
QKQEFKMN

SEQ ID NO: 276033 - protein, 8 aa, Influenza virus
KQEFKMNP

SEQ ID NO: 276034 - protein, 8 aa, Influenza virus
QEFKMNPN

SEQ ID NO: 276035 - protein, 8 aa, Influenza virus
EFKMNPNK

SEQ ID NO: 276036 - protein, 8 aa, Influenza virus
FKMNPNKK

SEQ ID NO: 276037 - protein, 8 aa, Influenza virus
KMNPNKKI

SEQ ID NO: 276038 - protein, 8 aa, Influenza virus
NRDITIGS

SEQ ID NO: 276039 - protein, 8 aa, Influenza virus
RDITIGSI

SEQ ID NO: 276040 - protein, 8 aa, Influenza virus
DITIGSIC

SEQ ID NO: 276041 - protein, 8 aa, Influenza virus
NLDLNMGQ

SEQ ID NO: 276042 - protein, 8 aa, Influenza virus
LDLNMGQP

SEQ ID NO: 276043 - protein, 8 aa, Influenza virus
DLNMGQPF

SEQ ID NO: 276044 - protein, 8 aa, Influenza virus
LNMGQPFY

SEQ ID NO: 276045 - protein, 8 aa, Influenza virus
GPSHSIHT

SEQ ID NO: 276046 - protein, 8 aa, Influenza virus
ITYENNTW

SEQ ID NO: 276047 - protein, 8 aa, Influenza virus
YENNTWVN

SEQ ID NO: 276048 - protein, 8 aa, Influenza virus
ENNTWVNQ

SEQ ID NO: 276049 - protein, 8 aa, Influenza virus
NNTWVNQT

SEQ ID NO: 276050 - protein, 8 aa, Influenza virus
NTWVNQTY

SEQ ID NO: 276051 - protein, 8 aa, Influenza virus
TWVNQTYV

SEQ ID NO: 276052 - protein, 8 aa, Influenza virus
GNSSLCPI

SEQ ID NO: 276053 - protein, 8 aa, Influenza virus
GWAVYSKD

SEQ ID NO: 276054 - protein, 8 aa, Influenza virus
WAVYSKDN

SEQ ID NO: 276055 - protein, 8 aa, Influenza virus
YSKDNSIR

SEQ ID NO: 276056 - protein, 8 aa, Influenza virus
SKDNSIRI

SEQ ID NO: 276057 - protein, 8 aa, Influenza virus
KDNSIRIG

SEQ ID NO: 276058 - protein, 8 aa, Influenza virus
DNSIRIGS

SEQ ID NO: 276059 - protein, 8 aa, Influenza virus
NSIRIGSK

SEQ ID NO: 276060 - protein, 8 aa, Influenza virus
SIRIGSKG

SEQ ID NO: 276061 - protein, 8 aa, Influenza virus
IRIGSKGD

SEQ ID NO: 276062 - protein, 8 aa, Influenza virus
RIGSKGDV

SEQ ID NO: 276063 - protein, 8 aa, Influenza virus
IGSKGDVF

SEQ ID NO: 276064 - protein, 8 aa, Influenza virus
GSKGDVFV

SEQ ID NO: 276065 - protein, 8 aa, Influenza virus
GDVFVIRE

SEQ ID NO: 276066 - protein, 8 aa, Influenza virus
DVFVIREP

SEQ ID NO: 276067 - protein, 8 aa, Influenza virus
VFVIREPF

SEQ ID NO: 276068 - protein, 8 aa, Influenza virus
FVIREPFI

SEQ ID NO: 276069 - protein, 8 aa, Influenza virus
VIREPFIS

SEQ ID NO: 276070 - protein, 8 aa, Influenza virus
IREPFISC

SEQ ID NO: 276071 - protein, 8 aa, Influenza virus
REPFISCS

SEQ ID NO: 276072 - protein, 8 aa, Influenza virus
EPFISCSH

SEQ ID NO: 276073 - protein, 8 aa, Influenza virus
PFISCSHL

SEQ ID NO: 276074 - protein, 8 aa, Influenza virus
FISCSHLE

SEQ ID NO: 276075 - protein, 8 aa, Influenza virus
ISCSHLEC

SEQ ID NO: 276076 - protein, 8 aa, Influenza virus
SCSHLECR

SEQ ID NO: 276077 - protein, 8 aa, Influenza virus
CSHLECRT

SEQ ID NO: 276078 - protein, 8 aa, Influenza virus
SHLECRTF

SEQ ID NO: 276079 - protein, 8 aa, Influenza virus
HLECRTFF

SEQ ID NO: 276080 - protein, 8 aa, Influenza virus
LECRTFFL

SEQ ID NO: 276081 - protein, 8 aa, Influenza virus
ECRTFFLT

SEQ ID NO: 276082 - protein, 8 aa, Influenza virus
CRTFFLTQ

SEQ ID NO: 276083 - protein, 8 aa, Influenza virus
RTFFLTQG

SEQ ID NO: 276084 - protein, 8 aa, Influenza virus
TFFLTQGA

SEQ ID NO: 276085 - protein, 8 aa, Influenza virus
FFLTQGAL

SEQ ID NO: 276086 - protein, 8 aa, Influenza virus
FLTQGALL

SEQ ID NO: 276087 - protein, 8 aa, Influenza virus
LTQGALLN

SEQ ID NO: 276088 - protein, 8 aa, Influenza virus
TQGALLND

SEQ ID NO: 276089 - protein, 8 aa, Influenza virus
QGALLNDK

SEQ ID NO: 276090 - protein, 8 aa, Influenza virus
GALLNDKH

SEQ ID NO: 276091 - protein, 8 aa, Influenza virus
ALLNDKHS

SEQ ID NO: 276092 - protein, 8 aa, Influenza virus
LLNDKHSN

SEQ ID NO: 276093 - protein, 8 aa, Influenza virus
LNDKHSNG

SEQ ID NO: 276094 - protein, 8 aa, Influenza virus
NDKHSNGT

SEQ ID NO: 276095 - protein, 8 aa, Influenza virus
DKHSNGTV

SEQ ID NO: 276096 - protein, 8 aa, Influenza virus
KHSNGTVK

SEQ ID NO: 276097 - protein, 8 aa, Influenza virus
HSNGTVKD

SEQ ID NO: 276098 - protein, 8 aa, Influenza virus
SNGTVKDR

SEQ ID NO: 276099 - protein, 8 aa, Influenza virus
NGTVKDRS

SEQ ID NO: 276100 - protein, 8 aa, Influenza virus
GTVKDRSP

SEQ ID NO: 276101 - protein, 8 aa, Influenza virus
VKDRSPHR

SEQ ID NO: 276102 - protein, 8 aa, Influenza virus
KDRSPHRT

SEQ ID NO: 276103 - protein, 8 aa, Influenza virus
DRSPHRTL

SEQ ID NO: 276104 - protein, 8 aa, Influenza virus
RSPHRTLM

SEQ ID NO: 276105 - protein, 8 aa, Influenza virus
SPHRTLMS

SEQ ID NO: 276106 - protein, 8 aa, Influenza virus
PHRTLMSC

SEQ ID NO: 276107 - protein, 8 aa, Influenza virus
HRTLMSCP

SEQ ID NO: 276108 - protein, 8 aa, Influenza virus
RTLMSCPV

SEQ ID NO: 276109 - protein, 8 aa, Influenza virus
TLMSCPVG

SEQ ID NO: 276110 - protein, 8 aa, Influenza virus
LMSCPVGE

SEQ ID NO: 276111 - protein, 8 aa, Influenza virus
PVGEAPSP

SEQ ID NO: 276112 - protein, 8 aa, Influenza virus
VGEAPSPY

SEQ ID NO: 276113 - protein, 8 aa, Influenza virus
GEAPSPYN

SEQ ID NO: 276114 - protein, 8 aa, Influenza virus
EAPSPYNS

SEQ ID NO: 276115 - protein, 8 aa, Influenza virus
APSPYNSR

SEQ ID NO: 276116 - protein, 8 aa, Influenza virus
PSPYNSRF

SEQ ID NO: 276117 - protein, 8 aa, Influenza virus
SPYNSRFE

SEQ ID NO: 276118 - protein, 8 aa, Influenza virus
PYNSRFES

SEQ ID NO: 276119 - protein, 8 aa, Influenza virus
YNSRFESV

SEQ ID NO: 276120 - protein, 8 aa, Influenza virus
NSRFESVA

SEQ ID NO: 276121 - protein, 8 aa, Influenza virus
SRFESVAW

SEQ ID NO: 276122 - protein, 8 aa, Influenza virus
RFESVAWS

SEQ ID NO: 276123 - protein, 8 aa, Influenza virus
FESVAWSA

SEQ ID NO: 276124 - protein, 8 aa, Influenza virus
ESVAWSAS

SEQ ID NO: 276125 - protein, 8 aa, Influenza virus
SVAWSASA

SEQ ID NO: 276126 - protein, 8 aa, Influenza virus
VAWSASAC

SEQ ID NO: 276127 - protein, 8 aa, Influenza virus
AWSASACH

SEQ ID NO: 276128 - protein, 8 aa, Influenza virus
WSASACHD

SEQ ID NO: 276129 - protein, 8 aa, Influenza virus
SASACHDG

SEQ ID NO: 276130 - protein, 8 aa, Influenza virus
ASACHDGT

SEQ ID NO: 276131 - protein, 8 aa, Influenza virus
SACHDGTS

SEQ ID NO: 276132 - protein, 8 aa, Influenza virus
ACHDGTSW

SEQ ID NO: 276133 - protein, 8 aa, Influenza virus
CHDGTSWL

SEQ ID NO: 276134 - protein, 8 aa, Influenza virus
HDGTSWLT

SEQ ID NO: 276135 - protein, 8 aa, Influenza virus
DGTSWLTI

SEQ ID NO: 276136 - protein, 8 aa, Influenza virus
SWLTIGIS

SEQ ID NO: 276137 - protein, 8 aa, Influenza virus
WLTIGISG

SEQ ID NO: 276138 - protein, 8 aa, Influenza virus
LTIGISGP

SEQ ID NO: 276139 - protein, 8 aa, Influenza virus
TIGISGPD

SEQ ID NO: 276140 - protein, 8 aa, Influenza virus
IGISGPDN

SEQ ID NO: 276141 - protein, 8 aa, Influenza virus
GISGPDNG

SEQ ID NO: 276142 - protein, 8 aa, Influenza virus
ISGPDNGA

SEQ ID NO: 276143 - protein, 8 aa, Influenza virus
SGPDNGAV

SEQ ID NO: 276144 - protein, 8 aa, Influenza virus
GPDNGAVA

SEQ ID NO: 276145 - protein, 8 aa, Influenza virus
PDNGAVAV

SEQ ID NO: 276146 - protein, 8 aa, Influenza virus
DNGAVAVL

SEQ ID NO: 276147 - protein, 8 aa, Influenza virus
NGAVAVLK

SEQ ID NO: 276148 - protein, 8 aa, Influenza virus
GAVAVLKY

SEQ ID NO: 276149 - protein, 8 aa, Influenza virus
AVAVLKYN

SEQ ID NO: 276150 - protein, 8 aa, Influenza virus
VAVLKYNG

SEQ ID NO: 276151 - protein, 8 aa, Influenza virus
KYNGIITD

SEQ ID NO: 276152 - protein, 8 aa, Influenza virus
YNGIITDT

SEQ ID NO: 276153 - protein, 8 aa, Influenza virus
NGIITDTI

SEQ ID NO: 276154 - protein, 8 aa, Influenza virus
GIITDTIK

SEQ ID NO: 276155 - protein, 8 aa, Influenza virus
IITDTIKS

SEQ ID NO: 276156 - protein, 8 aa, Influenza virus
ITDTIKSW

SEQ ID NO: 276157 - protein, 8 aa, Influenza virus
TDTIKSWR

SEQ ID NO: 276158 - protein, 8 aa, Influenza virus
NILRTQES

SEQ ID NO: 276159 - protein, 8 aa, Influenza virus
ILRTQESE

SEQ ID NO: 276160 - protein, 8 aa, Influenza virus
LRTQESEC

SEQ ID NO: 276161 - protein, 8 aa, Influenza virus
RTQESECA

SEQ ID NO: 276162 - protein, 8 aa, Influenza virus
TQESECAC

SEQ ID NO: 276163 - protein, 8 aa, Influenza virus
QESECACV

SEQ ID NO: 276164 - protein, 8 aa, Influenza virus
ESECACVN

SEQ ID NO: 276165 - protein, 8 aa, Influenza virus
SECACVNG

SEQ ID NO: 276166 - protein, 8 aa, Influenza virus
GSCFTVMT

SEQ ID NO: 276167 - protein, 8 aa, Influenza virus
SCFTVMTD

SEQ ID NO: 276168 - protein, 8 aa, Influenza virus
CFTVMTDG

SEQ ID NO: 276169 - protein, 8 aa, Influenza virus
FTVMTDGP

SEQ ID NO: 276170 - protein, 8 aa, Influenza virus
TVMTDGPS

SEQ ID NO: 276171 - protein, 8 aa, Influenza virus
QASYKIFK

SEQ ID NO: 276172 - protein, 8 aa, Influenza virus
YKYKIFKN

SEQ ID NO: 276173 - protein, 8 aa, Influenza virus
KYKIFKNG

SEQ ID NO: 276174 - protein, 8 aa, Influenza virus
GKKGKWLN

SEQ ID NO: 276175 - protein, 8 aa, Influenza virus
APNYHYEE

SEQ ID NO: 276176 - protein, 8 aa, Influenza virus
PNYHYEEC

SEQ ID NO: 276177 - protein, 8 aa, Influenza virus
NYHYEECS

SEQ ID NO: 276178 - protein, 8 aa, Influenza virus
YHYEECSC

SEQ ID NO: 276179 - protein, 8 aa, Influenza virus
HYEECSCY

SEQ ID NO: 276180 - protein, 8 aa, Influenza virus
YEECSCYP

SEQ ID NO: 276181 - protein, 8 aa, Influenza virus
EECSCYPD

SEQ ID NO: 276182 - protein, 8 aa, Influenza virus
ECSCYPDA

SEQ ID NO: 276183 - protein, 8 aa, Influenza virus
CSCYPDAG

SEQ ID NO: 276184 - protein, 8 aa, Influenza virus
SCYPDAGE

SEQ ID NO: 276185 - protein, 8 aa, Influenza virus
TCVCRDNW

SEQ ID NO: 276186 - protein, 8 aa, Influenza virus
CVCRDNWH

SEQ ID NO: 276187 - protein, 8 aa, Influenza virus
VCRDNWHG

SEQ ID NO: 276188 - protein, 8 aa, Influenza virus
CRDNWHGS

SEQ ID NO: 276189 - protein, 8 aa, Influenza virus
RDNWHGSN

SEQ ID NO: 276190 - protein, 8 aa, Influenza virus
DNWHGSNR

SEQ ID NO: 276191 - protein, 8 aa, Influenza virus
NWHGSNRP

SEQ ID NO: 276192 - protein, 8 aa, Influenza virus
WHGSNRPW

SEQ ID NO: 276193 - protein, 8 aa, Influenza virus
HGSNRPWV

SEQ ID NO: 276194 - protein, 8 aa, Influenza virus
GSNRPWVS

SEQ ID NO: 276195 - protein, 8 aa, Influenza virus
SNRPWVSF

SEQ ID NO: 276196 - protein, 8 aa, Influenza virus
NRPWVSFN

SEQ ID NO: 276197 - protein, 8 aa, Influenza virus
RPWVSFNQ

SEQ ID NO: 276198 - protein, 8 aa, Influenza virus
YQIGYICS

SEQ ID NO: 276199 - protein, 8 aa, Influenza virus
QIGYICSG

SEQ ID NO: 276200 - protein, 8 aa, Influenza virus
IGYICSGV

SEQ ID NO: 276201 - protein, 8 aa, Influenza virus
GYICSGVF

SEQ ID NO: 276202 - protein, 8 aa, Influenza virus
YICSGVFG

SEQ ID NO: 276203 - protein, 8 aa, Influenza virus
ICSGVFGD

SEQ ID NO: 276204 - protein, 8 aa, Influenza virus
CSGVFGDN

SEQ ID NO: 276205 - protein, 8 aa, Influenza virus
SGVFGDNP

SEQ ID NO: 276206 - protein, 8 aa, Influenza virus
GVFGDNPR

SEQ ID NO: 276207 - protein, 8 aa, Influenza virus
VFGDNPRP

SEQ ID NO: 276208 - protein, 8 aa, Influenza virus
FGDNPRPN

SEQ ID NO: 276209 - protein, 8 aa, Influenza virus
GDNPRPND

SEQ ID NO: 276210 - protein, 8 aa, Influenza virus
DNPRPNDG

SEQ ID NO: 276211 - protein, 8 aa, Influenza virus
PRPNDGTG

SEQ ID NO: 276212 - protein, 8 aa, Influenza virus
DGTGSCGP

SEQ ID NO: 276213 - protein, 8 aa, Influenza virus
GAYGVKGF

SEQ ID NO: 276214 - protein, 8 aa, Influenza virus
AYGVKGFS

SEQ ID NO: 276215 - protein, 8 aa, Influenza virus
YGVKGFSF

SEQ ID NO: 276216 - protein, 8 aa, Influenza virus
GVKGFSFK

SEQ ID NO: 276217 - protein, 8 aa, Influenza virus
VKGFSFKY

SEQ ID NO: 276218 - protein, 8 aa, Influenza virus
KGFSFKYG

SEQ ID NO: 276219 - protein, 8 aa, Influenza virus
GFSFKYGN

SEQ ID NO: 276220 - protein, 8 aa, Influenza virus
FSFKYGNG

SEQ ID NO: 276221 - protein, 8 aa, Influenza virus
FKYGNGVW

SEQ ID NO: 276222 - protein, 8 aa, Influenza virus
KYGNGVWI

SEQ ID NO: 276223 - protein, 8 aa, Influenza virus
YGNGVWIG

SEQ ID NO: 276224 - protein, 8 aa, Influenza virus
GNGVWIGR

SEQ ID NO: 276225 - protein, 8 aa, Influenza virus
NGVWIGRT

SEQ ID NO: 276226 - protein, 8 aa, Influenza virus
GVWIGRTK

SEQ ID NO: 276227 - protein, 8 aa, Influenza virus
VWIGRTKS

SEQ ID NO: 276228 - protein, 8 aa, Influenza virus
WIGRTKST

SEQ ID NO: 276229 - protein, 8 aa, Influenza virus
NSRSGFEM

SEQ ID NO: 276230 - protein, 8 aa, Influenza virus
SRSGFEMI

SEQ ID NO: 276231 - protein, 8 aa, Influenza virus
RSGFEMIW

SEQ ID NO: 276232 - protein, 8 aa, Influenza virus
SGFEMIWD

SEQ ID NO: 276233 - protein, 8 aa, Influenza virus
GFEMIWDP

SEQ ID NO: 276234 - protein, 8 aa, Influenza virus
FEMIWDPN

SEQ ID NO: 276235 - protein, 8 aa, Influenza virus
EMIWDPNG

SEQ ID NO: 276236 - protein, 8 aa, Influenza virus
MIWDPNGW

SEQ ID NO: 276237 - protein, 8 aa, Influenza virus
ITDWSGYS

SEQ ID NO: 276238 - protein, 8 aa, Influenza virus
TDWSGYSG

SEQ ID NO: 276239 - protein, 8 aa, Influenza virus
DWSGYSGS

SEQ ID NO: 276240 - protein, 8 aa, Influenza virus
WSGYSGSF

SEQ ID NO: 276241 - protein, 8 aa, Influenza virus
SGYSGSFV

SEQ ID NO: 276242 - protein, 8 aa, Influenza virus
GYSGSFVQ

SEQ ID NO: 276243 - protein, 8 aa, Influenza virus
YSGSFVQH

SEQ ID NO: 276244 - protein, 8 aa, Influenza virus
SGSFVQHP

SEQ ID NO: 276245 - protein, 8 aa, Influenza virus
GSFVQHPE

SEQ ID NO: 276246 - protein, 8 aa, Influenza virus
SFVQHPEL

SEQ ID NO: 276247 - protein, 8 aa, Influenza virus
FVQHPELT

SEQ ID NO: 276248 - protein, 8 aa, Influenza virus
VQHPELTG

SEQ ID NO: 276249 - protein, 8 aa, Influenza virus
QHPELTGL

SEQ ID NO: 276250 - protein, 8 aa, Influenza virus
HPELTGLD

SEQ ID NO: 276251 - protein, 8 aa, Influenza virus
PELTGLDC

SEQ ID NO: 276252 - protein, 8 aa, Influenza virus
TGLDCIRP

SEQ ID NO: 276253 - protein, 8 aa, Influenza virus
GLDCIRPC

SEQ ID NO: 276254 - protein, 8 aa, Influenza virus
LDCIRPCF

SEQ ID NO: 276255 - protein, 8 aa, Influenza virus
DCIRPCFW

SEQ ID NO: 276256 - protein, 8 aa, Influenza virus
CIRPCFWV

SEQ ID NO: 276257 - protein, 8 aa, Influenza virus
IRPCFWVE

SEQ ID NO: 276258 - protein, 8 aa, Influenza virus
RPCFWVEL

SEQ ID NO: 276259 - protein, 8 aa, Influenza virus
PCFWVELI

SEQ ID NO: 276260 - protein, 8 aa, Influenza virus
CFWVELIR

SEQ ID NO: 276261 - protein, 8 aa, Influenza virus
FWVELIRG

SEQ ID NO: 276262 - protein, 8 aa, Influenza virus
WVELIRGR

SEQ ID NO: 276263 - protein, 8 aa, Influenza virus
VELIRGRP

SEQ ID NO: 276264 - protein, 8 aa, Influenza virus
ELIRGRPK

SEQ ID NO: 276265 - protein, 8 aa, Influenza virus
LIRGRPKE

SEQ ID NO: 276266 - protein, 8 aa, Influenza virus
TIWTSGSS

SEQ ID NO: 276267 - protein, 8 aa, Influenza virus
IWTSGSSI

SEQ ID NO: 276268 - protein, 8 aa, Influenza virus
WTSGSSIS

SEQ ID NO: 276269 - protein, 8 aa, Influenza virus
TSGSSISF

SEQ ID NO: 276270 - protein, 8 aa, Influenza virus
SGSSISFC

SEQ ID NO: 276271 - protein, 8 aa, Influenza virus
GSSISFCG

SEQ ID NO: 276272 - protein, 8 aa, Influenza virus
SSISFCGV

SEQ ID NO: 276273 - protein, 8 aa, Influenza virus
SISFCGVN

SEQ ID NO: 276274 - protein, 8 aa, Influenza virus
ISFCGVNS

SEQ ID NO: 276275 - protein, 8 aa, Influenza virus
IFLWCKIV

SEQ ID NO: 276276 - protein, 8 aa, Influenza virus
FLWCKIVT

SEQ ID NO: 276277 - protein, 8 aa, Influenza virus
LWCKIVTT

SEQ ID NO: 276278 - protein, 8 aa, Influenza virus
WCKIVTTV

SEQ ID NO: 276279 - protein, 8 aa, Influenza virus
CKIVTTVG

SEQ ID NO: 276280 - protein, 8 aa, Influenza virus
KIVTTVGW

SEQ ID NO: 276281 - protein, 8 aa, Influenza virus
IVTTVGWS

SEQ ID NO: 276282 - protein, 8 aa, Influenza virus
VTTVGWSW

SEQ ID NO: 276283 - protein, 8 aa, Influenza virus
TVSWSWPD

SEQ ID NO: 276284 - protein, 8 aa, Influenza virus
SWSWPDGA

SEQ ID NO: 276285 - protein, 8 aa, Influenza virus
WSWPDGAE

SEQ ID NO: 276286 - protein, 8 aa, Influenza virus
SWPDGAEL

SEQ ID NO: 276287 - protein, 8 aa, Influenza virus
WPDGAELP

SEQ ID NO: 276288 - protein, 8 aa, Influenza virus
PDGAELPF

SEQ ID NO: 276289 - protein, 8 aa, Influenza virus
AELPFTID

SEQ ID NO: 276290 - protein, 8 aa, Influenza virus
LPFTIDKY

SEQ ID NO: 276291 - protein, 8 aa, Influenza virus
GDQICIGY

SEQ ID NO: 276292 - protein, 8 aa, Influenza virus
DQICIGYH

SEQ ID NO: 276293 - protein, 8 aa, Influenza virus
QICIGYHA

SEQ ID NO: 276294 - protein, 8 aa, Influenza virus
ICIGYHAN

SEQ ID NO: 276295 - protein, 8 aa, Influenza virus
CIGYHANN

SEQ ID NO: 276296 - protein, 8 aa, Influenza virus
IGYHANNS

SEQ ID NO: 276297 - protein, 8 aa, Influenza virus
GYHANNST

SEQ ID NO: 276298 - protein, 8 aa, Influenza virus
YHANNSTE

SEQ ID NO: 276299 - protein, 8 aa, Influenza virus
HANNSTEQ

SEQ ID NO: 276300 - protein, 8 aa, Influenza virus
ANNSTEQV

SEQ ID NO: 276301 - protein, 8 aa, Influenza virus
NNSTEQVD

SEQ ID NO: 276302 - protein, 8 aa, Influenza virus
NSTEQVDT

SEQ ID NO: 276303 - protein, 8 aa, Influenza virus
STEQVDTI

SEQ ID NO: 276304 - protein, 8 aa, Influenza virus
EQVDTIME

SEQ ID NO: 276305 - protein, 8 aa, Influenza virus
QVDTIMEK

SEQ ID NO: 276306 - protein, 8 aa, Influenza virus
VDTIMEKN

SEQ ID NO: 276307 - protein, 8 aa, Influenza virus
DTIMEKNV

SEQ ID NO: 276308 - protein, 8 aa, Influenza virus
TIMEKNVT

SEQ ID NO: 276309 - protein, 8 aa, Influenza virus
IMEKNVTV

SEQ ID NO: 276310 - protein, 8 aa, Influenza virus
MEKNVTVT

SEQ ID NO: 276311 - protein, 8 aa, Influenza virus
EKNVTVTH

SEQ ID NO: 276312 - protein, 8 aa, Influenza virus
KNVTVTHA

SEQ ID NO: 276313 - protein, 8 aa, Influenza virus
NVTVTHAQ

SEQ ID NO: 276314 - protein, 8 aa, Influenza virus
VTVTHAQD

SEQ ID NO: 276315 - protein, 8 aa, Influenza virus
HNGKLCSL

SEQ ID NO: 276316 - protein, 8 aa, Influenza virus
DCSVAGWL

SEQ ID NO: 276317 - protein, 8 aa, Influenza virus
AGWLLGNP

SEQ ID NO: 276318 - protein, 8 aa, Influenza virus
GWLLGNPM

SEQ ID NO: 276319 - protein, 8 aa, Influenza virus
WLLGNPMC

SEQ ID NO: 276320 - protein, 8 aa, Influenza virus
VPEWSYIV

SEQ ID NO: 276321 - protein, 8 aa, Influenza virus
PEWSYIVE

SEQ ID NO: 276322 - protein, 8 aa, Influenza virus
EWSYIVEK

SEQ ID NO: 276323 - protein, 8 aa, Influenza virus
WSYIVEKD

SEQ ID NO: 276324 - protein, 8 aa, Influenza virus
SYIVEKDN

SEQ ID NO: 276325 - protein, 8 aa, Influenza virus
YIVEKDNP

SEQ ID NO: 276326 - protein, 8 aa, Influenza virus
SSGVSSAC

SEQ ID NO: 276327 - protein, 8 aa, Influenza virus
SGVSSACP

SEQ ID NO: 276328 - protein, 8 aa, Influenza virus
YYNGRSSF

SEQ ID NO: 276329 - protein, 8 aa, Influenza virus
SSFFRNVV

SEQ ID NO: 276330 - protein, 8 aa, Influenza virus
SFFRNVVW

SEQ ID NO: 276331 - protein, 8 aa, Influenza virus
FFRNVVWL

SEQ ID NO: 276332 - protein, 8 aa, Influenza virus
FRNVVWLI

SEQ ID NO: 276333 - protein, 8 aa, Influenza virus
RNVVWLIK

SEQ ID NO: 276334 - protein, 8 aa, Influenza virus
NVVWLIKK

SEQ ID NO: 276335 - protein, 8 aa, Influenza virus
SVGTSTLN

SEQ ID NO: 276336 - protein, 8 aa, Influenza virus
GTSTLNQR

SEQ ID NO: 276337 - protein, 8 aa, Influenza virus
TSTLNQRS

SEQ ID NO: 276338 - protein, 8 aa, Influenza virus
IATRPKVN

SEQ ID NO: 276339 - protein, 8 aa, Influenza virus
ATRPKVNG

SEQ ID NO: 276340 - protein, 8 aa, Influenza virus
TRPKVNGQ

SEQ ID NO: 276341 - protein, 8 aa, Influenza virus
RPKVNGQS

SEQ ID NO: 276342 - protein, 8 aa, Influenza virus
PKVNGQSG

SEQ ID NO: 276343 - protein, 8 aa, Influenza virus
KVNGQSGR

SEQ ID NO: 276344 - protein, 8 aa, Influenza virus
VNGQSGRM

SEQ ID NO: 276345 - protein, 8 aa, Influenza virus
FESNGNFI

SEQ ID NO: 276346 - protein, 8 aa, Influenza virus
ESNGNFIA

SEQ ID NO: 276347 - protein, 8 aa, Influenza virus
SNGNFIAP

SEQ ID NO: 276348 - protein, 8 aa, Influenza virus
NGNFIAPE

SEQ ID NO: 276349 - protein, 8 aa, Influenza virus
GNFIAPEY

SEQ ID NO: 276350 - protein, 8 aa, Influenza virus
NFIAPEYA

SEQ ID NO: 276351 - protein, 8 aa, Influenza virus
FIAPEYAY

SEQ ID NO: 276352 - protein, 8 aa, Influenza virus
IAPEYAYK

SEQ ID NO: 276353 - protein, 8 aa, Influenza virus
APEYAYKI

SEQ ID NO: 276354 - protein, 8 aa, Influenza virus
PEYAYKIV

SEQ ID NO: 276355 - protein, 8 aa, Influenza virus
EYAYKIVK

SEQ ID NO: 276356 - protein, 8 aa, Influenza virus
YGNCDTKC

SEQ ID NO: 276357 - protein, 8 aa, Influenza virus
GNCDTKCQ

SEQ ID NO: 276358 - protein, 8 aa, Influenza virus
NCDTKCQT

SEQ ID NO: 276359 - protein, 8 aa, Influenza virus
CDTKCQTP

SEQ ID NO: 276360 - protein, 8 aa, Influenza virus
KCQTPVGA

SEQ ID NO: 276361 - protein, 8 aa, Influenza virus
MPFHNVHP

SEQ ID NO: 276362 - protein, 8 aa, Influenza virus
PFHNVHPL

SEQ ID NO: 276363 - protein, 8 aa, Influenza virus
FHNVHPLT

SEQ ID NO: 276364 - protein, 8 aa, Influenza virus
RKRKRKTR

SEQ ID NO: 276365 - protein, 8 aa, Influenza virus
KRKRKTRG

SEQ ID NO: 276366 - protein, 8 aa, Influenza virus
RKRKTRGL

SEQ ID NO: 276367 - protein, 8 aa, Influenza virus
KRKTRGLF

SEQ ID NO: 276368 - protein, 8 aa, Influenza virus
EKRRKKRG

SEQ ID NO: 276369 - protein, 8 aa, Influenza virus
KRRKKRGL

SEQ ID NO: 276370 - protein, 8 aa, Influenza virus
RRKKRGLF

SEQ ID NO: 276371 - protein, 8 aa, Influenza virus
RKKRGLFG

SEQ ID NO: 276372 - protein, 8 aa, Influenza virus
ETRGLFGA

SEQ ID NO: 276373 - protein, 8 aa, Influenza virus
TRGLFGAI

SEQ ID NO: 276374 - protein, 8 aa, Influenza virus
RGLFGAIA

SEQ ID NO: 276375 - protein, 8 aa, Influenza virus
GLFGAIAG

SEQ ID NO: 276376 - protein, 8 aa, Influenza virus
LFGAIAGF

SEQ ID NO: 276377 - protein, 8 aa, Influenza virus
FGAIAGFI

SEQ ID NO: 276378 - protein, 8 aa, Influenza virus
GAIAGFIE

SEQ ID NO: 276379 - protein, 8 aa, Influenza virus
AIAGFIEG

SEQ ID NO: 276380 - protein, 8 aa, Influenza virus
IAGFIEGG

SEQ ID NO: 276381 - protein, 8 aa, Influenza virus
AGFIEGGW

SEQ ID NO: 276382 - protein, 8 aa, Influenza virus
GFIEGGWQ

SEQ ID NO: 276383 - protein, 8 aa, Influenza virus
FIEGGWQG

SEQ ID NO: 276384 - protein, 8 aa, Influenza virus
IEGGWQGM

SEQ ID NO: 276385 - protein, 8 aa, Influenza virus
EGGWQGMV

SEQ ID NO: 276386 - protein, 8 aa, Influenza virus
GGWQGMVD

SEQ ID NO: 276387 - protein, 8 aa, Influenza virus
GWQGMVDG

SEQ ID NO: 276388 - protein, 8 aa, Influenza virus
WQGMVDGW

SEQ ID NO: 276389 - protein, 8 aa, Influenza virus
QGMVDGWY

SEQ ID NO: 276390 - protein, 8 aa, Influenza virus
GMVDGWYG

SEQ ID NO: 276391 - protein, 8 aa, Influenza virus
MVDGWYGY

SEQ ID NO: 276392 - protein, 8 aa, Influenza virus
VDGWYGYH

SEQ ID NO: 276393 - protein, 8 aa, Influenza virus
DGWYGYHH

SEQ ID NO: 276394 - protein, 8 aa, Influenza virus
GWYGYHHS

SEQ ID NO: 276395 - protein, 8 aa, Influenza virus
WYGYHHSN

SEQ ID NO: 276396 - protein, 8 aa, Influenza virus
NEQGSGYA

SEQ ID NO: 276397 - protein, 8 aa, Influenza virus
EQGSGYAA

SEQ ID NO: 276398 - protein, 8 aa, Influenza virus
QGSGYAAD

SEQ ID NO: 276399 - protein, 8 aa, Influenza virus
GSGYAADK

SEQ ID NO: 276400 - protein, 8 aa, Influenza virus
SGYAADKE

SEQ ID NO: 276401 - protein, 8 aa, Influenza virus
GYAADKES

SEQ ID NO: 276402 - protein, 8 aa, Influenza virus
YAADKEST

SEQ ID NO: 276403 - protein, 8 aa, Influenza virus
AADKESTQ

SEQ ID NO: 276404 - protein, 8 aa, Influenza virus
ADKESTQK

SEQ ID NO: 276405 - protein, 8 aa, Influenza virus
DKESTQKA

SEQ ID NO: 276406 - protein, 8 aa, Influenza virus
KESTQKAI

SEQ ID NO: 276407 - protein, 8 aa, Influenza virus
ESTQKAID

SEQ ID NO: 276408 - protein, 8 aa, Influenza virus
STQKAIDG

SEQ ID NO: 276409 - protein, 8 aa, Influenza virus
TQKAIDGI

SEQ ID NO: 276410 - protein, 8 aa, Influenza virus
QKAIDGIT

SEQ ID NO: 276411 - protein, 8 aa, Influenza virus
KAIDGITN

SEQ ID NO: 276412 - protein, 8 aa, Influenza virus
NSIIDKMN

SEQ ID NO: 276413 - protein, 8 aa, Influenza virus
DVWTYNAE

SEQ ID NO: 276414 - protein, 8 aa, Influenza virus
VWTYNAEL

SEQ ID NO: 276415 - protein, 8 aa, Influenza virus
WTYNAELL

SEQ ID NO: 276416 - protein, 8 aa, Influenza virus
TYNAELLV

SEQ ID NO: 276417 - protein, 8 aa, Influenza virus
YNAELLVL

SEQ ID NO: 276418 - protein, 8 aa, Influenza virus
NAELLVLM

SEQ ID NO: 276419 - protein, 8 aa, Influenza virus
AELLVLME

SEQ ID NO: 276420 - protein, 8 aa, Influenza virus
ELLVLMEN

SEQ ID NO: 276421 - protein, 8 aa, Influenza virus
LLVLMENE

SEQ ID NO: 276422 - protein, 8 aa, Influenza virus
LVLMENER

SEQ ID NO: 276423 - protein, 8 aa, Influenza virus
VLMENERT

SEQ ID NO: 276424 - protein, 8 aa, Influenza virus
LMENERTL

SEQ ID NO: 276425 - protein, 8 aa, Influenza virus
MENERTLD

SEQ ID NO: 276426 - protein, 8 aa, Influenza virus
ENERTLDF

SEQ ID NO: 276427 - protein, 8 aa, Influenza virus
NERTLDFH

SEQ ID NO: 276428 - protein, 8 aa, Influenza virus
ERTLDFHD

SEQ ID NO: 276429 - protein, 8 aa, Influenza virus
RTLDFHDS

SEQ ID NO: 276430 - protein, 8 aa, Influenza virus
TLDFHDSN

SEQ ID NO: 276431 - protein, 8 aa, Influenza virus
LDFHDSNV

SEQ ID NO: 276432 - protein, 8 aa, Influenza virus
DFHDSNVK

SEQ ID NO: 276433 - protein, 8 aa, Influenza virus
FHDSNVKN

SEQ ID NO: 276434 - protein, 8 aa, Influenza virus
HDSNVKNL

SEQ ID NO: 276435 - protein, 8 aa, Influenza virus
DSNVKNLY

SEQ ID NO: 276436 - protein, 8 aa, Influenza virus
SNVKNLYD

SEQ ID NO: 276437 - protein, 8 aa, Influenza virus
NVKNLYDK

SEQ ID NO: 276438 - protein, 8 aa, Influenza virus
VKNLYDKV

SEQ ID NO: 276439 - protein, 8 aa, Influenza virus
KNLYDKVR

SEQ ID NO: 276440 - protein, 8 aa, Influenza virus
NLYDKVRL

SEQ ID NO: 276441 - protein, 8 aa, Influenza virus
LYDKVRLQ

SEQ ID NO: 276442 - protein, 8 aa, Influenza virus
YDKVRLQL

SEQ ID NO: 276443 - protein, 8 aa, Influenza virus
VRLQLRDN

SEQ ID NO: 276444 - protein, 8 aa, Influenza virus
RLQLRDNA

SEQ ID NO: 276445 - protein, 8 aa, Influenza virus
QLRDNAKE

SEQ ID NO: 276446 - protein, 8 aa, Influenza virus
DNAKELGN

SEQ ID NO: 276447 - protein, 8 aa, Influenza virus
NAKELGNG

SEQ ID NO: 276448 - protein, 8 aa, Influenza virus
AKELGNGC

SEQ ID NO: 276449 - protein, 8 aa, Influenza virus
KELGNGCF

SEQ ID NO: 276450 - protein, 8 aa, Influenza virus
ELGNGCFE

SEQ ID NO: 276451 - protein, 8 aa, Influenza virus
LGNGCFEF

SEQ ID NO: 276452 - protein, 8 aa, Influenza virus
GNGCFEFY

SEQ ID NO: 276453 - protein, 8 aa, Influenza virus
NGCFEFYH

SEQ ID NO: 276454 - protein, 8 aa, Influenza virus
GCFEFYHK

SEQ ID NO: 276455 - protein, 8 aa, Influenza virus
CFEFYHKC

SEQ ID NO: 276456 - protein, 8 aa, Influenza virus
FEFYHKCD

SEQ ID NO: 276457 - protein, 8 aa, Influenza virus
EFYHKCDN

SEQ ID NO: 276458 - protein, 8 aa, Influenza virus
ECMESVRN

SEQ ID NO: 276459 - protein, 8 aa, Influenza virus
CMESVRNG

SEQ ID NO: 276460 - protein, 8 aa, Influenza virus
MESVRNGT

SEQ ID NO: 276461 - protein, 8 aa, Influenza virus
ESVRNGTY

SEQ ID NO: 276462 - protein, 8 aa, Influenza virus
SVRNGTYD

SEQ ID NO: 276463 - protein, 8 aa, Influenza virus
VRNGTYDY

SEQ ID NO: 276464 - protein, 8 aa, Influenza virus
YQILSIYS

SEQ ID NO: 276465 - protein, 8 aa, Influenza virus
ILSIYSTV

SEQ ID NO: 276466 - protein, 8 aa, Influenza virus
LSIYSTVA

SEQ ID NO: 276467 - protein, 8 aa, Influenza virus
SIYSTVAS

SEQ ID NO: 276468 - protein, 8 aa, Influenza virus
IYSTVASS

SEQ ID NO: 276469 - protein, 8 aa, Influenza virus
YSTVASSL

SEQ ID NO: 276470 - protein, 8 aa, Influenza virus
VASSLALA

SEQ ID NO: 276471 - protein, 8 aa, Influenza virus
ASSLALAI

SEQ ID NO: 276472 - protein, 8 aa, Influenza virus
SSLALAIM

SEQ ID NO: 276473 - protein, 8 aa, Influenza virus
LAIMIAGL

SEQ ID NO: 276474 - protein, 8 aa, Influenza virus
AIMIAGLS

SEQ ID NO: 276475 - protein, 8 aa, Influenza virus
IMIAGLSF

SEQ ID NO: 276476 - protein, 8 aa, Influenza virus
MIAGLSFW

SEQ ID NO: 276477 - protein, 8 aa, Influenza virus
IAGLSFWM

SEQ ID NO: 276478 - protein, 8 aa, Influenza virus
AGLSFWMC

SEQ ID NO: 276479 - protein, 8 aa, Influenza virus
GLSFWMCS

SEQ ID NO: 276480 - protein, 8 aa, Influenza virus
LSFWMCSN

SEQ ID NO: 276481 - protein, 8 aa, Influenza virus
SFWMCSNG

SEQ ID NO: 276482 - protein, 8 aa, Influenza virus
FWMCSNGS

SEQ ID NO: 276483 - protein, 8 aa, Influenza virus
WMCSNGSL

SEQ ID NO: 276484 - protein, 8 aa, Influenza virus
MCSNGSLQ

SEQ ID NO: 276485 - protein, 8 aa, Influenza virus
CSNGSLQC

SEQ ID NO: 276486 - protein, 8 aa, Influenza virus
SNGSLQCR

SEQ ID NO: 276487 - protein, 8 aa, Influenza virus
NGSLQCRI

SEQ ID NO: 276488 - protein, 8 aa, Influenza virus
GSLQCRIC

SEQ ID NO: 276489 - protein, 8 aa, Influenza virus
SLQCRICI

SEQ ID NO: 276490 - protein, 8 aa, Influenza virus
QKIITIGS

SEQ ID NO: 276491 - protein, 8 aa, Influenza virus
IITIGSVS

SEQ ID NO: 276492 - protein, 8 aa, Influenza virus
ITIGSVSL

SEQ ID NO: 276493 - protein, 8 aa, Influenza virus
YRNWSKPQ

SEQ ID NO: 276494 - protein, 8 aa, Influenza virus
RNWSKPQC

SEQ ID NO: 276495 - protein, 8 aa, Influenza virus
WSKPQCQI

SEQ ID NO: 276496 - protein, 8 aa, Influenza virus
KPQCQITG

SEQ ID NO: 276497 - protein, 8 aa, Influenza virus
PQCQITGF

SEQ ID NO: 276498 - protein, 8 aa, Influenza virus
QCQITGFA

SEQ ID NO: 276499 - protein, 8 aa, Influenza virus
CQITGFAP

SEQ ID NO: 276500 - protein, 8 aa, Influenza virus
QITGFAPF

SEQ ID NO: 276501 - protein, 8 aa, Influenza virus
ITGFAPFS

SEQ ID NO: 276502 - protein, 8 aa, Influenza virus
TGFAPFSK

SEQ ID NO: 276503 - protein, 8 aa, Influenza virus
GFAPFSKD

SEQ ID NO: 276504 - protein, 8 aa, Influenza virus
FAPFSKDN

SEQ ID NO: 276505 - protein, 8 aa, Influenza virus
APFSKDNS

SEQ ID NO: 276506 - protein, 8 aa, Influenza virus
PFSKDNSI

SEQ ID NO: 276507 - protein, 8 aa, Influenza virus
FSKDNSIR

SEQ ID NO: 276508 - protein, 8 aa, Influenza virus
SKDNSIRL

SEQ ID NO: 276509 - protein, 8 aa, Influenza virus
KDNSIRLS

SEQ ID NO: 276510 - protein, 8 aa, Influenza virus
DNSIRLSA

SEQ ID NO: 276511 - protein, 8 aa, Influenza virus
NSIRLSAG

SEQ ID NO: 276512 - protein, 8 aa, Influenza virus
SIRLSAGG

SEQ ID NO: 276513 - protein, 8 aa, Influenza virus
RLSAGGDI

SEQ ID NO: 276514 - protein, 8 aa, Influenza virus
LSAGGDIW

SEQ ID NO: 276515 - protein, 8 aa, Influenza virus
IWVTREPY

SEQ ID NO: 276516 - protein, 8 aa, Influenza virus
WVTREPYV

SEQ ID NO: 276517 - protein, 8 aa, Influenza virus
VTREPYVS

SEQ ID NO: 276518 - protein, 8 aa, Influenza virus
TREPYVSC

SEQ ID NO: 276519 - protein, 8 aa, Influenza virus
REPYVSCD

SEQ ID NO: 276520 - protein, 8 aa, Influenza virus
KCYQFALG

SEQ ID NO: 276521 - protein, 8 aa, Influenza virus
CYQFALGQ

SEQ ID NO: 276522 - protein, 8 aa, Influenza virus
YQFALGQG

SEQ ID NO: 276523 - protein, 8 aa, Influenza virus
QFALGQGT

SEQ ID NO: 276524 - protein, 8 aa, Influenza virus
FALGQGTT

SEQ ID NO: 276525 - protein, 8 aa, Influenza virus
ALGQGTTL

SEQ ID NO: 276526 - protein, 8 aa, Influenza virus
LGQGTTLD

SEQ ID NO: 276527 - protein, 8 aa, Influenza virus
GQGTTLDN

SEQ ID NO: 276528 - protein, 8 aa, Influenza virus
NKHSNGTI

SEQ ID NO: 276529 - protein, 8 aa, Influenza virus
KHSNGTIH

SEQ ID NO: 276530 - protein, 8 aa, Influenza virus
HSNGTIHD

SEQ ID NO: 276531 - protein, 8 aa, Influenza virus
SNGTIHDR

SEQ ID NO: 276532 - protein, 8 aa, Influenza virus
NGTIHDRI

SEQ ID NO: 276533 - protein, 8 aa, Influenza virus
PHRTLLMN

SEQ ID NO: 276534 - protein, 8 aa, Influenza virus
HRTLLMNE

SEQ ID NO: 276535 - protein, 8 aa, Influenza virus
RTLLMNEL

SEQ ID NO: 276536 - protein, 8 aa, Influenza virus
TLLMNELG

SEQ ID NO: 276537 - protein, 8 aa, Influenza virus
LLMNELGV

SEQ ID NO: 276538 - protein, 8 aa, Influenza virus
LMNELGVP

SEQ ID NO: 276539 - protein, 8 aa, Influenza virus
MNELGVPF

SEQ ID NO: 276540 - protein, 8 aa, Influenza virus
NELGVPFH

SEQ ID NO: 276541 - protein, 8 aa, Influenza virus
ELGVPFHL

SEQ ID NO: 276542 - protein, 8 aa, Influenza virus
LGVPFHLG

SEQ ID NO: 276543 - protein, 8 aa, Influenza virus
GVPFHLGT

SEQ ID NO: 276544 - protein, 8 aa, Influenza virus
VPFHLGTK

SEQ ID NO: 276545 - protein, 8 aa, Influenza virus
PFHLGTKQ

SEQ ID NO: 276546 - protein, 8 aa, Influenza virus
FHLGTKQV

SEQ ID NO: 276547 - protein, 8 aa, Influenza virus
HLGTKQVC

SEQ ID NO: 276548 - protein, 8 aa, Influenza virus
LGTKQVCI

SEQ ID NO: 276549 - protein, 8 aa, Influenza virus
GTKQVCIA

SEQ ID NO: 276550 - protein, 8 aa, Influenza virus
TKQVCIAW

SEQ ID NO: 276551 - protein, 8 aa, Influenza virus
KQVCIAWS

SEQ ID NO: 276552 - protein, 8 aa, Influenza virus
QVCIAWSS

SEQ ID NO: 276553 - protein, 8 aa, Influenza virus
VCIAWSSS

SEQ ID NO: 276554 - protein, 8 aa, Influenza virus
CIAWSSSS

SEQ ID NO: 276555 - protein, 8 aa, Influenza virus
IAWSSSSC

SEQ ID NO: 276556 - protein, 8 aa, Influenza virus
AWSSSSCH

SEQ ID NO: 276557 - protein, 8 aa, Influenza virus
WSSSSCHD

SEQ ID NO: 276558 - protein, 8 aa, Influenza virus
SSSSCHDG

SEQ ID NO: 276559 - protein, 8 aa, Influenza virus
SSSCHDGK

SEQ ID NO: 276560 - protein, 8 aa, Influenza virus
SSCHDGKA

SEQ ID NO: 276561 - protein, 8 aa, Influenza virus
SCHDGKAW

SEQ ID NO: 276562 - protein, 8 aa, Influenza virus
CHDGKAWL

SEQ ID NO: 276563 - protein, 8 aa, Influenza virus
HDGKAWLH

SEQ ID NO: 276564 - protein, 8 aa, Influenza virus
DGKAWLHV

SEQ ID NO: 276565 - protein, 8 aa, Influenza virus
GKAWLHVC

SEQ ID NO: 276566 - protein, 8 aa, Influenza virus
KAWLHVCV

SEQ ID NO: 276567 - protein, 8 aa, Influenza virus
AWLHVCVT

SEQ ID NO: 276568 - protein, 8 aa, Influenza virus
WLHVCVTG

SEQ ID NO: 276569 - protein, 8 aa, Influenza virus
LHVCVTGD

SEQ ID NO: 276570 - protein, 8 aa, Influenza virus
HVCVTGDD

SEQ ID NO: 276571 - protein, 8 aa, Influenza virus
TGDDRNAT

SEQ ID NO: 276572 - protein, 8 aa, Influenza virus
GDDRNATA

SEQ ID NO: 276573 - protein, 8 aa, Influenza virus
DDRNATAS

SEQ ID NO: 276574 - protein, 8 aa, Influenza virus
NATASFIY

SEQ ID NO: 276575 - protein, 8 aa, Influenza virus
SWSQNILR

SEQ ID NO: 276576 - protein, 8 aa, Influenza virus
WSQNILRT

SEQ ID NO: 276577 - protein, 8 aa, Influenza virus
SQNILRTQ

SEQ ID NO: 276578 - protein, 8 aa, Influenza virus
QNILRTQE

SEQ ID NO: 276579 - protein, 8 aa, Influenza virus
NILRTQES

SEQ ID NO: 276580 - protein, 8 aa, Influenza virus
ILRTQESE

SEQ ID NO: 276581 - protein, 8 aa, Influenza virus
LRTQESEC

SEQ ID NO: 276582 - protein, 8 aa, Influenza virus
RTQESECV

SEQ ID NO: 276583 - protein, 8 aa, Influenza virus
TQESECVC

SEQ ID NO: 276584 - protein, 8 aa, Influenza virus
QESECVCI

SEQ ID NO: 276585 - protein, 8 aa, Influenza virus
ESECVCIN

SEQ ID NO: 276586 - protein, 8 aa, Influenza virus
CTVVMTDG

SEQ ID NO: 276587 - protein, 8 aa, Influenza virus
TVVMTDGS

SEQ ID NO: 276588 - protein, 8 aa, Influenza virus
VVMTDGSA

SEQ ID NO: 276589 - protein, 8 aa, Influenza virus
VMTDGSAS

SEQ ID NO: 276590 - protein, 8 aa, Influenza virus
MTDGSASG

SEQ ID NO: 276591 - protein, 8 aa, Influenza virus
TDGSASGR

SEQ ID NO: 276592 - protein, 8 aa, Influenza virus
DGSASGRA

SEQ ID NO: 276593 - protein, 8 aa, Influenza virus
SPLSGSAQ

SEQ ID NO: 276594 - protein, 8 aa, Influenza virus
PLSGSAQH

SEQ ID NO: 276595 - protein, 8 aa, Influenza virus
LSGSAQHI

SEQ ID NO: 276596 - protein, 8 aa, Influenza virus
SGSAQHIE

SEQ ID NO: 276597 - protein, 8 aa, Influenza virus
GSAQHIEE

SEQ ID NO: 276598 - protein, 8 aa, Influenza virus
SAQHIEEC

SEQ ID NO: 276599 - protein, 8 aa, Influenza virus
AQHIEECS

SEQ ID NO: 276600 - protein, 8 aa, Influenza virus
QHIEECSC

SEQ ID NO: 276601 - protein, 8 aa, Influenza virus
HIEECSCY

SEQ ID NO: 276602 - protein, 8 aa, Influenza virus
IEECSCYP

SEQ ID NO: 276603 - protein, 8 aa, Influenza virus
EECSCYPR

SEQ ID NO: 276604 - protein, 8 aa, Influenza virus
SYPNVRCV

SEQ ID NO: 276605 - protein, 8 aa, Influenza virus
VRCVCRDN

SEQ ID NO: 276606 - protein, 8 aa, Influenza virus
RCVCRDNW

SEQ ID NO: 276607 - protein, 8 aa, Influenza virus
CVCRDNWK

SEQ ID NO: 276608 - protein, 8 aa, Influenza virus
VCRDNWKG

SEQ ID NO: 276609 - protein, 8 aa, Influenza virus
CRDNWKGS

SEQ ID NO: 276610 - protein, 8 aa, Influenza virus
RDNWKGSN

SEQ ID NO: 276611 - protein, 8 aa, Influenza virus
DNWKGSNR

SEQ ID NO: 276612 - protein, 8 aa, Influenza virus
NWKGSNRP

SEQ ID NO: 276613 - protein, 8 aa, Influenza virus
WKGSNRPV

SEQ ID NO: 276614 - protein, 8 aa, Influenza virus
KLDINMAD

SEQ ID NO: 276615 - protein, 8 aa, Influenza virus
SSYVCSGL

SEQ ID NO: 276616 - protein, 8 aa, Influenza virus
SYVCSGLV

SEQ ID NO: 276617 - protein, 8 aa, Influenza virus
YVCSGLVG

SEQ ID NO: 276618 - protein, 8 aa, Influenza virus
VCSGLVGD

SEQ ID NO: 276619 - protein, 8 aa, Influenza virus
CSGLVGDT

SEQ ID NO: 276620 - protein, 8 aa, Influenza virus
SGLVGDTP

SEQ ID NO: 276621 - protein, 8 aa, Influenza virus
GLVGDTPR

SEQ ID NO: 276622 - protein, 8 aa, Influenza virus
LVGDTPRN

SEQ ID NO: 276623 - protein, 8 aa, Influenza virus
VGDTPRND

SEQ ID NO: 276624 - protein, 8 aa, Influenza virus
GDTPRNDD

SEQ ID NO: 276625 - protein, 8 aa, Influenza virus
DTPRNDDS

SEQ ID NO: 276626 - protein, 8 aa, Influenza virus
SSSNCRDP

SEQ ID NO: 276627 - protein, 8 aa, Influenza virus
SSNCRDPN

SEQ ID NO: 276628 - protein, 8 aa, Influenza virus
SNCRDPNN

SEQ ID NO: 276629 - protein, 8 aa, Influenza virus
NCRDPNNE

SEQ ID NO: 276630 - protein, 8 aa, Influenza virus
CRDPNNER

SEQ ID NO: 276631 - protein, 8 aa, Influenza virus
RDPNNERG

SEQ ID NO: 276632 - protein, 8 aa, Influenza virus
GNPGVKGW

SEQ ID NO: 276633 - protein, 8 aa, Influenza virus
NPGVKGWA

SEQ ID NO: 276634 - protein, 8 aa, Influenza virus
PGVKGWAF

SEQ ID NO: 276635 - protein, 8 aa, Influenza virus
GVKGWAFD

SEQ ID NO: 276636 - protein, 8 aa, Influenza virus
VKGWAFDN

SEQ ID NO: 276637 - protein, 8 aa, Influenza virus
DDVWMGRT

SEQ ID NO: 276638 - protein, 8 aa, Influenza virus
DVWMGRTI

SEQ ID NO: 276639 - protein, 8 aa, Influenza virus
VWMGRTIS

SEQ ID NO: 276640 - protein, 8 aa, Influenza virus
WMGRTISK

SEQ ID NO: 276641 - protein, 8 aa, Influenza virus
GRTISKDS

SEQ ID NO: 276642 - protein, 8 aa, Influenza virus
RTISKDSR

SEQ ID NO: 276643 - protein, 8 aa, Influenza virus
SKDSRSGY

SEQ ID NO: 276644 - protein, 8 aa, Influenza virus
KDSRSGYE

SEQ ID NO: 276645 - protein, 8 aa, Influenza virus
DSRSGYET

SEQ ID NO: 276646 - protein, 8 aa, Influenza virus
SRSGYETF

SEQ ID NO: 276647 - protein, 8 aa, Influenza virus
RSGYETFR

SEQ ID NO: 276648 - protein, 8 aa, Influenza virus
SGYETFRV

SEQ ID NO: 276649 - protein, 8 aa, Influenza virus
GYETFRVI

SEQ ID NO: 276650 - protein, 8 aa, Influenza virus
NNWSGYSG

SEQ ID NO: 276651 - protein, 8 aa, Influenza virus
NWSGYSGI

SEQ ID NO: 276652 - protein, 8 aa, Influenza virus
WSGYSGIF

SEQ ID NO: 276653 - protein, 8 aa, Influenza virus
SGYSGIFS

SEQ ID NO: 276654 - protein, 8 aa, Influenza virus
GYSGIFSV

SEQ ID NO: 276655 - protein, 8 aa, Influenza virus
YSGIFSVE

SEQ ID NO: 276656 - protein, 8 aa, Influenza virus
SCINRCFY

SEQ ID NO: 276657 - protein, 8 aa, Influenza virus
CINRCFYV

SEQ ID NO: 276658 - protein, 8 aa, Influenza virus
INRCFYVE

SEQ ID NO: 276659 - protein, 8 aa, Influenza virus
NRCFYVEL

SEQ ID NO: 276660 - protein, 8 aa, Influenza virus
RCFYVELI

SEQ ID NO: 276661 - protein, 8 aa, Influenza virus
CFYVELIR

SEQ ID NO: 276662 - protein, 8 aa, Influenza virus
FYVELIRG

SEQ ID NO: 276663 - protein, 8 aa, Influenza virus
YVELIRGR

SEQ ID NO: 276664 - protein, 8 aa, Influenza virus
VELIRGRP

SEQ ID NO: 276665 - protein, 8 aa, Influenza virus
ELIRGRPQ

SEQ ID NO: 276666 - protein, 8 aa, Influenza virus
LIRGRPQE

SEQ ID NO: 276667 - protein, 8 aa, Influenza virus
RVWWTSNS

SEQ ID NO: 276668 - protein, 8 aa, Influenza virus
VWWTSNSI

SEQ ID NO: 276669 - protein, 8 aa, Influenza virus
WWTSNSIV

SEQ ID NO: 276670 - protein, 8 aa, Influenza virus
WTSNSIVV

SEQ ID NO: 276671 - protein, 8 aa, Influenza virus
TSNSIVVF

SEQ ID NO: 276672 - protein, 8 aa, Influenza virus
SNSIVVFC

SEQ ID NO: 276673 - protein, 8 aa, Influenza virus
NSIVVFCG

SEQ ID NO: 276674 - protein, 8 aa, Influenza virus
SIVVFCGT

SEQ ID NO: 276675 - protein, 8 aa, Influenza virus
IVVFCGTS

SEQ ID NO: 276676 - protein, 8 aa, Influenza virus
VVFCGTSG

SEQ ID NO: 276677 - protein, 8 aa, Influenza virus
VFCGTSGT

SEQ ID NO: 276678 - protein, 8 aa, Influenza virus
FCGTSGTY

SEQ ID NO: 276679 - protein, 8 aa, Influenza virus
CGTSGTYG

SEQ ID NO: 276680 - protein, 8 aa, Influenza virus
GTSGTYGT

SEQ ID NO: 276681 - protein, 8 aa, Influenza virus
TSGTYGTG

SEQ ID NO: 276682 - protein, 8 aa, Influenza virus
SGTYGTGS

SEQ ID NO: 276683 - protein, 8 aa, Influenza virus
GTYGTGSW

SEQ ID NO: 276684 - protein, 8 aa, Influenza virus
TYGTGSWP

SEQ ID NO: 276685 - protein, 8 aa, Influenza virus
YGTGSWPD

SEQ ID NO: 276686 - protein, 8 aa, Influenza virus
GTGSWPDG

SEQ ID NO: 276687 - protein, 8 aa, Influenza virus
TGSWPDGA

SEQ ID NO: 276688 - protein, 8 aa, Influenza virus
GSWPDGAN

SEQ ID NO: 276689 - protein, 8 aa, Influenza virus
SWPDGANI

SEQ ID NO: 276690 - protein, 8 aa, Influenza virus
WPDGANIN

SEQ ID NO: 276691 - protein, 8 aa, Influenza virus
PDGANINF

SEQ ID NO: 276692 - protein, 8 aa, Influenza virus
DGANINFM

SEQ ID NO: 276693 - protein, 8 aa, Influenza virus
GANINFMP

SEQ ID NO: 276694 - protein, 8 aa, Influenza virus
GKSDKICI

SEQ ID NO: 276695 - protein, 8 aa, Influenza virus
KSDKICIG

SEQ ID NO: 276696 - protein, 8 aa, Influenza virus
SDKICIGY

SEQ ID NO: 276697 - protein, 8 aa, Influenza virus
DKICIGYH

SEQ ID NO: 276698 - protein, 8 aa, Influenza virus
KICIGYHA

SEQ ID NO: 276699 - protein, 8 aa, Influenza virus
ICIGYHAN

SEQ ID NO: 276700 - protein, 8 aa, Influenza virus
CIGYHANN

SEQ ID NO: 276701 - protein, 8 aa, Influenza virus
IGYHANNS

SEQ ID NO: 276702 - protein, 8 aa, Influenza virus
GYHANNST

SEQ ID NO: 276703 - protein, 8 aa, Influenza virus
YHANNSTT

SEQ ID NO: 276704 - protein, 8 aa, Influenza virus
HANNSTTQ

SEQ ID NO: 276705 - protein, 8 aa, Influenza virus
ANNSTTQV

SEQ ID NO: 276706 - protein, 8 aa, Influenza virus
NNSTTQVD

SEQ ID NO: 276707 - protein, 8 aa, Influenza virus
NSTTQVDT

SEQ ID NO: 276708 - protein, 8 aa, Influenza virus
STTQVDTI

SEQ ID NO: 276709 - protein, 8 aa, Influenza virus
TQVDTILE

SEQ ID NO: 276710 - protein, 8 aa, Influenza virus
VDTILEKN

SEQ ID NO: 276711 - protein, 8 aa, Influenza virus
DTILEKNV

SEQ ID NO: 276712 - protein, 8 aa, Influenza virus
TILEKNVT

SEQ ID NO: 276713 - protein, 8 aa, Influenza virus
ILEKNVTV

SEQ ID NO: 276714 - protein, 8 aa, Influenza virus
LEKNVTVT

SEQ ID NO: 276715 - protein, 8 aa, Influenza virus
EKNVTVTH

SEQ ID NO: 276716 - protein, 8 aa, Influenza virus
KNVTVTHS

SEQ ID NO: 276717 - protein, 8 aa, Influenza virus
NVTVTHSV

SEQ ID NO: 276718 - protein, 8 aa, Influenza virus
VTVTHSVE

SEQ ID NO: 276719 - protein, 8 aa, Influenza virus
TVTHSVEL

SEQ ID NO: 276720 - protein, 8 aa, Influenza virus
VTHSVELL

SEQ ID NO: 276721 - protein, 8 aa, Influenza virus
THSVELLE

SEQ ID NO: 276722 - protein, 8 aa, Influenza virus
HSVELLEN

SEQ ID NO: 276723 - protein, 8 aa, Influenza virus
EGWILGNP

SEQ ID NO: 276724 - protein, 8 aa, Influenza virus
GWILGNPQ

SEQ ID NO: 276725 - protein, 8 aa, Influenza virus
WILGNPQC

SEQ ID NO: 276726 - protein, 8 aa, Influenza virus
ILGNPQCD

SEQ ID NO: 276727 - protein, 8 aa, Influenza virus
QSWSYIVE

SEQ ID NO: 276728 - protein, 8 aa, Influenza virus
SWSYIVER

SEQ ID NO: 276729 - protein, 8 aa, Influenza virus
WSYIVERP

SEQ ID NO: 276730 - protein, 8 aa, Influenza virus
AQNGICYP

SEQ ID NO: 276731 - protein, 8 aa, Influenza virus
QNGICYPG

SEQ ID NO: 276732 - protein, 8 aa, Influenza virus
GICYPGVL

SEQ ID NO: 276733 - protein, 8 aa, Influenza virus
VERFEMFP

SEQ ID NO: 276734 - protein, 8 aa, Influenza virus
ERFEMFPK

SEQ ID NO: 276735 - protein, 8 aa, Influenza virus
SSFYRNLL

SEQ ID NO: 276736 - protein, 8 aa, Influenza virus
SFYRNLLW

SEQ ID NO: 276737 - protein, 8 aa, Influenza virus
FYRNLLWI

SEQ ID NO: 276738 - protein, 8 aa, Influenza virus
PILYFWGV

SEQ ID NO: 276739 - protein, 8 aa, Influenza virus
ILYFWGVH

SEQ ID NO: 276740 - protein, 8 aa, Influenza virus
LYFWGVHH

SEQ ID NO: 276741 - protein, 8 aa, Influenza virus
YFWGVHHP

SEQ ID NO: 276742 - protein, 8 aa, Influenza virus
RYVRMGTE

SEQ ID NO: 276743 - protein, 8 aa, Influenza virus
YVRMGTES

SEQ ID NO: 276744 - protein, 8 aa, Influenza virus
GQRGRIDY

SEQ ID NO: 276745 - protein, 8 aa, Influenza virus
RGRIDYYW

SEQ ID NO: 276746 - protein, 8 aa, Influenza virus
GRIDYYWS

SEQ ID NO: 276747 - protein, 8 aa, Influenza virus
RIDYYWSV

SEQ ID NO: 276748 - protein, 8 aa, Influenza virus
IDYYWSVL

SEQ ID NO: 276749 - protein, 8 aa, Influenza virus
WSVLKPGE

SEQ ID NO: 276750 - protein, 8 aa, Influenza virus
SVLKPGET

SEQ ID NO: 276751 - protein, 8 aa, Influenza virus
VLKPGETL

SEQ ID NO: 276752 - protein, 8 aa, Influenza virus
LKPGETLN

SEQ ID NO: 276753 - protein, 8 aa, Influenza virus
KPGETLNV

SEQ ID NO: 276754 - protein, 8 aa, Influenza virus
PGETLNVE

SEQ ID NO: 276755 - protein, 8 aa, Influenza virus
GETLNVES

SEQ ID NO: 276756 - protein, 8 aa, Influenza virus
ETLNVESN

SEQ ID NO: 276757 - protein, 8 aa, Influenza virus
TLNVESNG

SEQ ID NO: 276758 - protein, 8 aa, Influenza virus
LNVESNGN

SEQ ID NO: 276759 - protein, 8 aa, Influenza virus
NVESNGNL

SEQ ID NO: 276760 - protein, 8 aa, Influenza virus
VESNGNLI

SEQ ID NO: 276761 - protein, 8 aa, Influenza virus
ESNGNLIA

SEQ ID NO: 276762 - protein, 8 aa, Influenza virus
SNGNLIAP

SEQ ID NO: 276763 - protein, 8 aa, Influenza virus
NGNLIAPW

SEQ ID NO: 276764 - protein, 8 aa, Influenza virus
GNLIAPWY

SEQ ID NO: 276765 - protein, 8 aa, Influenza virus
NLIAPWYA

SEQ ID NO: 276766 - protein, 8 aa, Influenza virus
LIAPWYAY

SEQ ID NO: 276767 - protein, 8 aa, Influenza virus
IAPWYAYK

SEQ ID NO: 276768 - protein, 8 aa, Influenza virus
NNNKGAVF

SEQ ID NO: 276769 - protein, 8 aa, Influenza virus
RTNKTFQN

SEQ ID NO: 276770 - protein, 8 aa, Influenza virus
TNKTFQNV

SEQ ID NO: 276771 - protein, 8 aa, Influenza virus
NKTFQNVS

SEQ ID NO: 276772 - protein, 8 aa, Influenza virus
KTFQNVSP

SEQ ID NO: 276773 - protein, 8 aa, Influenza virus
TFQNVSPL

SEQ ID NO: 276774 - protein, 8 aa, Influenza virus
FQNVSPLW

SEQ ID NO: 276775 - protein, 8 aa, Influenza virus
QNVSPLWI

SEQ ID NO: 276776 - protein, 8 aa, Influenza virus
NVSPLWIG

SEQ ID NO: 276777 - protein, 8 aa, Influenza virus
WIGECPKY

SEQ ID NO: 276778 - protein, 8 aa, Influenza virus
IGECPKYV

SEQ ID NO: 276779 - protein, 8 aa, Influenza virus
GECPKYVK

SEQ ID NO: 276780 - protein, 8 aa, Influenza virus
ECPKYVKS

SEQ ID NO: 276781 - protein, 8 aa, Influenza virus
SLRLATGL

SEQ ID NO: 276782 - protein, 8 aa, Influenza virus
LRLATGLR

SEQ ID NO: 276783 - protein, 8 aa, Influenza virus
RLATGLRN

SEQ ID NO: 276784 - protein, 8 aa, Influenza virus
LATGLRNV

SEQ ID NO: 276785 - protein, 8 aa, Influenza virus
ATGLRNVP

SEQ ID NO: 276786 - protein, 8 aa, Influenza virus
TGLRNVPQ

SEQ ID NO: 276787 - protein, 8 aa, Influenza virus
TRGLFGAI

SEQ ID NO: 276788 - protein, 8 aa, Influenza virus
RGLFGAIA

SEQ ID NO: 276789 - protein, 8 aa, Influenza virus
GLFGAIAG

SEQ ID NO: 276790 - protein, 8 aa, Influenza virus
LFGAIAGF

SEQ ID NO: 276791 - protein, 8 aa, Influenza virus
FGAIAGFI

SEQ ID NO: 276792 - protein, 8 aa, Influenza virus
GAIAGFIE

SEQ ID NO: 276793 - protein, 8 aa, Influenza virus
AIAGFIEG

SEQ ID NO: 276794 - protein, 8 aa, Influenza virus
IAGFIEGG

SEQ ID NO: 276795 - protein, 8 aa, Influenza virus
AGFIEGGW

SEQ ID NO: 276796 - protein, 8 aa, Influenza virus
GFIEGGWT

SEQ ID NO: 276797 - protein, 8 aa, Influenza virus
FIEGGWTG

SEQ ID NO: 276798 - protein, 8 aa, Influenza virus
IEGGWTGM

SEQ ID NO: 276799 - protein, 8 aa, Influenza virus
EGGWTGMI

SEQ ID NO: 276800 - protein, 8 aa, Influenza virus
GGWTGMID

SEQ ID NO: 276801 - protein, 8 aa, Influenza virus
GWTGMIDG

SEQ ID NO: 276802 - protein, 8 aa, Influenza virus
WTGMIDGW

SEQ ID NO: 276803 - protein, 8 aa, Influenza virus
TGMIDGWY

SEQ ID NO: 276804 - protein, 8 aa, Influenza virus
GMIDGWYG

SEQ ID NO: 276805 - protein, 8 aa, Influenza virus
MIDGWYGY

SEQ ID NO: 276806 - protein, 8 aa, Influenza virus
IDGWYGYH

SEQ ID NO: 276807 - protein, 8 aa, Influenza virus
DGWYGYHH

SEQ ID NO: 276808 - protein, 8 aa, Influenza virus
GWYGYHHE

SEQ ID NO: 276809 - protein, 8 aa, Influenza virus
WYGYHHEN

SEQ ID NO: 276810 - protein, 8 aa, Influenza virus
YGYHHENS

SEQ ID NO: 276811 - protein, 8 aa, Influenza virus
GYHHENSQ

SEQ ID NO: 276812 - protein, 8 aa, Influenza virus
YHHENSQG

SEQ ID NO: 276813 - protein, 8 aa, Influenza virus
HHENSQGS

SEQ ID NO: 276814 - protein, 8 aa, Influenza virus
HENSQGSG

SEQ ID NO: 276815 - protein, 8 aa, Influenza virus
ENSQGSGY

SEQ ID NO: 276816 - protein, 8 aa, Influenza virus
NSQGSGYA

SEQ ID NO: 276817 - protein, 8 aa, Influenza virus
SQGSGYAA

SEQ ID NO: 276818 - protein, 8 aa, Influenza virus
QGSGYAAD

SEQ ID NO: 276819 - protein, 8 aa, Influenza virus
GSGYAADK

SEQ ID NO: 276820 - protein, 8 aa, Influenza virus
SGYAADKE

SEQ ID NO: 276821 - protein, 8 aa, Influenza virus
GYAADKES

SEQ ID NO: 276822 - protein, 8 aa, Influenza virus
YAADKEST

SEQ ID NO: 276823 - protein, 8 aa, Influenza virus
AADKESTQ

SEQ ID NO: 276824 - protein, 8 aa, Influenza virus
ADKESTQK

SEQ ID NO: 276825 - protein, 8 aa, Influenza virus
DKESTQKA

SEQ ID NO: 276826 - protein, 8 aa, Influenza virus
ESTQKAID

SEQ ID NO: 276827 - protein, 8 aa, Influenza virus
ITNKVNSI

SEQ ID NO: 276828 - protein, 8 aa, Influenza virus
TNKVNSII

SEQ ID NO: 276829 - protein, 8 aa, Influenza virus
NSIIDKMN

SEQ ID NO: 276830 - protein, 8 aa, Influenza virus
SIIDKMNT

SEQ ID NO: 276831 - protein, 8 aa, Influenza virus
IIDKMNTQ

SEQ ID NO: 276832 - protein, 8 aa, Influenza virus
IDKMNTQF

SEQ ID NO: 276833 - protein, 8 aa, Influenza virus
DKMNTQFE

SEQ ID NO: 276834 - protein, 8 aa, Influenza virus
KMNTQFEA

SEQ ID NO: 276835 - protein, 8 aa, Influenza virus
MNTQFEAV

SEQ ID NO: 276836 - protein, 8 aa, Influenza virus
HEFSNLER

SEQ ID NO: 276837 - protein, 8 aa, Influenza virus
EFSNLERR

SEQ ID NO: 276838 - protein, 8 aa, Influenza virus
FSNLERRI

SEQ ID NO: 276839 - protein, 8 aa, Influenza virus
NLNKRMED

SEQ ID NO: 276840 - protein, 8 aa, Influenza virus
LNKRMEDG

SEQ ID NO: 276841 - protein, 8 aa, Influenza virus
NKRMEDGF

SEQ ID NO: 276842 - protein, 8 aa, Influenza virus
KRMEDGFL

SEQ ID NO: 276843 - protein, 8 aa, Influenza virus
DGFLDVWT

SEQ ID NO: 276844 - protein, 8 aa, Influenza virus
GFLDVWTY

SEQ ID NO: 276845 - protein, 8 aa, Influenza virus
FLDVWTYN

SEQ ID NO: 276846 - protein, 8 aa, Influenza virus
LDVWTYNA

SEQ ID NO: 276847 - protein, 8 aa, Influenza virus
DVWTYNAE

SEQ ID NO: 276848 - protein, 8 aa, Influenza virus
VWTYNAEL

SEQ ID NO: 276849 - protein, 8 aa, Influenza virus
WTYNAELL

SEQ ID NO: 276850 - protein, 8 aa, Influenza virus
TYNAELLV

SEQ ID NO: 276851 - protein, 8 aa, Influenza virus
YNAELLVL

SEQ ID NO: 276852 - protein, 8 aa, Influenza virus
NAELLVLL

SEQ ID NO: 276853 - protein, 8 aa, Influenza virus
AELLVLLE

SEQ ID NO: 276854 - protein, 8 aa, Influenza virus
ELLVLLEN

SEQ ID NO: 276855 - protein, 8 aa, Influenza virus
LLVLLENE

SEQ ID NO: 276856 - protein, 8 aa, Influenza virus
LVLLENER

SEQ ID NO: 276857 - protein, 8 aa, Influenza virus
VLLENERT

SEQ ID NO: 276858 - protein, 8 aa, Influenza virus
LLENERTL

SEQ ID NO: 276859 - protein, 8 aa, Influenza virus
LENERTLD

SEQ ID NO: 276860 - protein, 8 aa, Influenza virus
ENERTLDL

SEQ ID NO: 276861 - protein, 8 aa, Influenza virus
NERTLDLH

SEQ ID NO: 276862 - protein, 8 aa, Influenza virus
ERTLDLHD

SEQ ID NO: 276863 - protein, 8 aa, Influenza virus
RTLDLHDA

SEQ ID NO: 276864 - protein, 8 aa, Influenza virus
TLDLHDAN

SEQ ID NO: 276865 - protein, 8 aa, Influenza virus
LDLHDANV

SEQ ID NO: 276866 - protein, 8 aa, Influenza virus
DLHDANVK

SEQ ID NO: 276867 - protein, 8 aa, Influenza virus
HDANVKNL

SEQ ID NO: 276868 - protein, 8 aa, Influenza virus
VKSQLRDN

SEQ ID NO: 276869 - protein, 8 aa, Influenza virus
KSQLRDNA

SEQ ID NO: 276870 - protein, 8 aa, Influenza virus
SQLRDNAN

SEQ ID NO: 276871 - protein, 8 aa, Influenza virus
QLRDNAND

SEQ ID NO: 276872 - protein, 8 aa, Influenza virus
LRDNANDL

SEQ ID NO: 276873 - protein, 8 aa, Influenza virus
RDNANDLG

SEQ ID NO: 276874 - protein, 8 aa, Influenza virus
DNANDLGN

SEQ ID NO: 276875 - protein, 8 aa, Influenza virus
NANDLGNG

SEQ ID NO: 276876 - protein, 8 aa, Influenza virus
ANDLGNGC

SEQ ID NO: 276877 - protein, 8 aa, Influenza virus
NDLGNGCF

SEQ ID NO: 276878 - protein, 8 aa, Influenza virus
DLGNGCFE

SEQ ID NO: 276879 - protein, 8 aa, Influenza virus
LGNGCFEF

SEQ ID NO: 276880 - protein, 8 aa, Influenza virus
GNGCFEFW

SEQ ID NO: 276881 - protein, 8 aa, Influenza virus
NGCFEFWH

SEQ ID NO: 276882 - protein, 8 aa, Influenza virus
GCFEFWHK

SEQ ID NO: 276883 - protein, 8 aa, Influenza virus
CFEFWHKC

SEQ ID NO: 276884 - protein, 8 aa, Influenza virus
FEFWHKCD

SEQ ID NO: 276885 - protein, 8 aa, Influenza virus
EFWHKCDN

SEQ ID NO: 276886 - protein, 8 aa, Influenza virus
FWHKCDNE

SEQ ID NO: 276887 - protein, 8 aa, Influenza virus
WHKCDNEC

SEQ ID NO: 276888 - protein, 8 aa, Influenza virus
SVKNGTYD

SEQ ID NO: 276889 - protein, 8 aa, Influenza virus
VKNGTYDY

SEQ ID NO: 276890 - protein, 8 aa, Influenza virus
KNGTYDYP

SEQ ID NO: 276891 - protein, 8 aa, Influenza virus
NGTYDYPK

SEQ ID NO: 276892 - protein, 8 aa, Influenza virus
GTYDYPKY

SEQ ID NO: 276893 - protein, 8 aa, Influenza virus
TYDYPKYQ

SEQ ID NO: 276894 - protein, 8 aa, Influenza virus
LGVYQILA

SEQ ID NO: 276895 - protein, 8 aa, Influenza virus
GVYQILAI

SEQ ID NO: 276896 - protein, 8 aa, Influenza virus
VYQILAIY

SEQ ID NO: 276897 - protein, 8 aa, Influenza virus
YQILAIYS

SEQ ID NO: 276898 - protein, 8 aa, Influenza virus
QILAIYST

SEQ ID NO: 276899 - protein, 8 aa, Influenza virus
ILAIYSTV

SEQ ID NO: 276900 - protein, 8 aa, Influenza virus
LAIYSTVS

SEQ ID NO: 276901 - protein, 8 aa, Influenza virus
AIYSTVSS

SEQ ID NO: 276902 - protein, 8 aa, Influenza virus
IYSTVSSS

SEQ ID NO: 276903 - protein, 8 aa, Influenza virus
YSTVSSSL

SEQ ID NO: 276904 - protein, 8 aa, Influenza virus
STVSSSLV

SEQ ID NO: 276905 - protein, 8 aa, Influenza virus
TVSSSLVL

SEQ ID NO: 276906 - protein, 8 aa, Influenza virus
VSSSLVLV

SEQ ID NO: 276907 - protein, 8 aa, Influenza virus
SSSLVLVG

SEQ ID NO: 276908 - protein, 8 aa, Influenza virus
SSLVLVGL

SEQ ID NO: 276909 - protein, 8 aa, Influenza virus
SLVLVGLI

SEQ ID NO: 276910 - protein, 8 aa, Influenza virus
WMCSNGSM

SEQ ID NO: 276911 - protein, 8 aa, Influenza virus
MCSNGSMQ

SEQ ID NO: 276912 - protein, 8 aa, Influenza virus
CSNGSMQC

SEQ ID NO: 276913 - protein, 8 aa, Influenza virus
SNGSMQCR

SEQ ID NO: 276914 - protein, 8 aa, Influenza virus
NGSMQCRI

SEQ ID NO: 276915 - protein, 8 aa, Influenza virus
GSMQCRIC

SEQ ID NO: 276916 - protein, 8 aa, Influenza virus
SMQCRICI

SEQ ID NO: 276917 - protein, 8 aa, Influenza virus
MQCRICIG

SEQ ID NO: 276918 - protein, 8 aa, Influenza virus
QCRICIGS

SEQ ID NO: 276919 - protein, 8 aa, Influenza virus
SKSRGYKM

SEQ ID NO: 276920 - protein, 8 aa, Influenza virus
KSRGYKMN

SEQ ID NO: 276921 - protein, 8 aa, Influenza virus
SRGYKMNT

SEQ ID NO: 276922 - protein, 8 aa, Influenza virus
RGYKMNTQ

SEQ ID NO: 276923 - protein, 8 aa, Influenza virus
GYKMNTQI

SEQ ID NO: 276924 - protein, 8 aa, Influenza virus
YKMNTQIL

SEQ ID NO: 276925 - protein, 8 aa, Influenza virus
GCDHSDNA

SEQ ID NO: 276926 - protein, 8 aa, Influenza virus
CDHSDNAD

SEQ ID NO: 276927 - protein, 8 aa, Influenza virus
DHSDNADK

SEQ ID NO: 276928 - protein, 8 aa, Influenza virus
HSDNADKI

SEQ ID NO: 276929 - protein, 8 aa, Influenza virus
SDNADKIC

SEQ ID NO: 276930 - protein, 8 aa, Influenza virus
DNADKICL

SEQ ID NO: 276931 - protein, 8 aa, Influenza virus
GDKICLGH

SEQ ID NO: 276932 - protein, 8 aa, Influenza virus
DKICLGHH

SEQ ID NO: 276933 - protein, 8 aa, Influenza virus
KICLGHHA

SEQ ID NO: 276934 - protein, 8 aa, Influenza virus
ICLGHHAV

SEQ ID NO: 276935 - protein, 8 aa, Influenza virus
NGTKVNTL

SEQ ID NO: 276936 - protein, 8 aa, Influenza virus
GTKVNTLT

SEQ ID NO: 276937 - protein, 8 aa, Influenza virus
TLTERGIE

SEQ ID NO: 276938 - protein, 8 aa, Influenza virus
LTERGIEV

SEQ ID NO: 276939 - protein, 8 aa, Influenza virus
TERGIEVV

SEQ ID NO: 276940 - protein, 8 aa, Influenza virus
ERGIEVVN

SEQ ID NO: 276941 - protein, 8 aa, Influenza virus
RGIEVVNA

SEQ ID NO: 276942 - protein, 8 aa, Influenza virus
GIEVVNAT

SEQ ID NO: 276943 - protein, 8 aa, Influenza virus
IEVVNATE

SEQ ID NO: 276944 - protein, 8 aa, Influenza virus
EVVNATET

SEQ ID NO: 276945 - protein, 8 aa, Influenza virus
VVNATETV

SEQ ID NO: 276946 - protein, 8 aa, Influenza virus
VNATETVE

SEQ ID NO: 276947 - protein, 8 aa, Influenza virus
NATETVET

SEQ ID NO: 276948 - protein, 8 aa, Influenza virus
GPPQCDQF

SEQ ID NO: 276949 - protein, 8 aa, Influenza virus
PPQCDQFL

SEQ ID NO: 276950 - protein, 8 aa, Influenza virus
PQCDQFLE

SEQ ID NO: 276951 - protein, 8 aa, Influenza virus
QCDQFLEF

SEQ ID NO: 276952 - protein, 8 aa, Influenza virus
DVCYPGKF

SEQ ID NO: 276953 - protein, 8 aa, Influenza virus
GSSFYAEM

SEQ ID NO: 276954 - protein, 8 aa, Influenza virus
SSSFYAEM

SEQ ID NO: 276955 - protein, 8 aa, Influenza virus
SSFYAEMK

SEQ ID NO: 276956 - protein, 8 aa, Influenza virus
SFYAEMKW

SEQ ID NO: 276957 - protein, 8 aa, Influenza virus
FYAEMKWL

SEQ ID NO: 276958 - protein, 8 aa, Influenza virus
YAEMKWLL

SEQ ID NO: 276959 - protein, 8 aa, Influenza virus
AEMKWLLS

SEQ ID NO: 276960 - protein, 8 aa, Influenza virus
EMKWLLSN

SEQ ID NO: 276961 - protein, 8 aa, Influenza virus
ALIIWGVH

SEQ ID NO: 276962 - protein, 8 aa, Influenza virus
LIIWGVHH

SEQ ID NO: 276963 - protein, 8 aa, Influenza virus
VNGQSGRI

SEQ ID NO: 276964 - protein, 8 aa, Influenza virus
NGQSGRID

SEQ ID NO: 276965 - protein, 8 aa, Influenza virus
GQSGRIDF

SEQ ID NO: 276966 - protein, 8 aa, Influenza virus
QSGRIDFH

SEQ ID NO: 276967 - protein, 8 aa, Influenza virus
SGRIDFHW

SEQ ID NO: 276968 - protein, 8 aa, Influenza virus
GRIDFHWL

SEQ ID NO: 276969 - protein, 8 aa, Influenza virus
TFTFNGAF

SEQ ID NO: 276970 - protein, 8 aa, Influenza virus
FTFNGAFI

SEQ ID NO: 276971 - protein, 8 aa, Influenza virus
TFNGAFIA

SEQ ID NO: 276972 - protein, 8 aa, Influenza virus
FNGAFIAP

SEQ ID NO: 276973 - protein, 8 aa, Influenza virus
NGAFIAPD

SEQ ID NO: 276974 - protein, 8 aa, Influenza virus
GAFIAPDR

SEQ ID NO: 276975 - protein, 8 aa, Influenza virus
AFIAPDRA

SEQ ID NO: 276976 - protein, 8 aa, Influenza virus
FIAPDRAS

SEQ ID NO: 276977 - protein, 8 aa, Influenza virus
IAPDRASF

SEQ ID NO: 276978 - protein, 8 aa, Influenza virus
LPFQNINS

SEQ ID NO: 276979 - protein, 8 aa, Influenza virus
VGKCPRYV

SEQ ID NO: 276980 - protein, 8 aa, Influenza virus
GKCPRYVK

SEQ ID NO: 276981 - protein, 8 aa, Influenza virus
KCPRYVKQ

SEQ ID NO: 276982 - protein, 8 aa, Influenza virus
SLLLATGM

SEQ ID NO: 276983 - protein, 8 aa, Influenza virus
LLLATGMR

SEQ ID NO: 276984 - protein, 8 aa, Influenza virus
LLATGMRN

SEQ ID NO: 276985 - protein, 8 aa, Influenza virus
LATGMRNV

SEQ ID NO: 276986 - protein, 8 aa, Influenza virus
ATGMRNVP

SEQ ID NO: 276987 - protein, 8 aa, Influenza virus
TGMRNVPE

SEQ ID NO: 276988 - protein, 8 aa, Influenza virus
THKQLTHH

SEQ ID NO: 276989 - protein, 8 aa, Influenza virus
HKQLTHHM

SEQ ID NO: 276990 - protein, 8 aa, Influenza virus
KQLTHHMR

SEQ ID NO: 276991 - protein, 8 aa, Influenza virus
QLTHHMRK

SEQ ID NO: 276992 - protein, 8 aa, Influenza virus
LTHHMRKK

SEQ ID NO: 276993 - protein, 8 aa, Influenza virus
THHMRKKR

SEQ ID NO: 276994 - protein, 8 aa, Influenza virus
HHMRKKRG

SEQ ID NO: 276995 - protein, 8 aa, Influenza virus
HMRKKRGL

SEQ ID NO: 276996 - protein, 8 aa, Influenza virus
MRKKRGLF

SEQ ID NO: 276997 - protein, 8 aa, Influenza virus
RKKRGLFG

SEQ ID NO: 276998 - protein, 8 aa, Influenza virus
RMTRGLFG

SEQ ID NO: 276999 - protein, 8 aa, Influenza virus
MTRGLFGA

SEQ ID NO: 277000 - protein, 8 aa, Influenza virus
PRGLFGAI

SEQ ID NO: 277001 - protein, 8 aa, Influenza virus
TKPRPRRG

SEQ ID NO: 277002 - protein, 8 aa, Influenza virus
KPRPRRGL

SEQ ID NO: 277003 - protein, 8 aa, Influenza virus
PRPRRGLF

SEQ ID NO: 277004 - protein, 8 aa, Influenza virus
RPRRGLFG

SEQ ID NO: 277005 - protein, 8 aa, Influenza virus
PRRGLFGA

SEQ ID NO: 277006 - protein, 8 aa, Influenza virus
RRGLFGAI

SEQ ID NO: 277007 - protein, 8 aa, Influenza virus
RGLFGAIA

SEQ ID NO: 277008 - protein, 8 aa, Influenza virus
GLFGAIAG

SEQ ID NO: 277009 - protein, 8 aa, Influenza virus
LFGAIAGF

SEQ ID NO: 277010 - protein, 8 aa, Influenza virus
FGAIAGFI

SEQ ID NO: 277011 - protein, 8 aa, Influenza virus
GAIAGFIE

SEQ ID NO: 277012 - protein, 8 aa, Influenza virus
AIAGFIEN

SEQ ID NO: 277013 - protein, 8 aa, Influenza virus
IAGFIENG

SEQ ID NO: 277014 - protein, 8 aa, Influenza virus
AGFIENGW

SEQ ID NO: 277015 - protein, 8 aa, Influenza virus
GFIENGWE

SEQ ID NO: 277016 - protein, 8 aa, Influenza virus
FIENGWEG

SEQ ID NO: 277017 - protein, 8 aa, Influenza virus
IENGWEGL

SEQ ID NO: 277018 - protein, 8 aa, Influenza virus
ENGWEGLI

SEQ ID NO: 277019 - protein, 8 aa, Influenza virus
NGWEGLID

SEQ ID NO: 277020 - protein, 8 aa, Influenza virus
GWEGLIDG

SEQ ID NO: 277021 - protein, 8 aa, Influenza virus
WEGLIDGW

SEQ ID NO: 277022 - protein, 8 aa, Influenza virus
EGLIDGWY

SEQ ID NO: 277023 - protein, 8 aa, Influenza virus
GLIDGWYG

SEQ ID NO: 277024 - protein, 8 aa, Influenza virus
LIDGWYGF

SEQ ID NO: 277025 - protein, 8 aa, Influenza virus
IDGWYGFR

SEQ ID NO: 277026 - protein, 8 aa, Influenza virus
DGWYGFRH

SEQ ID NO: 277027 - protein, 8 aa, Influenza virus
GWYGFRHQ

SEQ ID NO: 277028 - protein, 8 aa, Influenza virus
WYGFRHQN

SEQ ID NO: 277029 - protein, 8 aa, Influenza virus
YGFRHQNA

SEQ ID NO: 277030 - protein, 8 aa, Influenza virus
GFRHQNAQ

SEQ ID NO: 277031 - protein, 8 aa, Influenza virus
FRHQNAQG

SEQ ID NO: 277032 - protein, 8 aa, Influenza virus
RHQNAQGE

SEQ ID NO: 277033 - protein, 8 aa, Influenza virus
HQNAQGEG

SEQ ID NO: 277034 - protein, 8 aa, Influenza virus
QNAQGEGT

SEQ ID NO: 277035 - protein, 8 aa, Influenza virus
NAQGEGTA

SEQ ID NO: 277036 - protein, 8 aa, Influenza virus
AQGEGTAA

SEQ ID NO: 277037 - protein, 8 aa, Influenza virus
QGEGTAAD

SEQ ID NO: 277038 - protein, 8 aa, Influenza virus
GEGTAADY

SEQ ID NO: 277039 - protein, 8 aa, Influenza virus
EGTAADYK

SEQ ID NO: 277040 - protein, 8 aa, Influenza virus
GTAADYKS

SEQ ID NO: 277041 - protein, 8 aa, Influenza virus
TAADYKST

SEQ ID NO: 277042 - protein, 8 aa, Influenza virus
AADYKSTQ

SEQ ID NO: 277043 - protein, 8 aa, Influenza virus
ADYKSTQS

SEQ ID NO: 277044 - protein, 8 aa, Influenza virus
DYKSTQSA

SEQ ID NO: 277045 - protein, 8 aa, Influenza virus
YKSTQSAI

SEQ ID NO: 277046 - protein, 8 aa, Influenza virus
KSTQSAID

SEQ ID NO: 277047 - protein, 8 aa, Influenza virus
STQSAIDQ

SEQ ID NO: 277048 - protein, 8 aa, Influenza virus
TQSAIDQI

SEQ ID NO: 277049 - protein, 8 aa, Influenza virus
QSAIDQIT

SEQ ID NO: 277050 - protein, 8 aa, Influenza virus
SAIDQITG

SEQ ID NO: 277051 - protein, 8 aa, Influenza virus
AIDQITGK

SEQ ID NO: 277052 - protein, 8 aa, Influenza virus
IDQITGKL

SEQ ID NO: 277053 - protein, 8 aa, Influenza virus
DQITGKLN

SEQ ID NO: 277054 - protein, 8 aa, Influenza virus
QITGKLNR

SEQ ID NO: 277055 - protein, 8 aa, Influenza virus
ITGKLNRL

SEQ ID NO: 277056 - protein, 8 aa, Influenza virus
TGKLNRLI

SEQ ID NO: 277057 - protein, 8 aa, Influenza virus
IEKTNQQF

SEQ ID NO: 277058 - protein, 8 aa, Influenza virus
KTNQQFEL

SEQ ID NO: 277059 - protein, 8 aa, Influenza virus
TNQQFELI

SEQ ID NO: 277060 - protein, 8 aa, Influenza virus
EIEQQIGN

SEQ ID NO: 277061 - protein, 8 aa, Influenza virus
EQQIGNVI

SEQ ID NO: 277062 - protein, 8 aa, Influenza virus
QQIGNVIN

SEQ ID NO: 277063 - protein, 8 aa, Influenza virus
QIGNVINW

SEQ ID NO: 277064 - protein, 8 aa, Influenza virus
IGNVINWT

SEQ ID NO: 277065 - protein, 8 aa, Influenza virus
GNVINWTR

SEQ ID NO: 277066 - protein, 8 aa, Influenza virus
NVINWTRD

SEQ ID NO: 277067 - protein, 8 aa, Influenza virus
VINWTRDS

SEQ ID NO: 277068 - protein, 8 aa, Influenza virus
TEVWSYNA

SEQ ID NO: 277069 - protein, 8 aa, Influenza virus
EVWSYNAE

SEQ ID NO: 277070 - protein, 8 aa, Influenza virus
WSYNAELL

SEQ ID NO: 277071 - protein, 8 aa, Influenza virus
SYNAELLV

SEQ ID NO: 277072 - protein, 8 aa, Influenza virus
YNAELLVA

SEQ ID NO: 277073 - protein, 8 aa, Influenza virus
AELLVAME

SEQ ID NO: 277074 - protein, 8 aa, Influenza virus
ELLVAMEN

SEQ ID NO: 277075 - protein, 8 aa, Influenza virus
LLVAMENQ

SEQ ID NO: 277076 - protein, 8 aa, Influenza virus
LVAMENQH

SEQ ID NO: 277077 - protein, 8 aa, Influenza virus
VAMENQHT

SEQ ID NO: 277078 - protein, 8 aa, Influenza virus
AMENQHTI

SEQ ID NO: 277079 - protein, 8 aa, Influenza virus
MENQHTID

SEQ ID NO: 277080 - protein, 8 aa, Influenza virus
ENQHTIDL

SEQ ID NO: 277081 - protein, 8 aa, Influenza virus
NQHTIDLA

SEQ ID NO: 277082 - protein, 8 aa, Influenza virus
QHTIDLAD

SEQ ID NO: 277083 - protein, 8 aa, Influenza virus
HTIDLADS

SEQ ID NO: 277084 - protein, 8 aa, Influenza virus
TIDLADSE

SEQ ID NO: 277085 - protein, 8 aa, Influenza virus
IDLADSEM

SEQ ID NO: 277086 - protein, 8 aa, Influenza virus
DSEMNKLY

SEQ ID NO: 277087 - protein, 8 aa, Influenza virus
SEMNKLYE

SEQ ID NO: 277088 - protein, 8 aa, Influenza virus
EMNKLYER

SEQ ID NO: 277089 - protein, 8 aa, Influenza virus
MNKLYERV

SEQ ID NO: 277090 - protein, 8 aa, Influenza virus
KLYERVRK

SEQ ID NO: 277091 - protein, 8 aa, Influenza virus
VRKQLREN

SEQ ID NO: 277092 - protein, 8 aa, Influenza virus
RKQLRENA

SEQ ID NO: 277093 - protein, 8 aa, Influenza virus
KQLRENAE

SEQ ID NO: 277094 - protein, 8 aa, Influenza virus
QLRENAEE

SEQ ID NO: 277095 - protein, 8 aa, Influenza virus
LRENAEED

SEQ ID NO: 277096 - protein, 8 aa, Influenza virus
RENAEEDG

SEQ ID NO: 277097 - protein, 8 aa, Influenza virus
ENAEEDGT

SEQ ID NO: 277098 - protein, 8 aa, Influenza virus
NAEEDGTG

SEQ ID NO: 277099 - protein, 8 aa, Influenza virus
AEEDGTGC

SEQ ID NO: 277100 - protein, 8 aa, Influenza virus
EEDGTGCF

SEQ ID NO: 277101 - protein, 8 aa, Influenza virus
EDGTGCFE

SEQ ID NO: 277102 - protein, 8 aa, Influenza virus
DGTGCFEI

SEQ ID NO: 277103 - protein, 8 aa, Influenza virus
GTGCFEIF

SEQ ID NO: 277104 - protein, 8 aa, Influenza virus
TGCFEIFH

SEQ ID NO: 277105 - protein, 8 aa, Influenza virus
GCFEIFHK

SEQ ID NO: 277106 - protein, 8 aa, Influenza virus
CFEIFHKC

SEQ ID NO: 277107 - protein, 8 aa, Influenza virus
FEIFHKCD

SEQ ID NO: 277108 - protein, 8 aa, Influenza virus
EIFHKCDD

SEQ ID NO: 277109 - protein, 8 aa, Influenza virus
CMESIRNN

SEQ ID NO: 277110 - protein, 8 aa, Influenza virus
MESIRNNT

SEQ ID NO: 277111 - protein, 8 aa, Influenza virus
ESIRNNTY

SEQ ID NO: 277112 - protein, 8 aa, Influenza virus
SIRNNTYD

SEQ ID NO: 277113 - protein, 8 aa, Influenza virus
IRNNTYDH

SEQ ID NO: 277114 - protein, 8 aa, Influenza virus
YRTESLQN

SEQ ID NO: 277115 - protein, 8 aa, Influenza virus
RTESLQNR

SEQ ID NO: 277116 - protein, 8 aa, Influenza virus
VKLSSGYK

SEQ ID NO: 277117 - protein, 8 aa, Influenza virus
KLSSGYKD

SEQ ID NO: 277118 - protein, 8 aa, Influenza virus
SSGYKDII

SEQ ID NO: 277119 - protein, 8 aa, Influenza virus
SGYKDIIL

SEQ ID NO: 277120 - protein, 8 aa, Influenza virus
GYKDIILW

SEQ ID NO: 277121 - protein, 8 aa, Influenza virus
YKDIILWF

SEQ ID NO: 277122 - protein, 8 aa, Influenza virus
KDIILWFS

SEQ ID NO: 277123 - protein, 8 aa, Influenza virus
DIILWFSF

SEQ ID NO: 277124 - protein, 8 aa, Influenza virus
IILWFSFG

SEQ ID NO: 277125 - protein, 8 aa, Influenza virus
ILWFSFGA

SEQ ID NO: 277126 - protein, 8 aa, Influenza virus
LWFSFGAS

SEQ ID NO: 277127 - protein, 8 aa, Influenza virus
WFSFGASC

SEQ ID NO: 277128 - protein, 8 aa, Influenza virus
FSFGASCF

SEQ ID NO: 277129 - protein, 8 aa, Influenza virus
SFGASCFL

SEQ ID NO: 277130 - protein, 8 aa, Influenza virus
FGASCFLL

SEQ ID NO: 277131 - protein, 8 aa, Influenza virus
GASCFLLL

SEQ ID NO: 277132 - protein, 8 aa, Influenza virus
ASCFLLLA

SEQ ID NO: 277133 - protein, 8 aa, Influenza virus
FICIKNGN

SEQ ID NO: 277134 - protein, 8 aa, Influenza virus
ICIKNGNM

SEQ ID NO: 277135 - protein, 8 aa, Influenza virus
CIKNGNMQ

SEQ ID NO: 277136 - protein, 8 aa, Influenza virus
KNGNMRCT

SEQ ID NO: 277137 - protein, 8 aa, Influenza virus
NGNMRCTI

SEQ ID NO: 277138 - protein, 8 aa, Influenza virus
GNMRCTIC

SEQ ID NO: 277139 - protein, 8 aa, Influenza virus
NMRCTICI

SEQ ID NO: 277140 - protein, 8 aa, Influenza virus
CSALFVYS

SEQ ID NO: 277141 - protein, 8 aa, Influenza virus
SALFVYSL

SEQ ID NO: 277142 - protein, 8 aa, Influenza virus
ALFVYSLR

SEQ ID NO: 277143 - protein, 8 aa, Influenza virus
LFVYSLRK

SEQ ID NO: 277144 - protein, 8 aa, Influenza virus
SKSRGYKM

SEQ ID NO: 277145 - protein, 8 aa, Influenza virus
KSRGYKMN

SEQ ID NO: 277146 - protein, 8 aa, Influenza virus
SRGYKMNT

SEQ ID NO: 277147 - protein, 8 aa, Influenza virus
RGYKMNTQ

SEQ ID NO: 277148 - protein, 8 aa, Influenza virus
GYKMNTQI

SEQ ID NO: 277149 - protein, 8 aa, Influenza virus
YKMNTQIL

SEQ ID NO: 277150 - protein, 8 aa, Influenza virus
KMNTQILI

SEQ ID NO: 277151 - protein, 8 aa, Influenza virus
GAKGDKIC

SEQ ID NO: 277152 - protein, 8 aa, Influenza virus
AKGDKICL

SEQ ID NO: 277153 - protein, 8 aa, Influenza virus
KGDKICLG

SEQ ID NO: 277154 - protein, 8 aa, Influenza virus
GDKICLGH

SEQ ID NO: 277155 - protein, 8 aa, Influenza virus
DKICLGHH

SEQ ID NO: 277156 - protein, 8 aa, Influenza virus
KICLGHHA

SEQ ID NO: 277157 - protein, 8 aa, Influenza virus
ICLGHHAV

SEQ ID NO: 277158 - protein, 8 aa, Influenza virus
CLGHHAVA

SEQ ID NO: 277159 - protein, 8 aa, Influenza virus
LGHHAVAN

SEQ ID NO: 277160 - protein, 8 aa, Influenza virus
GHHAVANG

SEQ ID NO: 277161 - protein, 8 aa, Influenza virus
HHAVANGT

SEQ ID NO: 277162 - protein, 8 aa, Influenza virus
HAVANGTK

SEQ ID NO: 277163 - protein, 8 aa, Influenza virus
AVANGTKV

SEQ ID NO: 277164 - protein, 8 aa, Influenza virus
VANGTKVN

SEQ ID NO: 277165 - protein, 8 aa, Influenza virus
ANGTKVNT

SEQ ID NO: 277166 - protein, 8 aa, Influenza virus
NGTKVNTL

SEQ ID NO: 277167 - protein, 8 aa, Influenza virus
GTKVNTLT

SEQ ID NO: 277168 - protein, 8 aa, Influenza virus
TKVNTLTE

SEQ ID NO: 277169 - protein, 8 aa, Influenza virus
KVNTLTER

SEQ ID NO: 277170 - protein, 8 aa, Influenza virus
VNTLTERG

SEQ ID NO: 277171 - protein, 8 aa, Influenza virus
NTLTERGI

SEQ ID NO: 277172 - protein, 8 aa, Influenza virus
TLTERGIE

SEQ ID NO: 277173 - protein, 8 aa, Influenza virus
LTERGIEV

SEQ ID NO: 277174 - protein, 8 aa, Influenza virus
TERGIEVV

SEQ ID NO: 277175 - protein, 8 aa, Influenza virus
ERGIEVVN

SEQ ID NO: 277176 - protein, 8 aa, Influenza virus
RGIEVVNA

SEQ ID NO: 277177 - protein, 8 aa, Influenza virus
GIEVVNAT

SEQ ID NO: 277178 - protein, 8 aa, Influenza virus
IEVVNATE

SEQ ID NO: 277179 - protein, 8 aa, Influenza virus
EVVNATET

SEQ ID NO: 277180 - protein, 8 aa, Influenza virus
VVNATETV

SEQ ID NO: 277181 - protein, 8 aa, Influenza virus
VNATETVE

SEQ ID NO: 277182 - protein, 8 aa, Influenza virus
NATETVET

SEQ ID NO: 277183 - protein, 8 aa, Influenza virus
ATETVETA

SEQ ID NO: 277184 - protein, 8 aa, Influenza virus
DLGQCGLL

SEQ ID NO: 277185 - protein, 8 aa, Influenza virus
LGQCGLLG

SEQ ID NO: 277186 - protein, 8 aa, Influenza virus
GQCGLLGT

SEQ ID NO: 277187 - protein, 8 aa, Influenza virus
QCGLLGTL

SEQ ID NO: 277188 - protein, 8 aa, Influenza virus
CGLLGTLI

SEQ ID NO: 277189 - protein, 8 aa, Influenza virus
GLLGTLIG

SEQ ID NO: 277190 - protein, 8 aa, Influenza virus
LLGTLIGP

SEQ ID NO: 277191 - protein, 8 aa, Influenza virus
LGTLIGPP

SEQ ID NO: 277192 - protein, 8 aa, Influenza virus
LIGPPQCD

SEQ ID NO: 277193 - protein, 8 aa, Influenza virus
IGPPQCDQ

SEQ ID NO: 277194 - protein, 8 aa, Influenza virus
GPPQCDQF

SEQ ID NO: 277195 - protein, 8 aa, Influenza virus
PPQCDQFL

SEQ ID NO: 277196 - protein, 8 aa, Influenza virus
PQCDQFLE

SEQ ID NO: 277197 - protein, 8 aa, Influenza virus
QCDQFLEF

SEQ ID NO: 277198 - protein, 8 aa, Influenza virus
CDQFLEFS

SEQ ID NO: 277199 - protein, 8 aa, Influenza virus
SDLIIERR

SEQ ID NO: 277200 - protein, 8 aa, Influenza virus
DLIIERRE

SEQ ID NO: 277201 - protein, 8 aa, Influenza virus
LIIERREG

SEQ ID NO: 277202 - protein, 8 aa, Influenza virus
IIERREGT

SEQ ID NO: 277203 - protein, 8 aa, Influenza virus
IERREGTD

SEQ ID NO: 277204 - protein, 8 aa, Influenza virus
EGTDVCYP

SEQ ID NO: 277205 - protein, 8 aa, Influenza virus
GTDVCYPG

SEQ ID NO: 277206 - protein, 8 aa, Influenza virus
DVCYPGKF

SEQ ID NO: 277207 - protein, 8 aa, Influenza virus
CYPGKFTN

SEQ ID NO: 277208 - protein, 8 aa, Influenza virus
YPGKFTNE

SEQ ID NO: 277209 - protein, 8 aa, Influenza virus
PGKFTNEE

SEQ ID NO: 277210 - protein, 8 aa, Influenza virus
FTNEESLR

SEQ ID NO: 277211 - protein, 8 aa, Influenza virus
TNEESLRQ

SEQ ID NO: 277212 - protein, 8 aa, Influenza virus
NEESLRQI

SEQ ID NO: 277213 - protein, 8 aa, Influenza virus
EESLRQIL

SEQ ID NO: 277214 - protein, 8 aa, Influenza virus
ESLRQILR

SEQ ID NO: 277215 - protein, 8 aa, Influenza virus
LRQILRRS

SEQ ID NO: 277216 - protein, 8 aa, Influenza virus
RQILRRSG

SEQ ID NO: 277217 - protein, 8 aa, Influenza virus
QILRRSGG

SEQ ID NO: 277218 - protein, 8 aa, Influenza virus
ILRRSGGI

SEQ ID NO: 277219 - protein, 8 aa, Influenza virus
RRSGGIGK

SEQ ID NO: 277220 - protein, 8 aa, Influenza virus
RSGGIGKE

SEQ ID NO: 277221 - protein, 8 aa, Influenza virus
GFTYSGIR

SEQ ID NO: 277222 - protein, 8 aa, Influenza virus
FTYSGIRT

SEQ ID NO: 277223 - protein, 8 aa, Influenza virus
TYSGIRTN

SEQ ID NO: 277224 - protein, 8 aa, Influenza virus
YSGIRTNG

SEQ ID NO: 277225 - protein, 8 aa, Influenza virus
SGIRTNGA

SEQ ID NO: 277226 - protein, 8 aa, Influenza virus
GIRTNGAT

SEQ ID NO: 277227 - protein, 8 aa, Influenza virus
IRTNGATS

SEQ ID NO: 277228 - protein, 8 aa, Influenza virus
RSGSSFYA

SEQ ID NO: 277229 - protein, 8 aa, Influenza virus
SGSSFYAE

SEQ ID NO: 277230 - protein, 8 aa, Influenza virus
GSSFYAEM

SEQ ID NO: 277231 - protein, 8 aa, Influenza virus
SSFYAEMK

SEQ ID NO: 277232 - protein, 8 aa, Influenza virus
SFYAEMKW

SEQ ID NO: 277233 - protein, 8 aa, Influenza virus
FYAEMKWL

SEQ ID NO: 277234 - protein, 8 aa, Influenza virus
YAEMKWLL

SEQ ID NO: 277235 - protein, 8 aa, Influenza virus
AEMKWLLS

SEQ ID NO: 277236 - protein, 8 aa, Influenza virus
EMKWLLSN

SEQ ID NO: 277237 - protein, 8 aa, Influenza virus
MKWLLSNS

SEQ ID NO: 277238 - protein, 8 aa, Influenza virus
KWLLSNSD

SEQ ID NO: 277239 - protein, 8 aa, Influenza virus
WLLSNSDN

SEQ ID NO: 277240 - protein, 8 aa, Influenza virus
ALIIWGVH

SEQ ID NO: 277241 - protein, 8 aa, Influenza virus
LIIWGVHH

SEQ ID NO: 277242 - protein, 8 aa, Influenza virus
IIWGVHHS

SEQ ID NO: 277243 - protein, 8 aa, Influenza virus
SEQTKLYG

SEQ ID NO: 277244 - protein, 8 aa, Influenza virus
EQTKLYGS

SEQ ID NO: 277245 - protein, 8 aa, Influenza virus
QTKLYGSG

SEQ ID NO: 277246 - protein, 8 aa, Influenza virus
TKLYGSGN

SEQ ID NO: 277247 - protein, 8 aa, Influenza virus
KLYGSGNK

SEQ ID NO: 277248 - protein, 8 aa, Influenza virus
LYGSGNKL

SEQ ID NO: 277249 - protein, 8 aa, Influenza virus
YGSGNKLI

SEQ ID NO: 277250 - protein, 8 aa, Influenza virus
SSKYQQSF

SEQ ID NO: 277251 - protein, 8 aa, Influenza virus
PGARRIDF

SEQ ID NO: 277252 - protein, 8 aa, Influenza virus
GARRIDFH

SEQ ID NO: 277253 - protein, 8 aa, Influenza virus
ARRIDFHW

SEQ ID NO: 277254 - protein, 8 aa, Influenza virus
RRIDFHWL

SEQ ID NO: 277255 - protein, 8 aa, Influenza virus
PQVNGQSG

SEQ ID NO: 277256 - protein, 8 aa, Influenza virus
QVNGQSGR

SEQ ID NO: 277257 - protein, 8 aa, Influenza virus
VNGQSGRI

SEQ ID NO: 277258 - protein, 8 aa, Influenza virus
NGQSGRID

SEQ ID NO: 277259 - protein, 8 aa, Influenza virus
GQSGRIDF

SEQ ID NO: 277260 - protein, 8 aa, Influenza virus
QSGRIDFH

SEQ ID NO: 277261 - protein, 8 aa, Influenza virus
SGRIDFHW

SEQ ID NO: 277262 - protein, 8 aa, Influenza virus
GRIDFHWL

SEQ ID NO: 277263 - protein, 8 aa, Influenza virus
RIDFHWLL

SEQ ID NO: 277264 - protein, 8 aa, Influenza virus
IDFHWLLL

SEQ ID NO: 277265 - protein, 8 aa, Influenza virus
NDTVTFTF

SEQ ID NO: 277266 - protein, 8 aa, Influenza virus
DTVTFTFN

SEQ ID NO: 277267 - protein, 8 aa, Influenza virus
TVTFTFNG

SEQ ID NO: 277268 - protein, 8 aa, Influenza virus
VTFTFNGA

SEQ ID NO: 277269 - protein, 8 aa, Influenza virus
TFTFNGAF

SEQ ID NO: 277270 - protein, 8 aa, Influenza virus
FTFNGAFI

SEQ ID NO: 277271 - protein, 8 aa, Influenza virus
TFNGAFIA

SEQ ID NO: 277272 - protein, 8 aa, Influenza virus
FNGAFIAP

SEQ ID NO: 277273 - protein, 8 aa, Influenza virus
NGAFIAPD

SEQ ID NO: 277274 - protein, 8 aa, Influenza virus
GAFIAPDR

SEQ ID NO: 277275 - protein, 8 aa, Influenza virus
AFIAPDRA

SEQ ID NO: 277276 - protein, 8 aa, Influenza virus
FIAPDRAS

SEQ ID NO: 277277 - protein, 8 aa, Influenza virus
IAPDRASF

SEQ ID NO: 277278 - protein, 8 aa, Influenza virus
APDRASFF

SEQ ID NO: 277279 - protein, 8 aa, Influenza virus
PDRASFFR

SEQ ID NO: 277280 - protein, 8 aa, Influenza virus
DRASFFRG

SEQ ID NO: 277281 - protein, 8 aa, Influenza virus
RASFFRGE

SEQ ID NO: 277282 - protein, 8 aa, Influenza virus
CFHSGGTI

SEQ ID NO: 277283 - protein, 8 aa, Influenza virus
GGTIVSSL

SEQ ID NO: 277284 - protein, 8 aa, Influenza virus
GTIVSSLP

SEQ ID NO: 277285 - protein, 8 aa, Influenza virus
TIVSSLPF

SEQ ID NO: 277286 - protein, 8 aa, Influenza virus
IVSSLPFQ

SEQ ID NO: 277287 - protein, 8 aa, Influenza virus
VSSLPFQN

SEQ ID NO: 277288 - protein, 8 aa, Influenza virus
SSLPFQNI

SEQ ID NO: 277289 - protein, 8 aa, Influenza virus
SLPFQNIN

SEQ ID NO: 277290 - protein, 8 aa, Influenza virus
LPFQNINS

SEQ ID NO: 277291 - protein, 8 aa, Influenza virus
PFQNINSR

SEQ ID NO: 277292 - protein, 8 aa, Influenza virus
FQNINSRT

SEQ ID NO: 277293 - protein, 8 aa, Influenza virus
RTVGKCPR

SEQ ID NO: 277294 - protein, 8 aa, Influenza virus
TVGKCPRY

SEQ ID NO: 277295 - protein, 8 aa, Influenza virus
VGKCPRYV

SEQ ID NO: 277296 - protein, 8 aa, Influenza virus
GKCPRYVK

SEQ ID NO: 277297 - protein, 8 aa, Influenza virus
KCPRYVKQ

SEQ ID NO: 277298 - protein, 8 aa, Influenza virus
CPRYVKQK

SEQ ID NO: 277299 - protein, 8 aa, Influenza virus
PRYVKQKS

SEQ ID NO: 277300 - protein, 8 aa, Influenza virus
VKQKSLLL

SEQ ID NO: 277301 - protein, 8 aa, Influenza virus
KQKSLLLA

SEQ ID NO: 277302 - protein, 8 aa, Influenza virus
QKSLLLAT

SEQ ID NO: 277303 - protein, 8 aa, Influenza virus
KSLLLATG

SEQ ID NO: 277304 - protein, 8 aa, Influenza virus
SLLLATGM

SEQ ID NO: 277305 - protein, 8 aa, Influenza virus
LLLATGMR

SEQ ID NO: 277306 - protein, 8 aa, Influenza virus
LLATGMRN

SEQ ID NO: 277307 - protein, 8 aa, Influenza virus
LATGMRNV

SEQ ID NO: 277308 - protein, 8 aa, Influenza virus
ATGMRNVP

SEQ ID NO: 277309 - protein, 8 aa, Influenza virus
TGMRNVPE

SEQ ID NO: 277310 - protein, 8 aa, Influenza virus
GMRNVPEK

SEQ ID NO: 277311 - protein, 8 aa, Influenza virus
MRNVPEKP

SEQ ID NO: 277312 - protein, 8 aa, Influenza virus
RNVPEKPK

SEQ ID NO: 277313 - protein, 8 aa, Influenza virus
PKPRGLFG

SEQ ID NO: 277314 - protein, 8 aa, Influenza virus
KPRGLFGA

SEQ ID NO: 277315 - protein, 8 aa, Influenza virus
PRGLFGAI

SEQ ID NO: 277316 - protein, 8 aa, Influenza virus
RGLFGAIA

SEQ ID NO: 277317 - protein, 8 aa, Influenza virus
GLFGAIAG

SEQ ID NO: 277318 - protein, 8 aa, Influenza virus
LFGAIAGF

SEQ ID NO: 277319 - protein, 8 aa, Influenza virus
FGAIAGFI

SEQ ID NO: 277320 - protein, 8 aa, Influenza virus
GAIAGFIE

SEQ ID NO: 277321 - protein, 8 aa, Influenza virus
AIAGFIEN

SEQ ID NO: 277322 - protein, 8 aa, Influenza virus
IAGFIENG

SEQ ID NO: 277323 - protein, 8 aa, Influenza virus
AGFIENGW

SEQ ID NO: 277324 - protein, 8 aa, Influenza virus
GFIENGWE

SEQ ID NO: 277325 - protein, 8 aa, Influenza virus
FIENGWEG

SEQ ID NO: 277326 - protein, 8 aa, Influenza virus
IENGWEGL

SEQ ID NO: 277327 - protein, 8 aa, Influenza virus
ENGWEGLI

SEQ ID NO: 277328 - protein, 8 aa, Influenza virus
NGWEGLIN

SEQ ID NO: 277329 - protein, 8 aa, Influenza virus
GWEGLING

SEQ ID NO: 277330 - protein, 8 aa, Influenza virus
WEGLINGW

SEQ ID NO: 277331 - protein, 8 aa, Influenza virus
EGLINGWY

SEQ ID NO: 277332 - protein, 8 aa, Influenza virus
GLINGWYG

SEQ ID NO: 277333 - protein, 8 aa, Influenza virus
LINGWYGF

SEQ ID NO: 277334 - protein, 8 aa, Influenza virus
INGWYGFR

SEQ ID NO: 277335 - protein, 8 aa, Influenza virus
NGWYGFRH

SEQ ID NO: 277336 - protein, 8 aa, Influenza virus
GWYGFRHQ

SEQ ID NO: 277337 - protein, 8 aa, Influenza virus
WYGFRHQN

SEQ ID NO: 277338 - protein, 8 aa, Influenza virus
YGFRHQNA

SEQ ID NO: 277339 - protein, 8 aa, Influenza virus
GFRHQNAQ

SEQ ID NO: 277340 - protein, 8 aa, Influenza virus
FRHQNAQG

SEQ ID NO: 277341 - protein, 8 aa, Influenza virus
RHQNAQGE

SEQ ID NO: 277342 - protein, 8 aa, Influenza virus
HQNAQGEG

SEQ ID NO: 277343 - protein, 8 aa, Influenza virus
QNAQGEGT

SEQ ID NO: 277344 - protein, 8 aa, Influenza virus
NAQGEGTA

SEQ ID NO: 277345 - protein, 8 aa, Influenza virus
AQGEGTAA

SEQ ID NO: 277346 - protein, 8 aa, Influenza virus
QGEGTAAD

SEQ ID NO: 277347 - protein, 8 aa, Influenza virus
GEGTAADY

SEQ ID NO: 277348 - protein, 8 aa, Influenza virus
EGTAADYK

SEQ ID NO: 277349 - protein, 8 aa, Influenza virus
GTAADYKS

SEQ ID NO: 277350 - protein, 8 aa, Influenza virus
TAADYKST

SEQ ID NO: 277351 - protein, 8 aa, Influenza virus
AADYKSTQ

SEQ ID NO: 277352 - protein, 8 aa, Influenza virus
ADYKSTQS

SEQ ID NO: 277353 - protein, 8 aa, Influenza virus
DYKSTQSA

SEQ ID NO: 277354 - protein, 8 aa, Influenza virus
YKSTQSAI

SEQ ID NO: 277355 - protein, 8 aa, Influenza virus
KSTQSAID

SEQ ID NO: 277356 - protein, 8 aa, Influenza virus
STQSAIDQ

SEQ ID NO: 277357 - protein, 8 aa, Influenza virus
TQSAIDQI

SEQ ID NO: 277358 - protein, 8 aa, Influenza virus
QSAIDQIT

SEQ ID NO: 277359 - protein, 8 aa, Influenza virus
SAIDQITG

SEQ ID NO: 277360 - protein, 8 aa, Influenza virus
AIDQITGK

SEQ ID NO: 277361 - protein, 8 aa, Influenza virus
IDQITGKL

SEQ ID NO: 277362 - protein, 8 aa, Influenza virus
DQITGKLN

SEQ ID NO: 277363 - protein, 8 aa, Influenza virus
QITGKLNR

SEQ ID NO: 277364 - protein, 8 aa, Influenza virus
ITGKLNRL

SEQ ID NO: 277365 - protein, 8 aa, Influenza virus
TGKLNRLI

SEQ ID NO: 277366 - protein, 8 aa, Influenza virus
GKLNRLIG

SEQ ID NO: 277367 - protein, 8 aa, Influenza virus
KLNRLIGK

SEQ ID NO: 277368 - protein, 8 aa, Influenza virus
LNRLIGKT

SEQ ID NO: 277369 - protein, 8 aa, Influenza virus
NRLIGKTN

SEQ ID NO: 277370 - protein, 8 aa, Influenza virus
RLIGKTNQ

SEQ ID NO: 277371 - protein, 8 aa, Influenza virus
LIGKTNQQ

SEQ ID NO: 277372 - protein, 8 aa, Influenza virus
IGKTNQQF

SEQ ID NO: 277373 - protein, 8 aa, Influenza virus
GKTNQQFE

SEQ ID NO: 277374 - protein, 8 aa, Influenza virus
KTNQQFEL

SEQ ID NO: 277375 - protein, 8 aa, Influenza virus
TNQQFELI

SEQ ID NO: 277376 - protein, 8 aa, Influenza virus
NQQFELID

SEQ ID NO: 277377 - protein, 8 aa, Influenza virus
QQFELIDN

SEQ ID NO: 277378 - protein, 8 aa, Influenza virus
QFELIDNE

SEQ ID NO: 277379 - protein, 8 aa, Influenza virus
FELIDNEF

SEQ ID NO: 277380 - protein, 8 aa, Influenza virus
ELIDNEFN

SEQ ID NO: 277381 - protein, 8 aa, Influenza virus
LIDNEFNE

SEQ ID NO: 277382 - protein, 8 aa, Influenza virus
NEFNEIEQ

SEQ ID NO: 277383 - protein, 8 aa, Influenza virus
EFNEIEQQ

SEQ ID NO: 277384 - protein, 8 aa, Influenza virus
FNEIEQQI

SEQ ID NO: 277385 - protein, 8 aa, Influenza virus
NEIEQQIG

SEQ ID NO: 277386 - protein, 8 aa, Influenza virus
EIEQQIGN

SEQ ID NO: 277387 - protein, 8 aa, Influenza virus
IEQQIGNV

SEQ ID NO: 277388 - protein, 8 aa, Influenza virus
EQQIGNVI

SEQ ID NO: 277389 - protein, 8 aa, Influenza virus
QQIGNVIN

SEQ ID NO: 277390 - protein, 8 aa, Influenza virus
QIGNVINW

SEQ ID NO: 277391 - protein, 8 aa, Influenza virus
IGNVINWT

SEQ ID NO: 277392 - protein, 8 aa, Influenza virus
GNVINWTR

SEQ ID NO: 277393 - protein, 8 aa, Influenza virus
NVINWTRD

SEQ ID NO: 277394 - protein, 8 aa, Influenza virus
VINWTRDA

SEQ ID NO: 277395 - protein, 8 aa, Influenza virus
INWTRDAM

SEQ ID NO: 277396 - protein, 8 aa, Influenza virus
NWTRDAMT

SEQ ID NO: 277397 - protein, 8 aa, Influenza virus
WTRDAMTE

SEQ ID NO: 277398 - protein, 8 aa, Influenza virus
TRDAMTEI

SEQ ID NO: 277399 - protein, 8 aa, Influenza virus
RDAMTEIW

SEQ ID NO: 277400 - protein, 8 aa, Influenza virus
DAMTEIWS

SEQ ID NO: 277401 - protein, 8 aa, Influenza virus
AMTEIWSY

SEQ ID NO: 277402 - protein, 8 aa, Influenza virus
MTEIWSYN

SEQ ID NO: 277403 - protein, 8 aa, Influenza virus
TEIWSYNA

SEQ ID NO: 277404 - protein, 8 aa, Influenza virus
EIWSYNAE

SEQ ID NO: 277405 - protein, 8 aa, Influenza virus
IWSYNAEL

SEQ ID NO: 277406 - protein, 8 aa, Influenza virus
WSYNAELL

SEQ ID NO: 277407 - protein, 8 aa, Influenza virus
SYNAELLV

SEQ ID NO: 277408 - protein, 8 aa, Influenza virus
YNAELLVA

SEQ ID NO: 277409 - protein, 8 aa, Influenza virus
NAELLVAM

SEQ ID NO: 277410 - protein, 8 aa, Influenza virus
AELLVAME

SEQ ID NO: 277411 - protein, 8 aa, Influenza virus
ELLVAMEN

SEQ ID NO: 277412 - protein, 8 aa, Influenza virus
LLVAMENQ

SEQ ID NO: 277413 - protein, 8 aa, Influenza virus
LVAMENQH

SEQ ID NO: 277414 - protein, 8 aa, Influenza virus
VAMENQHT

SEQ ID NO: 277415 - protein, 8 aa, Influenza virus
AMENQHTI

SEQ ID NO: 277416 - protein, 8 aa, Influenza virus
MENQHTID

SEQ ID NO: 277417 - protein, 8 aa, Influenza virus
ENQHTIDL

SEQ ID NO: 277418 - protein, 8 aa, Influenza virus
NQHTIDLA

SEQ ID NO: 277419 - protein, 8 aa, Influenza virus
QHTIDLAD

SEQ ID NO: 277420 - protein, 8 aa, Influenza virus
HTIDLADS

SEQ ID NO: 277421 - protein, 8 aa, Influenza virus
TIDLADSE

SEQ ID NO: 277422 - protein, 8 aa, Influenza virus
IDLADSEM

SEQ ID NO: 277423 - protein, 8 aa, Influenza virus
DLADSEMS

SEQ ID NO: 277424 - protein, 8 aa, Influenza virus
LADSEMSK

SEQ ID NO: 277425 - protein, 8 aa, Influenza virus
ADSEMSKL

SEQ ID NO: 277426 - protein, 8 aa, Influenza virus
DSEMSKLY

SEQ ID NO: 277427 - protein, 8 aa, Influenza virus
SEMSKLYE

SEQ ID NO: 277428 - protein, 8 aa, Influenza virus
EMSKLYER

SEQ ID NO: 277429 - protein, 8 aa, Influenza virus
MSKLYERV

SEQ ID NO: 277430 - protein, 8 aa, Influenza virus
SKLYERVK

SEQ ID NO: 277431 - protein, 8 aa, Influenza virus
KLYERVKK

SEQ ID NO: 277432 - protein, 8 aa, Influenza virus
LYERVKKQ

SEQ ID NO: 277433 - protein, 8 aa, Influenza virus
YERVKKQL

SEQ ID NO: 277434 - protein, 8 aa, Influenza virus
ERVKKQLR

SEQ ID NO: 277435 - protein, 8 aa, Influenza virus
RVKKQLRE

SEQ ID NO: 277436 - protein, 8 aa, Influenza virus
VKKQLREN

SEQ ID NO: 277437 - protein, 8 aa, Influenza virus
KKQLRENA

SEQ ID NO: 277438 - protein, 8 aa, Influenza virus
KQLRENAE

SEQ ID NO: 277439 - protein, 8 aa, Influenza virus
QLRENAEE

SEQ ID NO: 277440 - protein, 8 aa, Influenza virus
LRENAEED

SEQ ID NO: 277441 - protein, 8 aa, Influenza virus
RENAEEDG

SEQ ID NO: 277442 - protein, 8 aa, Influenza virus
ENAEEDGT

SEQ ID NO: 277443 - protein, 8 aa, Influenza virus
NAEEDGTG

SEQ ID NO: 277444 - protein, 8 aa, Influenza virus
AEEDGTGC

SEQ ID NO: 277445 - protein, 8 aa, Influenza virus
EEDGTGCF

SEQ ID NO: 277446 - protein, 8 aa, Influenza virus
EDGTGCFE

SEQ ID NO: 277447 - protein, 8 aa, Influenza virus
DGTGCFEI

SEQ ID NO: 277448 - protein, 8 aa, Influenza virus
GTGCFEIF

SEQ ID NO: 277449 - protein, 8 aa, Influenza virus
TGCFEIFH

SEQ ID NO: 277450 - protein, 8 aa, Influenza virus
GCFEIFHK

SEQ ID NO: 277451 - protein, 8 aa, Influenza virus
CFEIFHKC

SEQ ID NO: 277452 - protein, 8 aa, Influenza virus
FEIFHKCD

SEQ ID NO: 277453 - protein, 8 aa, Influenza virus
EIFHKCDD

SEQ ID NO: 277454 - protein, 8 aa, Influenza virus
IFHKCDDQ

SEQ ID NO: 277455 - protein, 8 aa, Influenza virus
FHKCDDQC

SEQ ID NO: 277456 - protein, 8 aa, Influenza virus
HKCDDQCM

SEQ ID NO: 277457 - protein, 8 aa, Influenza virus
KCDDQCME

SEQ ID NO: 277458 - protein, 8 aa, Influenza virus
CDDQCMES

SEQ ID NO: 277459 - protein, 8 aa, Influenza virus
DDQCMESI

SEQ ID NO: 277460 - protein, 8 aa, Influenza virus
DQCMESIR

SEQ ID NO: 277461 - protein, 8 aa, Influenza virus
QCMESIRN

SEQ ID NO: 277462 - protein, 8 aa, Influenza virus
CMESIRNN

SEQ ID NO: 277463 - protein, 8 aa, Influenza virus
MESIRNNT

SEQ ID NO: 277464 - protein, 8 aa, Influenza virus
ESIRNNTY

SEQ ID NO: 277465 - protein, 8 aa, Influenza virus
SIRNNTYD

SEQ ID NO: 277466 - protein, 8 aa, Influenza virus
IRNNTYDH

SEQ ID NO: 277467 - protein, 8 aa, Influenza virus
RNNTYDHT

SEQ ID NO: 277468 - protein, 8 aa, Influenza virus
NNTYDHTQ

SEQ ID NO: 277469 - protein, 8 aa, Influenza virus
NTYDHTQY

SEQ ID NO: 277470 - protein, 8 aa, Influenza virus
TYDHTQYR

SEQ ID NO: 277471 - protein, 8 aa, Influenza virus
YDHTQYRT

SEQ ID NO: 277472 - protein, 8 aa, Influenza virus
HTQYRTES

SEQ ID NO: 277473 - protein, 8 aa, Influenza virus
TQYRTESL

SEQ ID NO: 277474 - protein, 8 aa, Influenza virus
QYRTESLQ

SEQ ID NO: 277475 - protein, 8 aa, Influenza virus
YRTESLQN

SEQ ID NO: 277476 - protein, 8 aa, Influenza virus
RTESLQNR

SEQ ID NO: 277477 - protein, 8 aa, Influenza virus
TESLQNRI

SEQ ID NO: 277478 - protein, 8 aa, Influenza virus
ESLQNRIQ

SEQ ID NO: 277479 - protein, 8 aa, Influenza virus
SLQNRIQI

SEQ ID NO: 277480 - protein, 8 aa, Influenza virus
LQNRIQID

SEQ ID NO: 277481 - protein, 8 aa, Influenza virus
QNRIQIDP

SEQ ID NO: 277482 - protein, 8 aa, Influenza virus
NRIQIDPV

SEQ ID NO: 277483 - protein, 8 aa, Influenza virus
RIQIDPVK

SEQ ID NO: 277484 - protein, 8 aa, Influenza virus
IQIDPVKL

SEQ ID NO: 277485 - protein, 8 aa, Influenza virus
QIDPVKLS

SEQ ID NO: 277486 - protein, 8 aa, Influenza virus
IDPVKLSS

SEQ ID NO: 277487 - protein, 8 aa, Influenza virus
DPVKLSSG

SEQ ID NO: 277488 - protein, 8 aa, Influenza virus
PVKLSSGY

SEQ ID NO: 277489 - protein, 8 aa, Influenza virus
VKLSSGYK

SEQ ID NO: 277490 - protein, 8 aa, Influenza virus
KLSSGYKD

SEQ ID NO: 277491 - protein, 8 aa, Influenza virus
LSSGYKDI

SEQ ID NO: 277492 - protein, 8 aa, Influenza virus
SSGYKDII

SEQ ID NO: 277493 - protein, 8 aa, Influenza virus
SGYKDIIL

SEQ ID NO: 277494 - protein, 8 aa, Influenza virus
GYKDIILW

SEQ ID NO: 277495 - protein, 8 aa, Influenza virus
YKDIILWF

SEQ ID NO: 277496 - protein, 8 aa, Influenza virus
KDIILWFS

SEQ ID NO: 277497 - protein, 8 aa, Influenza virus
DIILWFSF

SEQ ID NO: 277498 - protein, 8 aa, Influenza virus
IILWFSFG

SEQ ID NO: 277499 - protein, 8 aa, Influenza virus
ILWFSFGA

SEQ ID NO: 277500 - protein, 8 aa, Influenza virus
LWFSFGAS

SEQ ID NO: 277501 - protein, 8 aa, Influenza virus
WFSFGASC

SEQ ID NO: 277502 - protein, 8 aa, Influenza virus
FSFGASCF

SEQ ID NO: 277503 - protein, 8 aa, Influenza virus
SFGASCFL

SEQ ID NO: 277504 - protein, 8 aa, Influenza virus
FGASCFLL

SEQ ID NO: 277505 - protein, 8 aa, Influenza virus
GASCFLLL

SEQ ID NO: 277506 - protein, 8 aa, Influenza virus
ASCFLLLA

SEQ ID NO: 277507 - protein, 8 aa, Influenza virus
SCFLLLAI

SEQ ID NO: 277508 - protein, 8 aa, Influenza virus
CFLLLAIA

SEQ ID NO: 277509 - protein, 8 aa, Influenza virus
LLAIAMGL

SEQ ID NO: 277510 - protein, 8 aa, Influenza virus
LAIAMGLV

SEQ ID NO: 277511 - protein, 8 aa, Influenza virus
AIAMGLVF

SEQ ID NO: 277512 - protein, 8 aa, Influenza virus
IAMGLVFI

SEQ ID NO: 277513 - protein, 8 aa, Influenza virus
AMGLVFIC

SEQ ID NO: 277514 - protein, 8 aa, Influenza virus
MGLVFICI

SEQ ID NO: 277515 - protein, 8 aa, Influenza virus
GLVFICIK

SEQ ID NO: 277516 - protein, 8 aa, Influenza virus
LVFICIKN

SEQ ID NO: 277517 - protein, 8 aa, Influenza virus
VFICIKNG

SEQ ID NO: 277518 - protein, 8 aa, Influenza virus
FICIKNGN

SEQ ID NO: 277519 - protein, 8 aa, Influenza virus
ICIKNGNM

SEQ ID NO: 277520 - protein, 8 aa, Influenza virus
CIKNGNMQ

SEQ ID NO: 277521 - protein, 8 aa, Influenza virus
IKNGNMQC

SEQ ID NO: 277522 - protein, 8 aa, Influenza virus
KNGNMQCT

SEQ ID NO: 277523 - protein, 8 aa, Influenza virus
NGNMQCTI

SEQ ID NO: 277524 - protein, 8 aa, Influenza virus
GNMQCTIC

SEQ ID NO: 277525 - protein, 8 aa, Influenza virus
NMQCTICI

SEQ ID NO: 277526 - protein, 8 aa, Influenza virus
CSALFVYS

SEQ ID NO: 277527 - protein, 8 aa, Influenza virus
SALFVYSL

SEQ ID NO: 277528 - protein, 8 aa, Influenza virus
ALFVYSLR

SEQ ID NO: 277529 - protein, 8 aa, Influenza virus
LFVYSLRK

SEQ ID NO: 277530 - protein, 8 aa, Influenza virus
MNPNQKII

SEQ ID NO: 277531 - protein, 8 aa, Influenza virus
NPNQKIIT

SEQ ID NO: 277532 - protein, 8 aa, Influenza virus
PNQKIITI

SEQ ID NO: 277533 - protein, 8 aa, Influenza virus
NQKIITIG

SEQ ID NO: 277534 - protein, 8 aa, Influenza virus
QKIITIGS

SEQ ID NO: 277535 - protein, 8 aa, Influenza virus
KIITIGSV

SEQ ID NO: 277536 - protein, 8 aa, Influenza virus
IITIGSVS

SEQ ID NO: 277537 - protein, 8 aa, Influenza virus
ITIGSVSL

SEQ ID NO: 277538 - protein, 8 aa, Influenza virus
TIGSVSLT

SEQ ID NO: 277539 - protein, 8 aa, Influenza virus
IGSVSLTI

SEQ ID NO: 277540 - protein, 8 aa, Influenza virus
GSVSLTIA

SEQ ID NO: 277541 - protein, 8 aa, Influenza virus
SVSLTIAT

SEQ ID NO: 277542 - protein, 8 aa, Influenza virus
TVCFLMQI

SEQ ID NO: 277543 - protein, 8 aa, Influenza virus
VCFLMQIA

SEQ ID NO: 277544 - protein, 8 aa, Influenza virus
CFLMQIAI

SEQ ID NO: 277545 - protein, 8 aa, Influenza virus
FLMQIAIL

SEQ ID NO: 277546 - protein, 8 aa, Influenza virus
ERNITEIV

SEQ ID NO: 277547 - protein, 8 aa, Influenza virus
RNITEIVY

SEQ ID NO: 277548 - protein, 8 aa, Influenza virus
NITEIVYL

SEQ ID NO: 277549 - protein, 8 aa, Influenza virus
ITEIVYLN

SEQ ID NO: 277550 - protein, 8 aa, Influenza virus
TEIVYLNN

SEQ ID NO: 277551 - protein, 8 aa, Influenza virus
EIVYLNNT

SEQ ID NO: 277552 - protein, 8 aa, Influenza virus
YRSWSKPQ

SEQ ID NO: 277553 - protein, 8 aa, Influenza virus
RSWSKPQC

SEQ ID NO: 277554 - protein, 8 aa, Influenza virus
SWSKPQCQ

SEQ ID NO: 277555 - protein, 8 aa, Influenza virus
WSKPQCQI

SEQ ID NO: 277556 - protein, 8 aa, Influenza virus
SKPQCQIT

SEQ ID NO: 277557 - protein, 8 aa, Influenza virus
KPQCQITG

SEQ ID NO: 277558 - protein, 8 aa, Influenza virus
QCQITGFA

SEQ ID NO: 277559 - protein, 8 aa, Influenza virus
CQITGFAP

SEQ ID NO: 277560 - protein, 8 aa, Influenza virus
GFAPFSKD

SEQ ID NO: 277561 - protein, 8 aa, Influenza virus
FAPFSKDN

SEQ ID NO: 277562 - protein, 8 aa, Influenza virus
APFSKDNS

SEQ ID NO: 277563 - protein, 8 aa, Influenza virus
PFSKDNSI

SEQ ID NO: 277564 - protein, 8 aa, Influenza virus
FSKDNSIR

SEQ ID NO: 277565 - protein, 8 aa, Influenza virus
SKDNSIRL

SEQ ID NO: 277566 - protein, 8 aa, Influenza virus
KDNSIRLS

SEQ ID NO: 277567 - protein, 8 aa, Influenza virus
DNSIRLSA

SEQ ID NO: 277568 - protein, 8 aa, Influenza virus
NSIRLSAG

SEQ ID NO: 277569 - protein, 8 aa, Influenza virus
SIRLSAGG

SEQ ID NO: 277570 - protein, 8 aa, Influenza virus
IRLSAGGD

SEQ ID NO: 277571 - protein, 8 aa, Influenza virus
RLSAGGDI

SEQ ID NO: 277572 - protein, 8 aa, Influenza virus
LSAGGDIW

SEQ ID NO: 277573 - protein, 8 aa, Influenza virus
SAGGDIWI

SEQ ID NO: 277574 - protein, 8 aa, Influenza virus
AGGDIWIT

SEQ ID NO: 277575 - protein, 8 aa, Influenza virus
GGDIWITR

SEQ ID NO: 277576 - protein, 8 aa, Influenza virus
GDIWITRE

SEQ ID NO: 277577 - protein, 8 aa, Influenza virus
DIWITREP

SEQ ID NO: 277578 - protein, 8 aa, Influenza virus
IWITREPY

SEQ ID NO: 277579 - protein, 8 aa, Influenza virus
WITREPYV

SEQ ID NO: 277580 - protein, 8 aa, Influenza virus
ITREPYVS

SEQ ID NO: 277581 - protein, 8 aa, Influenza virus
TREPYVSC

SEQ ID NO: 277582 - protein, 8 aa, Influenza virus
REPYVSCD

SEQ ID NO: 277583 - protein, 8 aa, Influenza virus
EPYVSCDT

SEQ ID NO: 277584 - protein, 8 aa, Influenza virus
SKCYQFAL

SEQ ID NO: 277585 - protein, 8 aa, Influenza virus
KCYQFALG

SEQ ID NO: 277586 - protein, 8 aa, Influenza virus
CYQFALGQ

SEQ ID NO: 277587 - protein, 8 aa, Influenza virus
YQFALGQG

SEQ ID NO: 277588 - protein, 8 aa, Influenza virus
QFALGQGT

SEQ ID NO: 277589 - protein, 8 aa, Influenza virus
FALGQGTT

SEQ ID NO: 277590 - protein, 8 aa, Influenza virus
ALGQGTTL

SEQ ID NO: 277591 - protein, 8 aa, Influenza virus
LGQGTTLD

SEQ ID NO: 277592 - protein, 8 aa, Influenza virus
GQGTTLDN

SEQ ID NO: 277593 - protein, 8 aa, Influenza virus
QGTTLDNK

SEQ ID NO: 277594 - protein, 8 aa, Influenza virus
GTTLDNKH

SEQ ID NO: 277595 - protein, 8 aa, Influenza virus
TTLDNKHS

SEQ ID NO: 277596 - protein, 8 aa, Influenza virus
TLDNKHSN

SEQ ID NO: 277597 - protein, 8 aa, Influenza virus
LDNKHSNG

SEQ ID NO: 277598 - protein, 8 aa, Influenza virus
DNKHSNGT

SEQ ID NO: 277599 - protein, 8 aa, Influenza virus
NKHSNGTI

SEQ ID NO: 277600 - protein, 8 aa, Influenza virus
KHSNGTIH

SEQ ID NO: 277601 - protein, 8 aa, Influenza virus
HSNGTIHD

SEQ ID NO: 277602 - protein, 8 aa, Influenza virus
SNGTIHDR

SEQ ID NO: 277603 - protein, 8 aa, Influenza virus
NGTIHDRI

SEQ ID NO: 277604 - protein, 8 aa, Influenza virus
HDRIPHRT

SEQ ID NO: 277605 - protein, 8 aa, Influenza virus
DRIPHRTL

SEQ ID NO: 277606 - protein, 8 aa, Influenza virus
RIPHRTLL

SEQ ID NO: 277607 - protein, 8 aa, Influenza virus
IPHRTLLM

SEQ ID NO: 277608 - protein, 8 aa, Influenza virus
PHRTLLMN

SEQ ID NO: 277609 - protein, 8 aa, Influenza virus
HRTLLMNE

SEQ ID NO: 277610 - protein, 8 aa, Influenza virus
RTLLMNEL

SEQ ID NO: 277611 - protein, 8 aa, Influenza virus
TLLMNELG

SEQ ID NO: 277612 - protein, 8 aa, Influenza virus
LLMNELGV

SEQ ID NO: 277613 - protein, 8 aa, Influenza virus
LMNELGVP

SEQ ID NO: 277614 - protein, 8 aa, Influenza virus
MNELGVPF

SEQ ID NO: 277615 - protein, 8 aa, Influenza virus
NELGVPFH

SEQ ID NO: 277616 - protein, 8 aa, Influenza virus
ELGVPFHL

SEQ ID NO: 277617 - protein, 8 aa, Influenza virus
LGVPFHLG

SEQ ID NO: 277618 - protein, 8 aa, Influenza virus
GVPFHLGT

SEQ ID NO: 277619 - protein, 8 aa, Influenza virus
VPFHLGTK

SEQ ID NO: 277620 - protein, 8 aa, Influenza virus
PFHLGTKQ

SEQ ID NO: 277621 - protein, 8 aa, Influenza virus
FHLGTKQV

SEQ ID NO: 277622 - protein, 8 aa, Influenza virus
HLGTKQVC

SEQ ID NO: 277623 - protein, 8 aa, Influenza virus
LGTKQVCI

SEQ ID NO: 277624 - protein, 8 aa, Influenza virus
GTKQVCIA

SEQ ID NO: 277625 - protein, 8 aa, Influenza virus
TKQVCIAW

SEQ ID NO: 277626 - protein, 8 aa, Influenza virus
KQVCIAWS

SEQ ID NO: 277627 - protein, 8 aa, Influenza virus
QVCIAWSS

SEQ ID NO: 277628 - protein, 8 aa, Influenza virus
VCIAWSSS

SEQ ID NO: 277629 - protein, 8 aa, Influenza virus
CIAWSSSS

SEQ ID NO: 277630 - protein, 8 aa, Influenza virus
IAWSSSSC

SEQ ID NO: 277631 - protein, 8 aa, Influenza virus
AWSSSSCH

SEQ ID NO: 277632 - protein, 8 aa, Influenza virus
WSSSSCHD

SEQ ID NO: 277633 - protein, 8 aa, Influenza virus
SSSSCHDG

SEQ ID NO: 277634 - protein, 8 aa, Influenza virus
SSSCHDGK

SEQ ID NO: 277635 - protein, 8 aa, Influenza virus
SSCHDGKA

SEQ ID NO: 277636 - protein, 8 aa, Influenza virus
SCHDGKAW

SEQ ID NO: 277637 - protein, 8 aa, Influenza virus
CHDGKAWL

SEQ ID NO: 277638 - protein, 8 aa, Influenza virus
HDGKAWLH

SEQ ID NO: 277639 - protein, 8 aa, Influenza virus
DGKAWLHV

SEQ ID NO: 277640 - protein, 8 aa, Influenza virus
GKAWLHVC

SEQ ID NO: 277641 - protein, 8 aa, Influenza virus
KAWLHVCV

SEQ ID NO: 277642 - protein, 8 aa, Influenza virus
AWLHVCVT

SEQ ID NO: 277643 - protein, 8 aa, Influenza virus
WLHVCVTG

SEQ ID NO: 277644 - protein, 8 aa, Influenza virus
LHVCVTGD

SEQ ID NO: 277645 - protein, 8 aa, Influenza virus
HVCVTGDD

SEQ ID NO: 277646 - protein, 8 aa, Influenza virus
VCVTGDDR

SEQ ID NO: 277647 - protein, 8 aa, Influenza virus
CVTGDDRN

SEQ ID NO: 277648 - protein, 8 aa, Influenza virus
VTGDDRNA

SEQ ID NO: 277649 - protein, 8 aa, Influenza virus
TGDDRNAT

SEQ ID NO: 277650 - protein, 8 aa, Influenza virus
GDDRNATA

SEQ ID NO: 277651 - protein, 8 aa, Influenza virus
DDRNATAS

SEQ ID NO: 277652 - protein, 8 aa, Influenza virus
DRNATASF

SEQ ID NO: 277653 - protein, 8 aa, Influenza virus
RNATASFI

SEQ ID NO: 277654 - protein, 8 aa, Influenza virus
NATASFIY

SEQ ID NO: 277655 - protein, 8 aa, Influenza virus
ATASFIYN

SEQ ID NO: 277656 - protein, 8 aa, Influenza virus
TASFIYNG

SEQ ID NO: 277657 - protein, 8 aa, Influenza virus
LVDSIGSW

SEQ ID NO: 277658 - protein, 8 aa, Influenza virus
VDSIGSWS

SEQ ID NO: 277659 - protein, 8 aa, Influenza virus
DSIGSWSQ

SEQ ID NO: 277660 - protein, 8 aa, Influenza virus
SIGSWSQN

SEQ ID NO: 277661 - protein, 8 aa, Influenza virus
IGSWSQNI

SEQ ID NO: 277662 - protein, 8 aa, Influenza virus
GSWSQNIL

SEQ ID NO: 277663 - protein, 8 aa, Influenza virus
SWSQNILR

SEQ ID NO: 277664 - protein, 8 aa, Influenza virus
WSQNILRT

SEQ ID NO: 277665 - protein, 8 aa, Influenza virus
SQNILRTQ

SEQ ID NO: 277666 - protein, 8 aa, Influenza virus
QNILRTQE

SEQ ID NO: 277667 - protein, 8 aa, Influenza virus
NILRTQES

SEQ ID NO: 277668 - protein, 8 aa, Influenza virus
ILRTQESE

SEQ ID NO: 277669 - protein, 8 aa, Influenza virus
LRTQESEC

SEQ ID NO: 277670 - protein, 8 aa, Influenza virus
RTQESECV

SEQ ID NO: 277671 - protein, 8 aa, Influenza virus
TQESECVC

SEQ ID NO: 277672 - protein, 8 aa, Influenza virus
QESECVCI

SEQ ID NO: 277673 - protein, 8 aa, Influenza virus
ESECVCIN

SEQ ID NO: 277674 - protein, 8 aa, Influenza virus
SECVCING

SEQ ID NO: 277675 - protein, 8 aa, Influenza virus
ECVCINGS

SEQ ID NO: 277676 - protein, 8 aa, Influenza virus
CVCINGSC

SEQ ID NO: 277677 - protein, 8 aa, Influenza virus
VCINGSCT

SEQ ID NO: 277678 - protein, 8 aa, Influenza virus
CINGSCTV

SEQ ID NO: 277679 - protein, 8 aa, Influenza virus
INGSCTVV

SEQ ID NO: 277680 - protein, 8 aa, Influenza virus
NGSCTVVM

SEQ ID NO: 277681 - protein, 8 aa, Influenza virus
GSCTVVMT

SEQ ID NO: 277682 - protein, 8 aa, Influenza virus
SCTVVMTD

SEQ ID NO: 277683 - protein, 8 aa, Influenza virus
CTVVMTDG

SEQ ID NO: 277684 - protein, 8 aa, Influenza virus
TVVMTDGS

SEQ ID NO: 277685 - protein, 8 aa, Influenza virus
VVMTDGSA

SEQ ID NO: 277686 - protein, 8 aa, Influenza virus
VMTDGSAS

SEQ ID NO: 277687 - protein, 8 aa, Influenza virus
MTDGSASG

SEQ ID NO: 277688 - protein, 8 aa, Influenza virus
TDGSASGK

SEQ ID NO: 277689 - protein, 8 aa, Influenza virus
DGSASGKA

SEQ ID NO: 277690 - protein, 8 aa, Influenza virus
GSASGKAD

SEQ ID NO: 277691 - protein, 8 aa, Influenza virus
SASGKADT

SEQ ID NO: 277692 - protein, 8 aa, Influenza virus
ASGKADTR

SEQ ID NO: 277693 - protein, 8 aa, Influenza virus
SGKADTRI

SEQ ID NO: 277694 - protein, 8 aa, Influenza virus
ADTRILFV

SEQ ID NO: 277695 - protein, 8 aa, Influenza virus
ILFVKEGK

SEQ ID NO: 277696 - protein, 8 aa, Influenza virus
LFVKEGKI

SEQ ID NO: 277697 - protein, 8 aa, Influenza virus
EGKIVHIS

SEQ ID NO: 277698 - protein, 8 aa, Influenza virus
GKIVHISP

SEQ ID NO: 277699 - protein, 8 aa, Influenza virus
KIVHISPL

SEQ ID NO: 277700 - protein, 8 aa, Influenza virus
IVHISPLS

SEQ ID NO: 277701 - protein, 8 aa, Influenza virus
VHISPLSG

SEQ ID NO: 277702 - protein, 8 aa, Influenza virus
HISPLSGS

SEQ ID NO: 277703 - protein, 8 aa, Influenza virus
ISPLSGSA

SEQ ID NO: 277704 - protein, 8 aa, Influenza virus
SPLSGSAQ

SEQ ID NO: 277705 - protein, 8 aa, Influenza virus
PLSGSAQH

SEQ ID NO: 277706 - protein, 8 aa, Influenza virus
LSGSAQHI

SEQ ID NO: 277707 - protein, 8 aa, Influenza virus
SGSAQHIE

SEQ ID NO: 277708 - protein, 8 aa, Influenza virus
GSAQHIEE

SEQ ID NO: 277709 - protein, 8 aa, Influenza virus
SAQHIEEC

SEQ ID NO: 277710 - protein, 8 aa, Influenza virus
AQHIEECS

SEQ ID NO: 277711 - protein, 8 aa, Influenza virus
QHIEECSC

SEQ ID NO: 277712 - protein, 8 aa, Influenza virus
HIEECSCY

SEQ ID NO: 277713 - protein, 8 aa, Influenza virus
IEECSCYP

SEQ ID NO: 277714 - protein, 8 aa, Influenza virus
EECSCYPR

SEQ ID NO: 277715 - protein, 8 aa, Influenza virus
ECSCYPRY

SEQ ID NO: 277716 - protein, 8 aa, Influenza virus
CSCYPRYP

SEQ ID NO: 277717 - protein, 8 aa, Influenza virus
SCYPRYPN

SEQ ID NO: 277718 - protein, 8 aa, Influenza virus
CYPRYPNV

SEQ ID NO: 277719 - protein, 8 aa, Influenza virus
YPRYPNVR

SEQ ID NO: 277720 - protein, 8 aa, Influenza virus
PRYPNVRC

SEQ ID NO: 277721 - protein, 8 aa, Influenza virus
RYPNVRCV

SEQ ID NO: 277722 - protein, 8 aa, Influenza virus
YPNVRCVC

SEQ ID NO: 277723 - protein, 8 aa, Influenza virus
PNVRCVCR

SEQ ID NO: 277724 - protein, 8 aa, Influenza virus
NVRCVCRD

SEQ ID NO: 277725 - protein, 8 aa, Influenza virus
VRCVCRDN

SEQ ID NO: 277726 - protein, 8 aa, Influenza virus
RCVCRDNW

SEQ ID NO: 277727 - protein, 8 aa, Influenza virus
CVCRDNWK

SEQ ID NO: 277728 - protein, 8 aa, Influenza virus
VCRDNWKG

SEQ ID NO: 277729 - protein, 8 aa, Influenza virus
CRDNWKGS

SEQ ID NO: 277730 - protein, 8 aa, Influenza virus
RDNWKGSN

SEQ ID NO: 277731 - protein, 8 aa, Influenza virus
DNWKGSNR

SEQ ID NO: 277732 - protein, 8 aa, Influenza virus
NWKGSNRP

SEQ ID NO: 277733 - protein, 8 aa, Influenza virus
WKGSNRPV

SEQ ID NO: 277734 - protein, 8 aa, Influenza virus
KGSNRPVI

SEQ ID NO: 277735 - protein, 8 aa, Influenza virus
GSNRPVID

SEQ ID NO: 277736 - protein, 8 aa, Influenza virus
SNRPVIDI

SEQ ID NO: 277737 - protein, 8 aa, Influenza virus
NRPVIDIN

SEQ ID NO: 277738 - protein, 8 aa, Influenza virus
RPVIDINM

SEQ ID NO: 277739 - protein, 8 aa, Influenza virus
DYSIDSSY

SEQ ID NO: 277740 - protein, 8 aa, Influenza virus
IDSSYVCS

SEQ ID NO: 277741 - protein, 8 aa, Influenza virus
DSSYVCSG

SEQ ID NO: 277742 - protein, 8 aa, Influenza virus
SSYVCSGL

SEQ ID NO: 277743 - protein, 8 aa, Influenza virus
SYVCSGLV

SEQ ID NO: 277744 - protein, 8 aa, Influenza virus
YVCSGLVG

SEQ ID NO: 277745 - protein, 8 aa, Influenza virus
VCSGLVGD

SEQ ID NO: 277746 - protein, 8 aa, Influenza virus
CSGLVGDT

SEQ ID NO: 277747 - protein, 8 aa, Influenza virus
SGLVGDTP

SEQ ID NO: 277748 - protein, 8 aa, Influenza virus
GLVGDTPR

SEQ ID NO: 277749 - protein, 8 aa, Influenza virus
LVGDTPRN

SEQ ID NO: 277750 - protein, 8 aa, Influenza virus
VGDTPRNE

SEQ ID NO: 277751 - protein, 8 aa, Influenza virus
GDTPRNED

SEQ ID NO: 277752 - protein, 8 aa, Influenza virus
DTPRNEDS

SEQ ID NO: 277753 - protein, 8 aa, Influenza virus
TPRNEDGS

SEQ ID NO: 277754 - protein, 8 aa, Influenza virus
PRNEDGSS

SEQ ID NO: 277755 - protein, 8 aa, Influenza virus
RNEDGSSS

SEQ ID NO: 277756 - protein, 8 aa, Influenza virus
NEDGSSSS

SEQ ID NO: 277757 - protein, 8 aa, Influenza virus
EDGSSSSN

SEQ ID NO: 277758 - protein, 8 aa, Influenza virus
DSSSSSNC

SEQ ID NO: 277759 - protein, 8 aa, Influenza virus
SSSNCRDP

SEQ ID NO: 277760 - protein, 8 aa, Influenza virus
SSNCRDPN

SEQ ID NO: 277761 - protein, 8 aa, Influenza virus
SNCRDPNE

SEQ ID NO: 277762 - protein, 8 aa, Influenza virus
NCRDPNEE

SEQ ID NO: 277763 - protein, 8 aa, Influenza virus
DPNEERGN

SEQ ID NO: 277764 - protein, 8 aa, Influenza virus
PNEERGNP

SEQ ID NO: 277765 - protein, 8 aa, Influenza virus
NEERGNPG

SEQ ID NO: 277766 - protein, 8 aa, Influenza virus
EERGNPGV

SEQ ID NO: 277767 - protein, 8 aa, Influenza virus
ERGNPGVK

SEQ ID NO: 277768 - protein, 8 aa, Influenza virus
RGNPGVKG

SEQ ID NO: 277769 - protein, 8 aa, Influenza virus
GNPGVKGW

SEQ ID NO: 277770 - protein, 8 aa, Influenza virus
NPGVKGWA

SEQ ID NO: 277771 - protein, 8 aa, Influenza virus
PGVKGWAF

SEQ ID NO: 277772 - protein, 8 aa, Influenza virus
GVKGWAFD

SEQ ID NO: 277773 - protein, 8 aa, Influenza virus
VKGWAFDS

SEQ ID NO: 277774 - protein, 8 aa, Influenza virus
KGWAFDSG

SEQ ID NO: 277775 - protein, 8 aa, Influenza virus
GWAFDSGD

SEQ ID NO: 277776 - protein, 8 aa, Influenza virus
WAFDSGDD

SEQ ID NO: 277777 - protein, 8 aa, Influenza virus
SGDDVWMG

SEQ ID NO: 277778 - protein, 8 aa, Influenza virus
GDDVWMGR

SEQ ID NO: 277779 - protein, 8 aa, Influenza virus
DDVWMGRT

SEQ ID NO: 277780 - protein, 8 aa, Influenza virus
DVWMGRTI

SEQ ID NO: 277781 - protein, 8 aa, Influenza virus
VWMGRTIS

SEQ ID NO: 277782 - protein, 8 aa, Influenza virus
WMGRTISR

SEQ ID NO: 277783 - protein, 8 aa, Influenza virus
MGRTISRD

SEQ ID NO: 277784 - protein, 8 aa, Influenza virus
GRTISRDS

SEQ ID NO: 277785 - protein, 8 aa, Influenza virus
RTISRDSR

SEQ ID NO: 277786 - protein, 8 aa, Influenza virus
TISRDSRS

SEQ ID NO: 277787 - protein, 8 aa, Influenza virus
ISRDSRSG

SEQ ID NO: 277788 - protein, 8 aa, Influenza virus
SRDSRSGY

SEQ ID NO: 277789 - protein, 8 aa, Influenza virus
RDSRSGYE

SEQ ID NO: 277790 - protein, 8 aa, Influenza virus
DSRSGYET

SEQ ID NO: 277791 - protein, 8 aa, Influenza virus
SRSGYETF

SEQ ID NO: 277792 - protein, 8 aa, Influenza virus
RSGYETFR

SEQ ID NO: 277793 - protein, 8 aa, Influenza virus
SGYETFRV

SEQ ID NO: 277794 - protein, 8 aa, Influenza virus
GYETFRVI

SEQ ID NO: 277795 - protein, 8 aa, Influenza virus
YETFRVIG

SEQ ID NO: 277796 - protein, 8 aa, Influenza virus
ETFRVIGG

SEQ ID NO: 277797 - protein, 8 aa, Influenza virus
TFRVIGGW

SEQ ID NO: 277798 - protein, 8 aa, Influenza virus
FRVIGGWT

SEQ ID NO: 277799 - protein, 8 aa, Influenza virus
VIGGWTTA

SEQ ID NO: 277800 - protein, 8 aa, Influenza virus
IGGWTTAN

SEQ ID NO: 277801 - protein, 8 aa, Influenza virus
GGWTTANS

SEQ ID NO: 277802 - protein, 8 aa, Influenza virus
GWTTANSK

SEQ ID NO: 277803 - protein, 8 aa, Influenza virus
WTTANSKS

SEQ ID NO: 277804 - protein, 8 aa, Influenza virus
TTANSKSQ

SEQ ID NO: 277805 - protein, 8 aa, Influenza virus
TANSKSQT

SEQ ID NO: 277806 - protein, 8 aa, Influenza virus
RQVIVDNN

SEQ ID NO: 277807 - protein, 8 aa, Influenza virus
QVIVDNNN

SEQ ID NO: 277808 - protein, 8 aa, Influenza virus
VIVDNNNW

SEQ ID NO: 277809 - protein, 8 aa, Influenza virus
IVDNNNWS

SEQ ID NO: 277810 - protein, 8 aa, Influenza virus
VDNNNWSG

SEQ ID NO: 277811 - protein, 8 aa, Influenza virus
DNNNWSGY

SEQ ID NO: 277812 - protein, 8 aa, Influenza virus
NNNWSGYS

SEQ ID NO: 277813 - protein, 8 aa, Influenza virus
NNWSGYSG

SEQ ID NO: 277814 - protein, 8 aa, Influenza virus
NWSGYSGI

SEQ ID NO: 277815 - protein, 8 aa, Influenza virus
WSGYSGIF

SEQ ID NO: 277816 - protein, 8 aa, Influenza virus
SGYSGIFS

SEQ ID NO: 277817 - protein, 8 aa, Influenza virus
GYSGIFSV

SEQ ID NO: 277818 - protein, 8 aa, Influenza virus
YSGIFSVE

SEQ ID NO: 277819 - protein, 8 aa, Influenza virus
GIFSVEHK

SEQ ID NO: 277820 - protein, 8 aa, Influenza virus
KSCINRCF

SEQ ID NO: 277821 - protein, 8 aa, Influenza virus
SCINRCFY

SEQ ID NO: 277822 - protein, 8 aa, Influenza virus
CINRCFYV

SEQ ID NO: 277823 - protein, 8 aa, Influenza virus
INRCFYVE

SEQ ID NO: 277824 - protein, 8 aa, Influenza virus
NRCFYVEL

SEQ ID NO: 277825 - protein, 8 aa, Influenza virus
RCFYVELI

SEQ ID NO: 277826 - protein, 8 aa, Influenza virus
CFYVELIR

SEQ ID NO: 277827 - protein, 8 aa, Influenza virus
FYVELIRG

SEQ ID NO: 277828 - protein, 8 aa, Influenza virus
YVELIRGR

SEQ ID NO: 277829 - protein, 8 aa, Influenza virus
VELIRGRP

SEQ ID NO: 277830 - protein, 8 aa, Influenza virus
ELIRGRPK

SEQ ID NO: 277831 - protein, 8 aa, Influenza virus
LIRGRPKE

SEQ ID NO: 277832 - protein, 8 aa, Influenza virus
IRGRPKET

SEQ ID NO: 277833 - protein, 8 aa, Influenza virus
PKETRVWW

SEQ ID NO: 277834 - protein, 8 aa, Influenza virus
KETRVWWT

SEQ ID NO: 277835 - protein, 8 aa, Influenza virus
ETRVWWTS

SEQ ID NO: 277836 - protein, 8 aa, Influenza virus
TRVWWTSN

SEQ ID NO: 277837 - protein, 8 aa, Influenza virus
RVWWTSNS

SEQ ID NO: 277838 - protein, 8 aa, Influenza virus
VWWTSNSI

SEQ ID NO: 277839 - protein, 8 aa, Influenza virus
WWTSNSIV

SEQ ID NO: 277840 - protein, 8 aa, Influenza virus
WTSNSIVV

SEQ ID NO: 277841 - protein, 8 aa, Influenza virus
TSNSIVVF

SEQ ID NO: 277842 - protein, 8 aa, Influenza virus
SNSIVVFC

SEQ ID NO: 277843 - protein, 8 aa, Influenza virus
NSIVVFCG

SEQ ID NO: 277844 - protein, 8 aa, Influenza virus
SIVVFCGT

SEQ ID NO: 277845 - protein, 8 aa, Influenza virus
IVVFCGTS

SEQ ID NO: 277846 - protein, 8 aa, Influenza virus
VVFCGTSG

SEQ ID NO: 277847 - protein, 8 aa, Influenza virus
VFCGTSGT

SEQ ID NO: 277848 - protein, 8 aa, Influenza virus
FCGTSGTY

SEQ ID NO: 277849 - protein, 8 aa, Influenza virus
CGTSGTYG

SEQ ID NO: 277850 - protein, 8 aa, Influenza virus
GTSGTYGT

SEQ ID NO: 277851 - protein, 8 aa, Influenza virus
TSGTYGTG

SEQ ID NO: 277852 - protein, 8 aa, Influenza virus
SGTYGTGS

SEQ ID NO: 277853 - protein, 8 aa, Influenza virus
GTYGTGSW

SEQ ID NO: 277854 - protein, 8 aa, Influenza virus
TYGTGSWP

SEQ ID NO: 277855 - protein, 8 aa, Influenza virus
YGTGSWPD

SEQ ID NO: 277856 - protein, 8 aa, Influenza virus
GTGSWPDG

SEQ ID NO: 277857 - protein, 8 aa, Influenza virus
TGSWPDGA

SEQ ID NO: 277858 - protein, 8 aa, Influenza virus
GSWPDGAN

SEQ ID NO: 277859 - protein, 8 aa, Influenza virus
SWPDGANI

SEQ ID NO: 277860 - protein, 8 aa, Influenza virus
WPDGANIN

SEQ ID NO: 277861 - protein, 8 aa, Influenza virus
PDGANINF

SEQ ID NO: 277862 - protein, 8 aa, Influenza virus
DGANINFM

SEQ ID NO: 277863 - protein, 8 aa, Influenza virus
GANINFMP

SEQ ID NO: 277864 - protein, 8 aa, Influenza virus
SKSRGYKM

SEQ ID NO: 277865 - protein, 8 aa, Influenza virus
KSRGYKMN

SEQ ID NO: 277866 - protein, 8 aa, Influenza virus
SRGYKMNT

SEQ ID NO: 277867 - protein, 8 aa, Influenza virus
RGYKMNTQ

SEQ ID NO: 277868 - protein, 8 aa, Influenza virus
GYKMNTQI

SEQ ID NO: 277869 - protein, 8 aa, Influenza virus
YKMNTQIL

SEQ ID NO: 277870 - protein, 8 aa, Influenza virus
KMNTQILV

SEQ ID NO: 277871 - protein, 8 aa, Influenza virus
GDKICLGH

SEQ ID NO: 277872 - protein, 8 aa, Influenza virus
DKICLGHH

SEQ ID NO: 277873 - protein, 8 aa, Influenza virus
KICLGHHA

SEQ ID NO: 277874 - protein, 8 aa, Influenza virus
ICLGHHAV

SEQ ID NO: 277875 - protein, 8 aa, Influenza virus
CLGHHAVA

SEQ ID NO: 277876 - protein, 8 aa, Influenza virus
LGHHAVAN

SEQ ID NO: 277877 - protein, 8 aa, Influenza virus
GHHAVANG

SEQ ID NO: 277878 - protein, 8 aa, Influenza virus
HHAVANGT

SEQ ID NO: 277879 - protein, 8 aa, Influenza virus
HAVANGTK

SEQ ID NO: 277880 - protein, 8 aa, Influenza virus
AVANGTKV

SEQ ID NO: 277881 - protein, 8 aa, Influenza virus
NGTKVNTL

SEQ ID NO: 277882 - protein, 8 aa, Influenza virus
GTKVNTLT

SEQ ID NO: 277883 - protein, 8 aa, Influenza virus
TKVNTLTE

SEQ ID NO: 277884 - protein, 8 aa, Influenza virus
VNTLTERG

SEQ ID NO: 277885 - protein, 8 aa, Influenza virus
NTLTERGI

SEQ ID NO: 277886 - protein, 8 aa, Influenza virus
TLTERGIE

SEQ ID NO: 277887 - protein, 8 aa, Influenza virus
LTERGIEV

SEQ ID NO: 277888 - protein, 8 aa, Influenza virus
TERGIEVV

SEQ ID NO: 277889 - protein, 8 aa, Influenza virus
ERGIEVVN

SEQ ID NO: 277890 - protein, 8 aa, Influenza virus
RGIEVVNA

SEQ ID NO: 277891 - protein, 8 aa, Influenza virus
GIEVVNAT

SEQ ID NO: 277892 - protein, 8 aa, Influenza virus
IEVVNATE

SEQ ID NO: 277893 - protein, 8 aa, Influenza virus
EVVNATET

SEQ ID NO: 277894 - protein, 8 aa, Influenza virus
VVNATETV

SEQ ID NO: 277895 - protein, 8 aa, Influenza virus
VNATETVE

SEQ ID NO: 277896 - protein, 8 aa, Influenza virus
NATETVET

SEQ ID NO: 277897 - protein, 8 aa, Influenza virus
TDLGQCGL

SEQ ID NO: 277898 - protein, 8 aa, Influenza virus
DLGQCGLL

SEQ ID NO: 277899 - protein, 8 aa, Influenza virus
LGQCGLLG

SEQ ID NO: 277900 - protein, 8 aa, Influenza virus
GQCGLLGT

SEQ ID NO: 277901 - protein, 8 aa, Influenza virus
QCGLLGTL

SEQ ID NO: 277902 - protein, 8 aa, Influenza virus
CGLLGTLI

SEQ ID NO: 277903 - protein, 8 aa, Influenza virus
GLLGTLIG

SEQ ID NO: 277904 - protein, 8 aa, Influenza virus
LLGTLIGP

SEQ ID NO: 277905 - protein, 8 aa, Influenza virus
LGTLIGPP

SEQ ID NO: 277906 - protein, 8 aa, Influenza virus
GTLIGPPQ

SEQ ID NO: 277907 - protein, 8 aa, Influenza virus
TLIGPPQC

SEQ ID NO: 277908 - protein, 8 aa, Influenza virus
LIGPPQCD

SEQ ID NO: 277909 - protein, 8 aa, Influenza virus
IGPPQCDQ

SEQ ID NO: 277910 - protein, 8 aa, Influenza virus
GPPQCDQF

SEQ ID NO: 277911 - protein, 8 aa, Influenza virus
PPQCDQFL

SEQ ID NO: 277912 - protein, 8 aa, Influenza virus
PQCDQFLE

SEQ ID NO: 277913 - protein, 8 aa, Influenza virus
QCDQFLEF

SEQ ID NO: 277914 - protein, 8 aa, Influenza virus
ADLIIERR

SEQ ID NO: 277915 - protein, 8 aa, Influenza virus
DLIIERRE

SEQ ID NO: 277916 - protein, 8 aa, Influenza virus
LIIERREG

SEQ ID NO: 277917 - protein, 8 aa, Influenza virus
GTDVCYPG

SEQ ID NO: 277918 - protein, 8 aa, Influenza virus
DVCYPGKF

SEQ ID NO: 277919 - protein, 8 aa, Influenza virus
VCYPGKFT

SEQ ID NO: 277920 - protein, 8 aa, Influenza virus
CYPGKFTN

SEQ ID NO: 277921 - protein, 8 aa, Influenza virus
ESLRQILR

SEQ ID NO: 277922 - protein, 8 aa, Influenza virus
LRQILRGS

SEQ ID NO: 277923 - protein, 8 aa, Influenza virus
RQILRGSG

SEQ ID NO: 277924 - protein, 8 aa, Influenza virus
QILRGSGG

SEQ ID NO: 277925 - protein, 8 aa, Influenza virus
ILRGSGGI

SEQ ID NO: 277926 - protein, 8 aa, Influenza virus
KESMGFTY

SEQ ID NO: 277927 - protein, 8 aa, Influenza virus
GFTYSGIR

SEQ ID NO: 277928 - protein, 8 aa, Influenza virus
FTYSGIRT

SEQ ID NO: 277929 - protein, 8 aa, Influenza virus
GSSFYAEM

SEQ ID NO: 277930 - protein, 8 aa, Influenza virus
SSSFYAEM

SEQ ID NO: 277931 - protein, 8 aa, Influenza virus
SSFYAEMK

SEQ ID NO: 277932 - protein, 8 aa, Influenza virus
SFYAEMKW

SEQ ID NO: 277933 - protein, 8 aa, Influenza virus
FYAEMKWL

SEQ ID NO: 277934 - protein, 8 aa, Influenza virus
YAEMKWLL

SEQ ID NO: 277935 - protein, 8 aa, Influenza virus
AEMKWLLS

SEQ ID NO: 277936 - protein, 8 aa, Influenza virus
EMKWLLSN

SEQ ID NO: 277937 - protein, 8 aa, Influenza virus
MKWLLSNS

SEQ ID NO: 277938 - protein, 8 aa, Influenza virus
KWLLSNSD

SEQ ID NO: 277939 - protein, 8 aa, Influenza virus
WLLSNSDN

SEQ ID NO: 277940 - protein, 8 aa, Influenza virus
FPQMTKSY

SEQ ID NO: 277941 - protein, 8 aa, Influenza virus
PALIIWGV

SEQ ID NO: 277942 - protein, 8 aa, Influenza virus
ALIIWGVH

SEQ ID NO: 277943 - protein, 8 aa, Influenza virus
LIIWGVHH

SEQ ID NO: 277944 - protein, 8 aa, Influenza virus
IIWGVHHS

SEQ ID NO: 277945 - protein, 8 aa, Influenza virus
WGVHHSGS

SEQ ID NO: 277946 - protein, 8 aa, Influenza virus
EQTKLYGS

SEQ ID NO: 277947 - protein, 8 aa, Influenza virus
QTKLYGSG

SEQ ID NO: 277948 - protein, 8 aa, Influenza virus
KLYGSGNK

SEQ ID NO: 277949 - protein, 8 aa, Influenza virus
LYGSGNKL

SEQ ID NO: 277950 - protein, 8 aa, Influenza virus
YGSGNKLI

SEQ ID NO: 277951 - protein, 8 aa, Influenza virus
GSGNKLIT

SEQ ID NO: 277952 - protein, 8 aa, Influenza virus
SGNKLITV

SEQ ID NO: 277953 - protein, 8 aa, Influenza virus
KLITVGSS

SEQ ID NO: 277954 - protein, 8 aa, Influenza virus
SSKYQQSF

SEQ ID NO: 277955 - protein, 8 aa, Influenza virus
SKYQQSFT

SEQ ID NO: 277956 - protein, 8 aa, Influenza virus
KYQQSFTP

SEQ ID NO: 277957 - protein, 8 aa, Influenza virus
YQQSFTPS

SEQ ID NO: 277958 - protein, 8 aa, Influenza virus
QQSFTPSP

SEQ ID NO: 277959 - protein, 8 aa, Influenza virus
QSFTPSPG

SEQ ID NO: 277960 - protein, 8 aa, Influenza virus
SFTPSPGA

SEQ ID NO: 277961 - protein, 8 aa, Influenza virus
FTPSPGAR

SEQ ID NO: 277962 - protein, 8 aa, Influenza virus
QVNGQSGR

SEQ ID NO: 277963 - protein, 8 aa, Influenza virus
VNGQSGRI

SEQ ID NO: 277964 - protein, 8 aa, Influenza virus
NGQSGRID

SEQ ID NO: 277965 - protein, 8 aa, Influenza virus
GQSGRIDF

SEQ ID NO: 277966 - protein, 8 aa, Influenza virus
QSGRIDFH

SEQ ID NO: 277967 - protein, 8 aa, Influenza virus
SGRIDFHW

SEQ ID NO: 277968 - protein, 8 aa, Influenza virus
GRIDFHWL

SEQ ID NO: 277969 - protein, 8 aa, Influenza virus
FHWLLLDP

SEQ ID NO: 277970 - protein, 8 aa, Influenza virus
HWLLLDPN

SEQ ID NO: 277971 - protein, 8 aa, Influenza virus
WLLLDPND

SEQ ID NO: 277972 - protein, 8 aa, Influenza virus
LLLDPNDT

SEQ ID NO: 277973 - protein, 8 aa, Influenza virus
LLDPNDTV

SEQ ID NO: 277974 - protein, 8 aa, Influenza virus
LDPNDTVT

SEQ ID NO: 277975 - protein, 8 aa, Influenza virus
DPNDTVTF

SEQ ID NO: 277976 - protein, 8 aa, Influenza virus
NDTVTFTF

SEQ ID NO: 277977 - protein, 8 aa, Influenza virus
DTVTFTFN

SEQ ID NO: 277978 - protein, 8 aa, Influenza virus
TVTFTFNG

SEQ ID NO: 277979 - protein, 8 aa, Influenza virus
TFTFNGAF

SEQ ID NO: 277980 - protein, 8 aa, Influenza virus
FTFNGAFI

SEQ ID NO: 277981 - protein, 8 aa, Influenza virus
TFNGAFIA

SEQ ID NO: 277982 - protein, 8 aa, Influenza virus
FNGAFIAP

SEQ ID NO: 277983 - protein, 8 aa, Influenza virus
NGAFIAPD

SEQ ID NO: 277984 - protein, 8 aa, Influenza virus
GAFIAPDR

SEQ ID NO: 277985 - protein, 8 aa, Influenza virus
AFIAPDRA

SEQ ID NO: 277986 - protein, 8 aa, Influenza virus
FIAPDRAS

SEQ ID NO: 277987 - protein, 8 aa, Influenza virus
IAPDRASF

SEQ ID NO: 277988 - protein, 8 aa, Influenza virus
APDRASFF

SEQ ID NO: 277989 - protein, 8 aa, Influenza virus
CFHSGGTI

SEQ ID NO: 277990 - protein, 8 aa, Influenza virus
GGTIVSSL

SEQ ID NO: 277991 - protein, 8 aa, Influenza virus
GTIVSSLP

SEQ ID NO: 277992 - protein, 8 aa, Influenza virus
TIVSSLPF

SEQ ID NO: 277993 - protein, 8 aa, Influenza virus
IVSSLPFQ

SEQ ID NO: 277994 - protein, 8 aa, Influenza virus
VSSLPFQN

SEQ ID NO: 277995 - protein, 8 aa, Influenza virus
SSLPFQNI

SEQ ID NO: 277996 - protein, 8 aa, Influenza virus
SLPFQNIN

SEQ ID NO: 277997 - protein, 8 aa, Influenza virus
LPFQNINP

SEQ ID NO: 277998 - protein, 8 aa, Influenza virus
PFQNINPR

SEQ ID NO: 277999 - protein, 8 aa, Influenza virus
FQNINPRT

SEQ ID NO: 278000 - protein, 8 aa, Influenza virus
VGKCPRYV

SEQ ID NO: 278001 - protein, 8 aa, Influenza virus
GKCPRYVK

SEQ ID NO: 278002 - protein, 8 aa, Influenza virus
KCPRYVKQ

SEQ ID NO: 278003 - protein, 8 aa, Influenza virus
SLLLATGM

SEQ ID NO: 278004 - protein, 8 aa, Influenza virus
LLLATGMR

SEQ ID NO: 278005 - protein, 8 aa, Influenza virus
LLATGMRN

SEQ ID NO: 278006 - protein, 8 aa, Influenza virus
LATGMRNV

SEQ ID NO: 278007 - protein, 8 aa, Influenza virus
ATGMRNVP

SEQ ID NO: 278008 - protein, 8 aa, Influenza virus
TGMRNVPE

SEQ ID NO: 278009 - protein, 8 aa, Influenza virus
GMRNVPEN

SEQ ID NO: 278010 - protein, 8 aa, Influenza virus
MRNVPENP

SEQ ID NO: 278011 - protein, 8 aa, Influenza virus
RNVPENPK

SEQ ID NO: 278012 - protein, 8 aa, Influenza virus
CSPLSRCR

SEQ ID NO: 278013 - protein, 8 aa, Influenza virus
RKRGLFGA

SEQ ID NO: 278014 - protein, 8 aa, Influenza virus
LSRCRETR

SEQ ID NO: 278015 - protein, 8 aa, Influenza virus
SRCRETRG

SEQ ID NO: 278016 - protein, 8 aa, Influenza virus
RCRETRGL

SEQ ID NO: 278017 - protein, 8 aa, Influenza virus
KRMTRGLF

SEQ ID NO: 278018 - protein, 8 aa, Influenza virus
RMTRGLFG

SEQ ID NO: 278019 - protein, 8 aa, Influenza virus
MTRGLFGA

SEQ ID NO: 278020 - protein, 8 aa, Influenza virus
TRGLFGAI

SEQ ID NO: 278021 - protein, 8 aa, Influenza virus
TKPRPRRG

SEQ ID NO: 278022 - protein, 8 aa, Influenza virus
KPRPRRGL

SEQ ID NO: 278023 - protein, 8 aa, Influenza virus
PRPRRGLF

SEQ ID NO: 278024 - protein, 8 aa, Influenza virus
RPRRGLFG

SEQ ID NO: 278025 - protein, 8 aa, Influenza virus
PRRGLFGA

SEQ ID NO: 278026 - protein, 8 aa, Influenza virus
RRGLFGAI

SEQ ID NO: 278027 - protein, 8 aa, Influenza virus
RGLFGAIA

SEQ ID NO: 278028 - protein, 8 aa, Influenza virus
GLFGAIAG

SEQ ID NO: 278029 - protein, 8 aa, Influenza virus
LFGAIAGF

SEQ ID NO: 278030 - protein, 8 aa, Influenza virus
FGAIAGFI

SEQ ID NO: 278031 - protein, 8 aa, Influenza virus
GAIAGFIE

SEQ ID NO: 278032 - protein, 8 aa, Influenza virus
AIAGFIEN

SEQ ID NO: 278033 - protein, 8 aa, Influenza virus
IAGFIENG

SEQ ID NO: 278034 - protein, 8 aa, Influenza virus
AGFIENGW

SEQ ID NO: 278035 - protein, 8 aa, Influenza virus
GFIENGWE

SEQ ID NO: 278036 - protein, 8 aa, Influenza virus
FIENGWEG

SEQ ID NO: 278037 - protein, 8 aa, Influenza virus
IENGWEGL

SEQ ID NO: 278038 - protein, 8 aa, Influenza virus
ENGWEGLI

SEQ ID NO: 278039 - protein, 8 aa, Influenza virus
NGWEGLID

SEQ ID NO: 278040 - protein, 8 aa, Influenza virus
GWEGLIDG

SEQ ID NO: 278041 - protein, 8 aa, Influenza virus
WEGLIDGW

SEQ ID NO: 278042 - protein, 8 aa, Influenza virus
EGLIDGWY

SEQ ID NO: 278043 - protein, 8 aa, Influenza virus
GLIDGWYG

SEQ ID NO: 278044 - protein, 8 aa, Influenza virus
LIDGWYGF

SEQ ID NO: 278045 - protein, 8 aa, Influenza virus
IDGWYGFR

SEQ ID NO: 278046 - protein, 8 aa, Influenza virus
DGWYGFRH

SEQ ID NO: 278047 - protein, 8 aa, Influenza virus
GWYGFRHQ

SEQ ID NO: 278048 - protein, 8 aa, Influenza virus
WYGFRHQN

SEQ ID NO: 278049 - protein, 8 aa, Influenza virus
YGFRHQNA

SEQ ID NO: 278050 - protein, 8 aa, Influenza virus
GFRHQNAQ

SEQ ID NO: 278051 - protein, 8 aa, Influenza virus
FRHQNAQG

SEQ ID NO: 278052 - protein, 8 aa, Influenza virus
RHQNAQGE

SEQ ID NO: 278053 - protein, 8 aa, Influenza virus
HQNAQGEG

SEQ ID NO: 278054 - protein, 8 aa, Influenza virus
QNAQGEGT

SEQ ID NO: 278055 - protein, 8 aa, Influenza virus
NAQGEGTA

SEQ ID NO: 278056 - protein, 8 aa, Influenza virus
AQGEGTAA

SEQ ID NO: 278057 - protein, 8 aa, Influenza virus
QGEGTAAD

SEQ ID NO: 278058 - protein, 8 aa, Influenza virus
GEGTAADY

SEQ ID NO: 278059 - protein, 8 aa, Influenza virus
EGTAADYK

SEQ ID NO: 278060 - protein, 8 aa, Influenza virus
GTAADYKS

SEQ ID NO: 278061 - protein, 8 aa, Influenza virus
TAADYKST

SEQ ID NO: 278062 - protein, 8 aa, Influenza virus
AADYKSTQ

SEQ ID NO: 278063 - protein, 8 aa, Influenza virus
ADYKSTQS

SEQ ID NO: 278064 - protein, 8 aa, Influenza virus
DYKSTQSA

SEQ ID NO: 278065 - protein, 8 aa, Influenza virus
YKSTQSAI

SEQ ID NO: 278066 - protein, 8 aa, Influenza virus
KSTQSAID

SEQ ID NO: 278067 - protein, 8 aa, Influenza virus
STQSAIDQ

SEQ ID NO: 278068 - protein, 8 aa, Influenza virus
TQSAIDQI

SEQ ID NO: 278069 - protein, 8 aa, Influenza virus
QSAIDQIT

SEQ ID NO: 278070 - protein, 8 aa, Influenza virus
SAIDQITG

SEQ ID NO: 278071 - protein, 8 aa, Influenza virus
AIDQITGK

SEQ ID NO: 278072 - protein, 8 aa, Influenza virus
IDQITGKL

SEQ ID NO: 278073 - protein, 8 aa, Influenza virus
DQITGKLN

SEQ ID NO: 278074 - protein, 8 aa, Influenza virus
QITGKLNR

SEQ ID NO: 278075 - protein, 8 aa, Influenza virus
ITGKLNRL

SEQ ID NO: 278076 - protein, 8 aa, Influenza virus
TGKLNRLI

SEQ ID NO: 278077 - protein, 8 aa, Influenza virus
GKLNRLID

SEQ ID NO: 278078 - protein, 8 aa, Influenza virus
KLNRLIDK

SEQ ID NO: 278079 - protein, 8 aa, Influenza virus
LNRLIDKT

SEQ ID NO: 278080 - protein, 8 aa, Influenza virus
NRLIDKTN

SEQ ID NO: 278081 - protein, 8 aa, Influenza virus
RLIDKTNQ

SEQ ID NO: 278082 - protein, 8 aa, Influenza virus
LIDKTNQQ

SEQ ID NO: 278083 - protein, 8 aa, Influenza virus
IDKTNQQF

SEQ ID NO: 278084 - protein, 8 aa, Influenza virus
DKTNQQFE

SEQ ID NO: 278085 - protein, 8 aa, Influenza virus
KTNQQFEL

SEQ ID NO: 278086 - protein, 8 aa, Influenza virus
TNQQFELI

SEQ ID NO: 278087 - protein, 8 aa, Influenza virus
NQQFELID

SEQ ID NO: 278088 - protein, 8 aa, Influenza virus
QQFELIDN

SEQ ID NO: 278089 - protein, 8 aa, Influenza virus
QFELIDNE

SEQ ID NO: 278090 - protein, 8 aa, Influenza virus
FELIDNEF

SEQ ID NO: 278091 - protein, 8 aa, Influenza virus
LIDNEFTE

SEQ ID NO: 278092 - protein, 8 aa, Influenza virus
IDNEFNEI

SEQ ID NO: 278093 - protein, 8 aa, Influenza virus
DNEFNEIE

SEQ ID NO: 278094 - protein, 8 aa, Influenza virus
FNEIEQQI

SEQ ID NO: 278095 - protein, 8 aa, Influenza virus
NEIEQQIG

SEQ ID NO: 278096 - protein, 8 aa, Influenza virus
EIEQQIGN

SEQ ID NO: 278097 - protein, 8 aa, Influenza virus
IEQQIGNV

SEQ ID NO: 278098 - protein, 8 aa, Influenza virus
EQQIGNVI

SEQ ID NO: 278099 - protein, 8 aa, Influenza virus
QQIGNVIN

SEQ ID NO: 278100 - protein, 8 aa, Influenza virus
QIGNVINW

SEQ ID NO: 278101 - protein, 8 aa, Influenza virus
IGNVINWT

SEQ ID NO: 278102 - protein, 8 aa, Influenza virus
GNVINWTR

SEQ ID NO: 278103 - protein, 8 aa, Influenza virus
NVINWTRD

SEQ ID NO: 278104 - protein, 8 aa, Influenza virus
VINWTRDS

SEQ ID NO: 278105 - protein, 8 aa, Influenza virus
INWTRDSM

SEQ ID NO: 278106 - protein, 8 aa, Influenza virus
NWTRDSMT

SEQ ID NO: 278107 - protein, 8 aa, Influenza virus
WTRDSMTE

SEQ ID NO: 278108 - protein, 8 aa, Influenza virus
TRDSMTEV

SEQ ID NO: 278109 - protein, 8 aa, Influenza virus
RDSMTEVW

SEQ ID NO: 278110 - protein, 8 aa, Influenza virus
DSMTEVWS

SEQ ID NO: 278111 - protein, 8 aa, Influenza virus
SMTEVWSY

SEQ ID NO: 278112 - protein, 8 aa, Influenza virus
MTEVWSYN

SEQ ID NO: 278113 - protein, 8 aa, Influenza virus
TEVWSYNA

SEQ ID NO: 278114 - protein, 8 aa, Influenza virus
EVWSYNAE

SEQ ID NO: 278115 - protein, 8 aa, Influenza virus
VWSYNAEL

SEQ ID NO: 278116 - protein, 8 aa, Influenza virus
WSYNAELL

SEQ ID NO: 278117 - protein, 8 aa, Influenza virus
SYNAELLV

SEQ ID NO: 278118 - protein, 8 aa, Influenza virus
YNAELLVA

SEQ ID NO: 278119 - protein, 8 aa, Influenza virus
NAELLVAM

SEQ ID NO: 278120 - protein, 8 aa, Influenza virus
AELLVAME

SEQ ID NO: 278121 - protein, 8 aa, Influenza virus
ELLVAMEN

SEQ ID NO: 278122 - protein, 8 aa, Influenza virus
LLVAMENQ

SEQ ID NO: 278123 - protein, 8 aa, Influenza virus
LVAMENQH

SEQ ID NO: 278124 - protein, 8 aa, Influenza virus
VAMENQHT

SEQ ID NO: 278125 - protein, 8 aa, Influenza virus
AMENQHTI

SEQ ID NO: 278126 - protein, 8 aa, Influenza virus
MENQHTID

SEQ ID NO: 278127 - protein, 8 aa, Influenza virus
ENQHTIDL

SEQ ID NO: 278128 - protein, 8 aa, Influenza virus
NQHTIDLA

SEQ ID NO: 278129 - protein, 8 aa, Influenza virus
QHTIDLAD

SEQ ID NO: 278130 - protein, 8 aa, Influenza virus
HTIDLADS

SEQ ID NO: 278131 - protein, 8 aa, Influenza virus
TIDLADSE

SEQ ID NO: 278132 - protein, 8 aa, Influenza virus
IDLADSEM

SEQ ID NO: 278133 - protein, 8 aa, Influenza virus
DLADSEMN

SEQ ID NO: 278134 - protein, 8 aa, Influenza virus
LADSEMNK

SEQ ID NO: 278135 - protein, 8 aa, Influenza virus
ADSEMNKL

SEQ ID NO: 278136 - protein, 8 aa, Influenza virus
DSEMNKLY

SEQ ID NO: 278137 - protein, 8 aa, Influenza virus
SEMNKLYE

SEQ ID NO: 278138 - protein, 8 aa, Influenza virus
EMNKLYER

SEQ ID NO: 278139 - protein, 8 aa, Influenza virus
MNKLYERV

SEQ ID NO: 278140 - protein, 8 aa, Influenza virus
KLYERVRK

SEQ ID NO: 278141 - protein, 8 aa, Influenza virus
LYERVRKQ

SEQ ID NO: 278142 - protein, 8 aa, Influenza virus
YERVRKQL

SEQ ID NO: 278143 - protein, 8 aa, Influenza virus
ERVRKQLR

SEQ ID NO: 278144 - protein, 8 aa, Influenza virus
RVRKQLRE

SEQ ID NO: 278145 - protein, 8 aa, Influenza virus
VRKQLREN

SEQ ID NO: 278146 - protein, 8 aa, Influenza virus
RKQLRENA

SEQ ID NO: 278147 - protein, 8 aa, Influenza virus
KQLRENAE

SEQ ID NO: 278148 - protein, 8 aa, Influenza virus
QLRENAEE

SEQ ID NO: 278149 - protein, 8 aa, Influenza virus
LRENAEED

SEQ ID NO: 278150 - protein, 8 aa, Influenza virus
RENAEEDG

SEQ ID NO: 278151 - protein, 8 aa, Influenza virus
ENAEEDGT

SEQ ID NO: 278152 - protein, 8 aa, Influenza virus
NAEEDGTG

SEQ ID NO: 278153 - protein, 8 aa, Influenza virus
AEEDGTGC

SEQ ID NO: 278154 - protein, 8 aa, Influenza virus
EEDGTGCF

SEQ ID NO: 278155 - protein, 8 aa, Influenza virus
EDGTGCFE

SEQ ID NO: 278156 - protein, 8 aa, Influenza virus
DGTGCFEI

SEQ ID NO: 278157 - protein, 8 aa, Influenza virus
GTGCFEIF

SEQ ID NO: 278158 - protein, 8 aa, Influenza virus
TGCFEIFH

SEQ ID NO: 278159 - protein, 8 aa, Influenza virus
GCFEIFHK

SEQ ID NO: 278160 - protein, 8 aa, Influenza virus
CFEIFHKC

SEQ ID NO: 278161 - protein, 8 aa, Influenza virus
FEIFHKCD

SEQ ID NO: 278162 - protein, 8 aa, Influenza virus
EIFHKCDD

SEQ ID NO: 278163 - protein, 8 aa, Influenza virus
QCMESIRN

SEQ ID NO: 278164 - protein, 8 aa, Influenza virus
CMESIRNN

SEQ ID NO: 278165 - protein, 8 aa, Influenza virus
MESIRNNT

SEQ ID NO: 278166 - protein, 8 aa, Influenza virus
ESIRNNTY

SEQ ID NO: 278167 - protein, 8 aa, Influenza virus
SIRNNTYD

SEQ ID NO: 278168 - protein, 8 aa, Influenza virus
IRNNTYDH

SEQ ID NO: 278169 - protein, 8 aa, Influenza virus
RNNTYDHT

SEQ ID NO: 278170 - protein, 8 aa, Influenza virus
TYDHTQYR

SEQ ID NO: 278171 - protein, 8 aa, Influenza virus
QYRTESLQ

SEQ ID NO: 278172 - protein, 8 aa, Influenza virus
YRTESLQN

SEQ ID NO: 278173 - protein, 8 aa, Influenza virus
RTESLQNR

SEQ ID NO: 278174 - protein, 8 aa, Influenza virus
TESLQNRI

SEQ ID NO: 278175 - protein, 8 aa, Influenza virus
ESLQNRIQ

SEQ ID NO: 278176 - protein, 8 aa, Influenza virus
SLQNRIQI

SEQ ID NO: 278177 - protein, 8 aa, Influenza virus
QNRIQIDP

SEQ ID NO: 278178 - protein, 8 aa, Influenza virus
NRIQIDPV

SEQ ID NO: 278179 - protein, 8 aa, Influenza virus
RIQIDPVK

SEQ ID NO: 278180 - protein, 8 aa, Influenza virus
IQIDPVKL

SEQ ID NO: 278181 - protein, 8 aa, Influenza virus
DPVKLSSG

SEQ ID NO: 278182 - protein, 8 aa, Influenza virus
PVKLSSGY

SEQ ID NO: 278183 - protein, 8 aa, Influenza virus
VKLSSGYK

SEQ ID NO: 278184 - protein, 8 aa, Influenza virus
KLSSGYKD

SEQ ID NO: 278185 - protein, 8 aa, Influenza virus
SSGYKDII

SEQ ID NO: 278186 - protein, 8 aa, Influenza virus
SGYKDIIL

SEQ ID NO: 278187 - protein, 8 aa, Influenza virus
GYKDIILW

SEQ ID NO: 278188 - protein, 8 aa, Influenza virus
YKDIILWF

SEQ ID NO: 278189 - protein, 8 aa, Influenza virus
KDIILWFS

SEQ ID NO: 278190 - protein, 8 aa, Influenza virus
DIILWFSF

SEQ ID NO: 278191 - protein, 8 aa, Influenza virus
IILWFSFG

SEQ ID NO: 278192 - protein, 8 aa, Influenza virus
ILWFSFGA

SEQ ID NO: 278193 - protein, 8 aa, Influenza virus
LWFSFGAS

SEQ ID NO: 278194 - protein, 8 aa, Influenza virus
WFSFGASC

SEQ ID NO: 278195 - protein, 8 aa, Influenza virus
FSFGASCF

SEQ ID NO: 278196 - protein, 8 aa, Influenza virus
SFGASCFL

SEQ ID NO: 278197 - protein, 8 aa, Influenza virus
FGASCFLL

SEQ ID NO: 278198 - protein, 8 aa, Influenza virus
GASCFLLL

SEQ ID NO: 278199 - protein, 8 aa, Influenza virus
ASCFLLLA

SEQ ID NO: 278200 - protein, 8 aa, Influenza virus
SCFLLLAI

SEQ ID NO: 278201 - protein, 8 aa, Influenza virus
FICIKNGN

SEQ ID NO: 278202 - protein, 8 aa, Influenza virus
ICIKNGNM

SEQ ID NO: 278203 - protein, 8 aa, Influenza virus
CIKNGNMR

SEQ ID NO: 278204 - protein, 8 aa, Influenza virus
IKNGNMRC

SEQ ID NO: 278205 - protein, 8 aa, Influenza virus
KNGNMRCT

SEQ ID NO: 278206 - protein, 8 aa, Influenza virus
NGNMRCTI

SEQ ID NO: 278207 - protein, 8 aa, Influenza virus
GNMRCTIC

SEQ ID NO: 278208 - protein, 8 aa, Influenza virus
NMRCTICI

SEQ ID NO: 278209 - protein, 8 aa, Influenza virus
GVVNTTLS

SEQ ID NO: 278210 - protein, 8 aa, Influenza virus
VVNTTLST

SEQ ID NO: 278211 - protein, 8 aa, Influenza virus
VNTTLSTI

SEQ ID NO: 278212 - protein, 8 aa, Influenza virus
NTTLSTIA

SEQ ID NO: 278213 - protein, 8 aa, Influenza virus
TTLSTIAL

SEQ ID NO: 278214 - protein, 8 aa, Influenza virus
TLSTIALL

SEQ ID NO: 278215 - protein, 8 aa, Influenza virus
LSTIALLI

SEQ ID NO: 278216 - protein, 8 aa, Influenza virus
STIALLIG

SEQ ID NO: 278217 - protein, 8 aa, Influenza virus
TIALLIGV

SEQ ID NO: 278218 - protein, 8 aa, Influenza virus
IALLIGVG

SEQ ID NO: 278219 - protein, 8 aa, Influenza virus
ALLIGVGN

SEQ ID NO: 278220 - protein, 8 aa, Influenza virus
LLIGVGNL

SEQ ID NO: 278221 - protein, 8 aa, Influenza virus
IGVGNLVF

SEQ ID NO: 278222 - protein, 8 aa, Influenza virus
GVGNLVFN

SEQ ID NO: 278223 - protein, 8 aa, Influenza virus
VGNLVFNT

SEQ ID NO: 278224 - protein, 8 aa, Influenza virus
GNLVFNTV

SEQ ID NO: 278225 - protein, 8 aa, Influenza virus
NLVFNTVI

SEQ ID NO: 278226 - protein, 8 aa, Influenza virus
LVFNTVIH

SEQ ID NO: 278227 - protein, 8 aa, Influenza virus
VFNTVIHE

SEQ ID NO: 278228 - protein, 8 aa, Influenza virus
FNTVIHEK

SEQ ID NO: 278229 - protein, 8 aa, Influenza virus
ITYNNTVI

SEQ ID NO: 278230 - protein, 8 aa, Influenza virus
TYNNTVIN

SEQ ID NO: 278231 - protein, 8 aa, Influenza virus
YNNTVINN

SEQ ID NO: 278232 - protein, 8 aa, Influenza virus
NNTVINNI

SEQ ID NO: 278233 - protein, 8 aa, Influenza virus
NTVINNIT

SEQ ID NO: 278234 - protein, 8 aa, Influenza virus
TVINNITT

SEQ ID NO: 278235 - protein, 8 aa, Influenza virus
VINNITTT

SEQ ID NO: 278236 - protein, 8 aa, Influenza virus
INNITTTI

SEQ ID NO: 278237 - protein, 8 aa, Influenza virus
NNITTTII

SEQ ID NO: 278238 - protein, 8 aa, Influenza virus
NITTTIIT

SEQ ID NO: 278239 - protein, 8 aa, Influenza virus
FKSPLPLC

SEQ ID NO: 278240 - protein, 8 aa, Influenza virus
KSPLPLCP

SEQ ID NO: 278241 - protein, 8 aa, Influenza virus
SPLPLCPF

SEQ ID NO: 278242 - protein, 8 aa, Influenza virus
PLPLCPFR

SEQ ID NO: 278243 - protein, 8 aa, Influenza virus
LPLCPFRG

SEQ ID NO: 278244 - protein, 8 aa, Influenza virus
PLCPFRGF

SEQ ID NO: 278245 - protein, 8 aa, Influenza virus
LCPFRGFF

SEQ ID NO: 278246 - protein, 8 aa, Influenza virus
CPFRGFFP

SEQ ID NO: 278247 - protein, 8 aa, Influenza virus
PFRGFFPF

SEQ ID NO: 278248 - protein, 8 aa, Influenza virus
FRGFFPFH

SEQ ID NO: 278249 - protein, 8 aa, Influenza virus
RGFFPFHK

SEQ ID NO: 278250 - protein, 8 aa, Influenza virus
GFFPFHKD

SEQ ID NO: 278251 - protein, 8 aa, Influenza virus
FFPFHKDN

SEQ ID NO: 278252 - protein, 8 aa, Influenza virus
FPFHKDNA

SEQ ID NO: 278253 - protein, 8 aa, Influenza virus
PFHKDNAI

SEQ ID NO: 278254 - protein, 8 aa, Influenza virus
FHKDNAIR

SEQ ID NO: 278255 - protein, 8 aa, Influenza virus
HKDNAIRL

SEQ ID NO: 278256 - protein, 8 aa, Influenza virus
KDNAIRLG

SEQ ID NO: 278257 - protein, 8 aa, Influenza virus
DNAIRLGE

SEQ ID NO: 278258 - protein, 8 aa, Influenza virus
NAIRLGEN

SEQ ID NO: 278259 - protein, 8 aa, Influenza virus
AIRLGENK

SEQ ID NO: 278260 - protein, 8 aa, Influenza virus
DVIVTREP

SEQ ID NO: 278261 - protein, 8 aa, Influenza virus
VIVTREPY

SEQ ID NO: 278262 - protein, 8 aa, Influenza virus
IVTREPYV

SEQ ID NO: 278263 - protein, 8 aa, Influenza virus
VTREPYVS

SEQ ID NO: 278264 - protein, 8 aa, Influenza virus
TREPYVSC

SEQ ID NO: 278265 - protein, 8 aa, Influenza virus
REPYVSCD

SEQ ID NO: 278266 - protein, 8 aa, Influenza virus
EPYVSCDN

SEQ ID NO: 278267 - protein, 8 aa, Influenza virus
NCWSFALA

SEQ ID NO: 278268 - protein, 8 aa, Influenza virus
CWSFALAQ

SEQ ID NO: 278269 - protein, 8 aa, Influenza virus
WSFALAQG

SEQ ID NO: 278270 - protein, 8 aa, Influenza virus
SFALAQGA

SEQ ID NO: 278271 - protein, 8 aa, Influenza virus
FALAQGAL

SEQ ID NO: 278272 - protein, 8 aa, Influenza virus
ALAQGALL

SEQ ID NO: 278273 - protein, 8 aa, Influenza virus
LAQGALLG

SEQ ID NO: 278274 - protein, 8 aa, Influenza virus
AQGALLGT

SEQ ID NO: 278275 - protein, 8 aa, Influenza virus
QGALLGTK

SEQ ID NO: 278276 - protein, 8 aa, Influenza virus
GALLGTKH

SEQ ID NO: 278277 - protein, 8 aa, Influenza virus
ALLGTKHS

SEQ ID NO: 278278 - protein, 8 aa, Influenza virus
LLGTKHSN

SEQ ID NO: 278279 - protein, 8 aa, Influenza virus
LGTKHSNG

SEQ ID NO: 278280 - protein, 8 aa, Influenza virus
GTKHSNGT

SEQ ID NO: 278281 - protein, 8 aa, Influenza virus
HSNGTIKD

SEQ ID NO: 278282 - protein, 8 aa, Influenza virus
SNGTIKDR

SEQ ID NO: 278283 - protein, 8 aa, Influenza virus
KDRTPYRS

SEQ ID NO: 278284 - protein, 8 aa, Influenza virus
DRTPYRSL

SEQ ID NO: 278285 - protein, 8 aa, Influenza virus
RTPYRSLI

SEQ ID NO: 278286 - protein, 8 aa, Influenza virus
TPYRSLIR

SEQ ID NO: 278287 - protein, 8 aa, Influenza virus
PYRSLIRF

SEQ ID NO: 278288 - protein, 8 aa, Influenza virus
YRSLIRFP

SEQ ID NO: 278289 - protein, 8 aa, Influenza virus
RSLIRFPI

SEQ ID NO: 278290 - protein, 8 aa, Influenza virus
SLIRFPIG

SEQ ID NO: 278291 - protein, 8 aa, Influenza virus
LIRFPIGT

SEQ ID NO: 278292 - protein, 8 aa, Influenza virus
IRFPIGTA

SEQ ID NO: 278293 - protein, 8 aa, Influenza virus
RFPIGTAP

SEQ ID NO: 278294 - protein, 8 aa, Influenza virus
FPIGTAPV

SEQ ID NO: 278295 - protein, 8 aa, Influenza virus
PIGTAPVL

SEQ ID NO: 278296 - protein, 8 aa, Influenza virus
IGTAPVLG

SEQ ID NO: 278297 - protein, 8 aa, Influenza virus
GTAPVLGN

SEQ ID NO: 278298 - protein, 8 aa, Influenza virus
TAPVLGNY

SEQ ID NO: 278299 - protein, 8 aa, Influenza virus
APVLGNYK

SEQ ID NO: 278300 - protein, 8 aa, Influenza virus
PVLGNYKE

SEQ ID NO: 278301 - protein, 8 aa, Influenza virus
VLGNYKEI

SEQ ID NO: 278302 - protein, 8 aa, Influenza virus
LGNYKEIC

SEQ ID NO: 278303 - protein, 8 aa, Influenza virus
GNYKEICI

SEQ ID NO: 278304 - protein, 8 aa, Influenza virus
NYKEICIA

SEQ ID NO: 278305 - protein, 8 aa, Influenza virus
YKEICIAW

SEQ ID NO: 278306 - protein, 8 aa, Influenza virus
KEICIAWS

SEQ ID NO: 278307 - protein, 8 aa, Influenza virus
EICIAWSS

SEQ ID NO: 278308 - protein, 8 aa, Influenza virus
ICIAWSSS

SEQ ID NO: 278309 - protein, 8 aa, Influenza virus
CIAWSSSS

SEQ ID NO: 278310 - protein, 8 aa, Influenza virus
IAWSSSSC

SEQ ID NO: 278311 - protein, 8 aa, Influenza virus
AWSSSSCF

SEQ ID NO: 278312 - protein, 8 aa, Influenza virus
WSSSSCFD

SEQ ID NO: 278313 - protein, 8 aa, Influenza virus
SSSSCFDG

SEQ ID NO: 278314 - protein, 8 aa, Influenza virus
SSSCFDGK

SEQ ID NO: 278315 - protein, 8 aa, Influenza virus
SSCFDGKE

SEQ ID NO: 278316 - protein, 8 aa, Influenza virus
SCFDGKEW

SEQ ID NO: 278317 - protein, 8 aa, Influenza virus
CFDGKEWM

SEQ ID NO: 278318 - protein, 8 aa, Influenza virus
FDGKEWMH

SEQ ID NO: 278319 - protein, 8 aa, Influenza virus
DGKEWMHV

SEQ ID NO: 278320 - protein, 8 aa, Influenza virus
GKEWMHVC

SEQ ID NO: 278321 - protein, 8 aa, Influenza virus
KEWMHVCM

SEQ ID NO: 278322 - protein, 8 aa, Influenza virus
EWMHVCMT

SEQ ID NO: 278323 - protein, 8 aa, Influenza virus
WMHVCMTG

SEQ ID NO: 278324 - protein, 8 aa, Influenza virus
HVCMTGND

SEQ ID NO: 278325 - protein, 8 aa, Influenza virus
GRMTDSIK

SEQ ID NO: 278326 - protein, 8 aa, Influenza virus
RMTDSIKS

SEQ ID NO: 278327 - protein, 8 aa, Influenza virus
MTDSIKSW

SEQ ID NO: 278328 - protein, 8 aa, Influenza virus
TDSIKSWR

SEQ ID NO: 278329 - protein, 8 aa, Influenza virus
DSIKSWRK

SEQ ID NO: 278330 - protein, 8 aa, Influenza virus
SIKSWRKD

SEQ ID NO: 278331 - protein, 8 aa, Influenza virus
IKSWRKDI

SEQ ID NO: 278332 - protein, 8 aa, Influenza virus
KSWRKDIL

SEQ ID NO: 278333 - protein, 8 aa, Influenza virus
SWRKDILR

SEQ ID NO: 278334 - protein, 8 aa, Influenza virus
WRKDILRT

SEQ ID NO: 278335 - protein, 8 aa, Influenza virus
RKDILRTQ

SEQ ID NO: 278336 - protein, 8 aa, Influenza virus
KDILRTQE

SEQ ID NO: 278337 - protein, 8 aa, Influenza virus
DILRTQES

SEQ ID NO: 278338 - protein, 8 aa, Influenza virus
ILRTQESE

SEQ ID NO: 278339 - protein, 8 aa, Influenza virus
LRTQESEC

SEQ ID NO: 278340 - protein, 8 aa, Influenza virus
RTQESECQ

SEQ ID NO: 278341 - protein, 8 aa, Influenza virus
TQESECQC

SEQ ID NO: 278342 - protein, 8 aa, Influenza virus
QESECQCI

SEQ ID NO: 278343 - protein, 8 aa, Influenza virus
ESECQCID

SEQ ID NO: 278344 - protein, 8 aa, Influenza virus
SECQCIDG

SEQ ID NO: 278345 - protein, 8 aa, Influenza virus
GTCVVAVT

SEQ ID NO: 278346 - protein, 8 aa, Influenza virus
TCVVAVTD

SEQ ID NO: 278347 - protein, 8 aa, Influenza virus
CVVAVTDG

SEQ ID NO: 278348 - protein, 8 aa, Influenza virus
VVAVTDGP

SEQ ID NO: 278349 - protein, 8 aa, Influenza virus
VAVTDGPA

SEQ ID NO: 278350 - protein, 8 aa, Influenza virus
AVTDGPAA

SEQ ID NO: 278351 - protein, 8 aa, Influenza virus
VTDGPAAN

SEQ ID NO: 278352 - protein, 8 aa, Influenza virus
TDGPAANS

SEQ ID NO: 278353 - protein, 8 aa, Influenza virus
DGPAANSA

SEQ ID NO: 278354 - protein, 8 aa, Influenza virus
GPAANSAD

SEQ ID NO: 278355 - protein, 8 aa, Influenza virus
PAANSADH

SEQ ID NO: 278356 - protein, 8 aa, Influenza virus
AANSADHR

SEQ ID NO: 278357 - protein, 8 aa, Influenza virus
ANSADHRV

SEQ ID NO: 278358 - protein, 8 aa, Influenza virus
NSADHRVY

SEQ ID NO: 278359 - protein, 8 aa, Influenza virus
SADHRVYW

SEQ ID NO: 278360 - protein, 8 aa, Influenza virus
ADHRVYWI

SEQ ID NO: 278361 - protein, 8 aa, Influenza virus
DHRVYWIR

SEQ ID NO: 278362 - protein, 8 aa, Influenza virus
HRVYWIRE

SEQ ID NO: 278363 - protein, 8 aa, Influenza virus
RVYWIREG

SEQ ID NO: 278364 - protein, 8 aa, Influenza virus
VYWIREGR

SEQ ID NO: 278365 - protein, 8 aa, Influenza virus
KIQHLEEC

SEQ ID NO: 278366 - protein, 8 aa, Influenza virus
IQHLEECS

SEQ ID NO: 278367 - protein, 8 aa, Influenza virus
QHLEECSC

SEQ ID NO: 278368 - protein, 8 aa, Influenza virus
HLEECSCY

SEQ ID NO: 278369 - protein, 8 aa, Influenza virus
LEECSCYV

SEQ ID NO: 278370 - protein, 8 aa, Influenza virus
EECSCYVD

SEQ ID NO: 278371 - protein, 8 aa, Influenza virus
ECSCYVDI

SEQ ID NO: 278372 - protein, 8 aa, Influenza virus
CSCYVDID

SEQ ID NO: 278373 - protein, 8 aa, Influenza virus
SCYVDIDV

SEQ ID NO: 278374 - protein, 8 aa, Influenza virus
CYVDIDVY

SEQ ID NO: 278375 - protein, 8 aa, Influenza virus
YVDIDVYC

SEQ ID NO: 278376 - protein, 8 aa, Influenza virus
DIDVYCIC

SEQ ID NO: 278377 - protein, 8 aa, Influenza virus
IDVYCICR

SEQ ID NO: 278378 - protein, 8 aa, Influenza virus
DVYCICRD

SEQ ID NO: 278379 - protein, 8 aa, Influenza virus
VYCICRDN

SEQ ID NO: 278380 - protein, 8 aa, Influenza virus
YCICRDNW

SEQ ID NO: 278381 - protein, 8 aa, Influenza virus
CICRDNWK

SEQ ID NO: 278382 - protein, 8 aa, Influenza virus
ICRDNWKG

SEQ ID NO: 278383 - protein, 8 aa, Influenza virus
CRDNWKGS

SEQ ID NO: 278384 - protein, 8 aa, Influenza virus
RDNWKGSN

SEQ ID NO: 278385 - protein, 8 aa, Influenza virus
DNWKGSNR

SEQ ID NO: 278386 - protein, 8 aa, Influenza virus
NWKGSNRP

SEQ ID NO: 278387 - protein, 8 aa, Influenza virus
WKGSNRPW

SEQ ID NO: 278388 - protein, 8 aa, Influenza virus
KGSNRPWM

SEQ ID NO: 278389 - protein, 8 aa, Influenza virus
GSNRPWMR

SEQ ID NO: 278390 - protein, 8 aa, Influenza virus
SNRPWMRI

SEQ ID NO: 278391 - protein, 8 aa, Influenza virus
NRPWMRIN

SEQ ID NO: 278392 - protein, 8 aa, Influenza virus
RPWMRINN

SEQ ID NO: 278393 - protein, 8 aa, Influenza virus
PWMRINNE

SEQ ID NO: 278394 - protein, 8 aa, Influenza virus
WMRINNET

SEQ ID NO: 278395 - protein, 8 aa, Influenza virus
MRINNETI

SEQ ID NO: 278396 - protein, 8 aa, Influenza virus
RINNETIL

SEQ ID NO: 278397 - protein, 8 aa, Influenza virus
INNETILE

SEQ ID NO: 278398 - protein, 8 aa, Influenza virus
NNETILET

SEQ ID NO: 278399 - protein, 8 aa, Influenza virus
NETILETG

SEQ ID NO: 278400 - protein, 8 aa, Influenza virus
ETILETGY

SEQ ID NO: 278401 - protein, 8 aa, Influenza virus
TILETGYV

SEQ ID NO: 278402 - protein, 8 aa, Influenza virus
ILETGYVC

SEQ ID NO: 278403 - protein, 8 aa, Influenza virus
LETGYVCS

SEQ ID NO: 278404 - protein, 8 aa, Influenza virus
ETGYVCSK

SEQ ID NO: 278405 - protein, 8 aa, Influenza virus
TGYVCSKF

SEQ ID NO: 278406 - protein, 8 aa, Influenza virus
GYVCSKFH

SEQ ID NO: 278407 - protein, 8 aa, Influenza virus
YVCSKFHS

SEQ ID NO: 278408 - protein, 8 aa, Influenza virus
VCSKFHSD

SEQ ID NO: 278409 - protein, 8 aa, Influenza virus
CSKFHSDT

SEQ ID NO: 278410 - protein, 8 aa, Influenza virus
SKFHSDTP

SEQ ID NO: 278411 - protein, 8 aa, Influenza virus
KFHSDTPR

SEQ ID NO: 278412 - protein, 8 aa, Influenza virus
FHSDTPRP

SEQ ID NO: 278413 - protein, 8 aa, Influenza virus
HSDTPRPA

SEQ ID NO: 278414 - protein, 8 aa, Influenza virus
SDTPRPAD

SEQ ID NO: 278415 - protein, 8 aa, Influenza virus
DTPRPADP

SEQ ID NO: 278416 - protein, 8 aa, Influenza virus
TPRPADPS

SEQ ID NO: 278417 - protein, 8 aa, Influenza virus
DPSTVSCD

SEQ ID NO: 278418 - protein, 8 aa, Influenza virus
PSTVSCDS

SEQ ID NO: 278419 - protein, 8 aa, Influenza virus
STVSCDSP

SEQ ID NO: 278420 - protein, 8 aa, Influenza virus
TVSCDSPS

SEQ ID NO: 278421 - protein, 8 aa, Influenza virus
VSCDSPSN

SEQ ID NO: 278422 - protein, 8 aa, Influenza virus
SCDSPSNV

SEQ ID NO: 278423 - protein, 8 aa, Influenza virus
CDSPSNVN

SEQ ID NO: 278424 - protein, 8 aa, Influenza virus
DSPSNVNG

SEQ ID NO: 278425 - protein, 8 aa, Influenza virus
SPSNVNGG

SEQ ID NO: 278426 - protein, 8 aa, Influenza virus
NGGPGVKG

SEQ ID NO: 278427 - protein, 8 aa, Influenza virus
GGPGVKGF

SEQ ID NO: 278428 - protein, 8 aa, Influenza virus
GPGVKGFG

SEQ ID NO: 278429 - protein, 8 aa, Influenza virus
PGVKGFGF

SEQ ID NO: 278430 - protein, 8 aa, Influenza virus
GVKGFGFK

SEQ ID NO: 278431 - protein, 8 aa, Influenza virus
VKGFGFKA

SEQ ID NO: 278432 - protein, 8 aa, Influenza virus
KGFGFKAG

SEQ ID NO: 278433 - protein, 8 aa, Influenza virus
GNDVWLGR

SEQ ID NO: 278434 - protein, 8 aa, Influenza virus
NDVWLGRT

SEQ ID NO: 278435 - protein, 8 aa, Influenza virus
DVWLGRTV

SEQ ID NO: 278436 - protein, 8 aa, Influenza virus
VWLGRTVS

SEQ ID NO: 278437 - protein, 8 aa, Influenza virus
WLGRTVST

SEQ ID NO: 278438 - protein, 8 aa, Influenza virus
LGRTVSTS

SEQ ID NO: 278439 - protein, 8 aa, Influenza virus
GRTVSTSG

SEQ ID NO: 278440 - protein, 8 aa, Influenza virus
RTVSTSGR

SEQ ID NO: 278441 - protein, 8 aa, Influenza virus
TVSTSGRS

SEQ ID NO: 278442 - protein, 8 aa, Influenza virus
SGRSGFEI

SEQ ID NO: 278443 - protein, 8 aa, Influenza virus
GRSGFEII

SEQ ID NO: 278444 - protein, 8 aa, Influenza virus
RSGFEIIK

SEQ ID NO: 278445 - protein, 8 aa, Influenza virus
SGFEIIKV

SEQ ID NO: 278446 - protein, 8 aa, Influenza virus
IKVTEGWI

SEQ ID NO: 278447 - protein, 8 aa, Influenza virus
VTEGWINS

SEQ ID NO: 278448 - protein, 8 aa, Influenza virus
TEGWINSP

SEQ ID NO: 278449 - protein, 8 aa, Influenza virus
EGWINSPN

SEQ ID NO: 278450 - protein, 8 aa, Influenza virus
GWINSPNH

SEQ ID NO: 278451 - protein, 8 aa, Influenza virus
WINSPNHA

SEQ ID NO: 278452 - protein, 8 aa, Influenza virus
INSPNHAK

SEQ ID NO: 278453 - protein, 8 aa, Influenza virus
NSPNHAKS

SEQ ID NO: 278454 - protein, 8 aa, Influenza virus
AKSVTQTL

SEQ ID NO: 278455 - protein, 8 aa, Influenza virus
KSITQTLV

SEQ ID NO: 278456 - protein, 8 aa, Influenza virus
SITQTLVS

SEQ ID NO: 278457 - protein, 8 aa, Influenza virus
ITQTLVSN

SEQ ID NO: 278458 - protein, 8 aa, Influenza virus
TQTLVSNN

SEQ ID NO: 278459 - protein, 8 aa, Influenza virus
QTLVSNND

SEQ ID NO: 278460 - protein, 8 aa, Influenza virus
TLVSNNDW

SEQ ID NO: 278461 - protein, 8 aa, Influenza virus
LVSNNDWS

SEQ ID NO: 278462 - protein, 8 aa, Influenza virus
VSNNDWSG

SEQ ID NO: 278463 - protein, 8 aa, Influenza virus
SNNDWSGY

SEQ ID NO: 278464 - protein, 8 aa, Influenza virus
NNDWSGYS

SEQ ID NO: 278465 - protein, 8 aa, Influenza virus
NDWSGYSG

SEQ ID NO: 278466 - protein, 8 aa, Influenza virus
DWSGYSGS

SEQ ID NO: 278467 - protein, 8 aa, Influenza virus
WSGYSGSF

SEQ ID NO: 278468 - protein, 8 aa, Influenza virus
SGYSGSFI

SEQ ID NO: 278469 - protein, 8 aa, Influenza virus
GYSGSFIV

SEQ ID NO: 278470 - protein, 8 aa, Influenza virus
KDCFQPCF

SEQ ID NO: 278471 - protein, 8 aa, Influenza virus
DCFQPCFY

SEQ ID NO: 278472 - protein, 8 aa, Influenza virus
CFQPCFYV

SEQ ID NO: 278473 - protein, 8 aa, Influenza virus
FQPCFYVE

SEQ ID NO: 278474 - protein, 8 aa, Influenza virus
QPCFYVEL

SEQ ID NO: 278475 - protein, 8 aa, Influenza virus
PCFYVELI

SEQ ID NO: 278476 - protein, 8 aa, Influenza virus
CFYVELIR

SEQ ID NO: 278477 - protein, 8 aa, Influenza virus
FYVELIRG

SEQ ID NO: 278478 - protein, 8 aa, Influenza virus
YVELIRGR

SEQ ID NO: 278479 - protein, 8 aa, Influenza virus
VELIRGRP

SEQ ID NO: 278480 - protein, 8 aa, Influenza virus
ELIRGRPN

SEQ ID NO: 278481 - protein, 8 aa, Influenza virus
NDDVSWTS

SEQ ID NO: 278482 - protein, 8 aa, Influenza virus
DDVSWTSN

SEQ ID NO: 278483 - protein, 8 aa, Influenza virus
DVSWTSNS

SEQ ID NO: 278484 - protein, 8 aa, Influenza virus
VSWTSNSI

SEQ ID NO: 278485 - protein, 8 aa, Influenza virus
SWTSNSIV

SEQ ID NO: 278486 - protein, 8 aa, Influenza virus
WTSNSIVT

SEQ ID NO: 278487 - protein, 8 aa, Influenza virus
TSNSIVTF

SEQ ID NO: 278488 - protein, 8 aa, Influenza virus
SNSIVTFC

SEQ ID NO: 278489 - protein, 8 aa, Influenza virus
NSIVTFCG

SEQ ID NO: 278490 - protein, 8 aa, Influenza virus
SIVTFCGL

SEQ ID NO: 278491 - protein, 8 aa, Influenza virus
IVTFCGLD

SEQ ID NO: 278492 - protein, 8 aa, Influenza virus
VTFCGLDN

SEQ ID NO: 278493 - protein, 8 aa, Influenza virus
TFCGLDNE

SEQ ID NO: 278494 - protein, 8 aa, Influenza virus
FCGLDNEP

SEQ ID NO: 278495 - protein, 8 aa, Influenza virus
CGLDNEPG

SEQ ID NO: 278496 - protein, 8 aa, Influenza virus
GLDNEPGS

SEQ ID NO: 278497 - protein, 8 aa, Influenza virus
LDNEPGSG

SEQ ID NO: 278498 - protein, 8 aa, Influenza virus
DNEPGSGN

SEQ ID NO: 278499 - protein, 8 aa, Influenza virus
NEPGSGNW

SEQ ID NO: 278500 - protein, 8 aa, Influenza virus
EPGSGNWP

SEQ ID NO: 278501 - protein, 8 aa, Influenza virus
PGSGNWPD

SEQ ID NO: 278502 - protein, 8 aa, Influenza virus
GSGNWPDG

SEQ ID NO: 278503 - protein, 8 aa, Influenza virus
SGNWPDGS

SEQ ID NO: 278504 - protein, 8 aa, Influenza virus
GNWPDGSN

SEQ ID NO: 278505 - protein, 8 aa, Influenza virus
NWPDGSNI

SEQ ID NO: 278506 - protein, 8 aa, Influenza virus
WPDGSNIG

SEQ ID NO: 278507 - protein, 8 aa, Influenza virus
PDGSNIGF

SEQ ID NO: 278508 - protein, 8 aa, Influenza virus
DGSNIGFM

SEQ ID NO: 278509 - protein, 8 aa, Influenza virus
GSNIGFMP

SEQ ID NO: 278510 - protein, 8 aa, Influenza virus
SNIGFMPK

SEQ ID NO: 278511 - protein, 8 aa, Influenza virus
SKSRGYKM

SEQ ID NO: 278512 - protein, 8 aa, Influenza virus
KSRGYKMN

SEQ ID NO: 278513 - protein, 8 aa, Influenza virus
SRGYKMNT

SEQ ID NO: 278514 - protein, 8 aa, Influenza virus
RGYKMNTQ

SEQ ID NO: 278515 - protein, 8 aa, Influenza virus
GYKMNTQI

SEQ ID NO: 278516 - protein, 8 aa, Influenza virus
YKMNTQIL

SEQ ID NO: 278517 - protein, 8 aa, Influenza virus
KMNTQILV

SEQ ID NO: 278518 - protein, 8 aa, Influenza virus
GCDHSDNA

SEQ ID NO: 278519 - protein, 8 aa, Influenza virus
CDHSDNAD

SEQ ID NO: 278520 - protein, 8 aa, Influenza virus
DHSDNADK

SEQ ID NO: 278521 - protein, 8 aa, Influenza virus
HSDNADKI

SEQ ID NO: 278522 - protein, 8 aa, Influenza virus
SDNADKIC

SEQ ID NO: 278523 - protein, 8 aa, Influenza virus
DNADKICL

SEQ ID NO: 278524 - protein, 8 aa, Influenza virus
NADKICLG

SEQ ID NO: 278525 - protein, 8 aa, Influenza virus
ADKICLGH

SEQ ID NO: 278526 - protein, 8 aa, Influenza virus
DKICLGHH

SEQ ID NO: 278527 - protein, 8 aa, Influenza virus
KICLGHHA

SEQ ID NO: 278528 - protein, 8 aa, Influenza virus
ICLGHHAV

SEQ ID NO: 278529 - protein, 8 aa, Influenza virus
NGTKVNTL

SEQ ID NO: 278530 - protein, 8 aa, Influenza virus
GTKVNTLT

SEQ ID NO: 278531 - protein, 8 aa, Influenza virus
TKVNTLTE

SEQ ID NO: 278532 - protein, 8 aa, Influenza virus
KVNTLTER

SEQ ID NO: 278533 - protein, 8 aa, Influenza virus
VNTLTERG

SEQ ID NO: 278534 - protein, 8 aa, Influenza virus
NTLTERGV

SEQ ID NO: 278535 - protein, 8 aa, Influenza virus
TLTERGVE

SEQ ID NO: 278536 - protein, 8 aa, Influenza virus
LTERGVEV

SEQ ID NO: 278537 - protein, 8 aa, Influenza virus
TERGVEVV

SEQ ID NO: 278538 - protein, 8 aa, Influenza virus
ERGVEVVN

SEQ ID NO: 278539 - protein, 8 aa, Influenza virus
RGVEVVNA

SEQ ID NO: 278540 - protein, 8 aa, Influenza virus
GVEVVNAT

SEQ ID NO: 278541 - protein, 8 aa, Influenza virus
VEVVNATE

SEQ ID NO: 278542 - protein, 8 aa, Influenza virus
EVVNATET

SEQ ID NO: 278543 - protein, 8 aa, Influenza virus
VVNATETV

SEQ ID NO: 278544 - protein, 8 aa, Influenza virus
VNATETVE

SEQ ID NO: 278545 - protein, 8 aa, Influenza virus
NATETVER

SEQ ID NO: 278546 - protein, 8 aa, Influenza virus
DLGQCGLL

SEQ ID NO: 278547 - protein, 8 aa, Influenza virus
LGQCGLLG

SEQ ID NO: 278548 - protein, 8 aa, Influenza virus
GQCGLLGT

SEQ ID NO: 278549 - protein, 8 aa, Influenza virus
ITGPPQCD

SEQ ID NO: 278550 - protein, 8 aa, Influenza virus
TGPPQCDQ

SEQ ID NO: 278551 - protein, 8 aa, Influenza virus
GPPQCDQF

SEQ ID NO: 278552 - protein, 8 aa, Influenza virus
PPQCDQFL

SEQ ID NO: 278553 - protein, 8 aa, Influenza virus
PQCDQFLE

SEQ ID NO: 278554 - protein, 8 aa, Influenza virus
QCDQFLEF

SEQ ID NO: 278555 - protein, 8 aa, Influenza virus
DLIIERRE

SEQ ID NO: 278556 - protein, 8 aa, Influenza virus
LIIERREG

SEQ ID NO: 278557 - protein, 8 aa, Influenza virus
DVCYPGKF

SEQ ID NO: 278558 - protein, 8 aa, Influenza virus
EEALRQIL

SEQ ID NO: 278559 - protein, 8 aa, Influenza virus
EALRQILR

SEQ ID NO: 278560 - protein, 8 aa, Influenza virus
LRQILRES

SEQ ID NO: 278561 - protein, 8 aa, Influenza virus
RQILRESG

SEQ ID NO: 278562 - protein, 8 aa, Influenza virus
QILRESGG

SEQ ID NO: 278563 - protein, 8 aa, Influenza virus
ILRESGGI

SEQ ID NO: 278564 - protein, 8 aa, Influenza virus
MGFTYSGI

SEQ ID NO: 278565 - protein, 8 aa, Influenza virus
GFTYSGIR

SEQ ID NO: 278566 - protein, 8 aa, Influenza virus
FTYSGIRT

SEQ ID NO: 278567 - protein, 8 aa, Influenza virus
TYSGIRTN

SEQ ID NO: 278568 - protein, 8 aa, Influenza virus
YSGIRTNG

SEQ ID NO: 278569 - protein, 8 aa, Influenza virus
RSGSSFYA

SEQ ID NO: 278570 - protein, 8 aa, Influenza virus
SGSSFYAE

SEQ ID NO: 278571 - protein, 8 aa, Influenza virus
GSSFYAEM

SEQ ID NO: 278572 - protein, 8 aa, Influenza virus
SSFYAEMK

SEQ ID NO: 278573 - protein, 8 aa, Influenza virus
SFYAEMKW

SEQ ID NO: 278574 - protein, 8 aa, Influenza virus
FYAEMKWL

SEQ ID NO: 278575 - protein, 8 aa, Influenza virus
YAEMKWLL

SEQ ID NO: 278576 - protein, 8 aa, Influenza virus
AEMKWLLS

SEQ ID NO: 278577 - protein, 8 aa, Influenza virus
EMKWLLSN

SEQ ID NO: 278578 - protein, 8 aa, Influenza virus
FPQMTKSY

SEQ ID NO: 278579 - protein, 8 aa, Influenza virus
PQMTKSYK

SEQ ID NO: 278580 - protein, 8 aa, Influenza virus
QMTKSYKN

SEQ ID NO: 278581 - protein, 8 aa, Influenza virus
TKSYKNTR

SEQ ID NO: 278582 - protein, 8 aa, Influenza virus
PALIIWGI

SEQ ID NO: 278583 - protein, 8 aa, Influenza virus
ALIIWGIH

SEQ ID NO: 278584 - protein, 8 aa, Influenza virus
LIIWGIHH

SEQ ID NO: 278585 - protein, 8 aa, Influenza virus
WGIHHSGS

SEQ ID NO: 278586 - protein, 8 aa, Influenza virus
EQTKLYGS

SEQ ID NO: 278587 - protein, 8 aa, Influenza virus
QTKLYGSG

SEQ ID NO: 278588 - protein, 8 aa, Influenza virus
LYGSGNKL

SEQ ID NO: 278589 - protein, 8 aa, Influenza virus
ITVGSSNY

SEQ ID NO: 278590 - protein, 8 aa, Influenza virus
TVGSSNYQ

SEQ ID NO: 278591 - protein, 8 aa, Influenza virus
VGSSNYQQ

SEQ ID NO: 278592 - protein, 8 aa, Influenza virus
GSSNYQQS

SEQ ID NO: 278593 - protein, 8 aa, Influenza virus
SSNYQQSF

SEQ ID NO: 278594 - protein, 8 aa, Influenza virus
RPQVNGQS

SEQ ID NO: 278595 - protein, 8 aa, Influenza virus
PQVNGQSG

SEQ ID NO: 278596 - protein, 8 aa, Influenza virus
QVNGQSGR

SEQ ID NO: 278597 - protein, 8 aa, Influenza virus
VNGQSGRI

SEQ ID NO: 278598 - protein, 8 aa, Influenza virus
NGQSGRID

SEQ ID NO: 278599 - protein, 8 aa, Influenza virus
GQSGRIDF

SEQ ID NO: 278600 - protein, 8 aa, Influenza virus
QSGRIDFH

SEQ ID NO: 278601 - protein, 8 aa, Influenza virus
SGRIDFHW

SEQ ID NO: 278602 - protein, 8 aa, Influenza virus
GRIDFHWL

SEQ ID NO: 278603 - protein, 8 aa, Influenza virus
NDTVTFSF

SEQ ID NO: 278604 - protein, 8 aa, Influenza virus
DTVTFSFN

SEQ ID NO: 278605 - protein, 8 aa, Influenza virus
TVTFSFNG

SEQ ID NO: 278606 - protein, 8 aa, Influenza virus
VTFSFNGA

SEQ ID NO: 278607 - protein, 8 aa, Influenza virus
TFSFNGAF

SEQ ID NO: 278608 - protein, 8 aa, Influenza virus
FSFNGAFI

SEQ ID NO: 278609 - protein, 8 aa, Influenza virus
SFNGAFIA

SEQ ID NO: 278610 - protein, 8 aa, Influenza virus
FNGAFIAP

SEQ ID NO: 278611 - protein, 8 aa, Influenza virus
NGAFIAPD

SEQ ID NO: 278612 - protein, 8 aa, Influenza virus
GAFIAPDR

SEQ ID NO: 278613 - protein, 8 aa, Influenza virus
AFIAPDRA

SEQ ID NO: 278614 - protein, 8 aa, Influenza virus
FIAPDRAS

SEQ ID NO: 278615 - protein, 8 aa, Influenza virus
IAPDRASF

SEQ ID NO: 278616 - protein, 8 aa, Influenza virus
CYHSGGTI

SEQ ID NO: 278617 - protein, 8 aa, Influenza virus
SNLPFQNI

SEQ ID NO: 278618 - protein, 8 aa, Influenza virus
NLPFQNIN

SEQ ID NO: 278619 - protein, 8 aa, Influenza virus
LPFQNINS

SEQ ID NO: 278620 - protein, 8 aa, Influenza virus
PFQNINSR

SEQ ID NO: 278621 - protein, 8 aa, Influenza virus
FQNINSRA

SEQ ID NO: 278622 - protein, 8 aa, Influenza virus
VGKCPRYV

SEQ ID NO: 278623 - protein, 8 aa, Influenza virus
GKCPRYVK

SEQ ID NO: 278624 - protein, 8 aa, Influenza virus
KCPRYVKQ

SEQ ID NO: 278625 - protein, 8 aa, Influenza virus
SLLLATGM

SEQ ID NO: 278626 - protein, 8 aa, Influenza virus
LLLATGMK

SEQ ID NO: 278627 - protein, 8 aa, Influenza virus
LLATGMKN

SEQ ID NO: 278628 - protein, 8 aa, Influenza virus
LATGMKNV

SEQ ID NO: 278629 - protein, 8 aa, Influenza virus
ATGMKNVP

SEQ ID NO: 278630 - protein, 8 aa, Influenza virus
TGMKNVPE

SEQ ID NO: 278631 - protein, 8 aa, Influenza virus
THKQLTHH

SEQ ID NO: 278632 - protein, 8 aa, Influenza virus
HKQLTHHM

SEQ ID NO: 278633 - protein, 8 aa, Influenza virus
KQLTHHMR

SEQ ID NO: 278634 - protein, 8 aa, Influenza virus
QLTHHMRK

SEQ ID NO: 278635 - protein, 8 aa, Influenza virus
LTHHMRKK

SEQ ID NO: 278636 - protein, 8 aa, Influenza virus
THHMRKKR

SEQ ID NO: 278637 - protein, 8 aa, Influenza virus
HHMRKKRG

SEQ ID NO: 278638 - protein, 8 aa, Influenza virus
HMRKKRGL

SEQ ID NO: 278639 - protein, 8 aa, Influenza virus
MRKKRGLF

SEQ ID NO: 278640 - protein, 8 aa, Influenza virus
RKKRGLFG

SEQ ID NO: 278641 - protein, 8 aa, Influenza virus
EKRGLFGA

SEQ ID NO: 278642 - protein, 8 aa, Influenza virus
RGLFGAIA

SEQ ID NO: 278643 - protein, 8 aa, Influenza virus
GLFGAIAG

SEQ ID NO: 278644 - protein, 8 aa, Influenza virus
LFGAIAGF

SEQ ID NO: 278645 - protein, 8 aa, Influenza virus
FGAIAGFI

SEQ ID NO: 278646 - protein, 8 aa, Influenza virus
GAIAGFIE

SEQ ID NO: 278647 - protein, 8 aa, Influenza virus
AIAGFIEN

SEQ ID NO: 278648 - protein, 8 aa, Influenza virus
IAGFIENG

SEQ ID NO: 278649 - protein, 8 aa, Influenza virus
AGFIENGW

SEQ ID NO: 278650 - protein, 8 aa, Influenza virus
GFIENGWE

SEQ ID NO: 278651 - protein, 8 aa, Influenza virus
FIENGWEG

SEQ ID NO: 278652 - protein, 8 aa, Influenza virus
IENGWEGL

SEQ ID NO: 278653 - protein, 8 aa, Influenza virus
ENGWEGLI

SEQ ID NO: 278654 - protein, 8 aa, Influenza virus
NGWEGLID

SEQ ID NO: 278655 - protein, 8 aa, Influenza virus
GWEGLIDG

SEQ ID NO: 278656 - protein, 8 aa, Influenza virus
WEGLIDGW

SEQ ID NO: 278657 - protein, 8 aa, Influenza virus
EGLIDGWY

SEQ ID NO: 278658 - protein, 8 aa, Influenza virus
GLIDGWYG

SEQ ID NO: 278659 - protein, 8 aa, Influenza virus
LIDGWYGF

SEQ ID NO: 278660 - protein, 8 aa, Influenza virus
IDGWYGFR

SEQ ID NO: 278661 - protein, 8 aa, Influenza virus
DGWYGFRH

SEQ ID NO: 278662 - protein, 8 aa, Influenza virus
GWYGFRHQ

SEQ ID NO: 278663 - protein, 8 aa, Influenza virus
WYGFRHQN

SEQ ID NO: 278664 - protein, 8 aa, Influenza virus
YGFRHQNA

SEQ ID NO: 278665 - protein, 8 aa, Influenza virus
GFRHQNAQ

SEQ ID NO: 278666 - protein, 8 aa, Influenza virus
FRHQNAQG

SEQ ID NO: 278667 - protein, 8 aa, Influenza virus
RHQNAQGE

SEQ ID NO: 278668 - protein, 8 aa, Influenza virus
HQNAQGEG

SEQ ID NO: 278669 - protein, 8 aa, Influenza virus
QNAQGEGT

SEQ ID NO: 278670 - protein, 8 aa, Influenza virus
NAQGEGTA

SEQ ID NO: 278671 - protein, 8 aa, Influenza virus
AQGEGTAA

SEQ ID NO: 278672 - protein, 8 aa, Influenza virus
QGEGTAAD

SEQ ID NO: 278673 - protein, 8 aa, Influenza virus
GEGTAADY

SEQ ID NO: 278674 - protein, 8 aa, Influenza virus
EGTAADYK

SEQ ID NO: 278675 - protein, 8 aa, Influenza virus
GTAADYKS

SEQ ID NO: 278676 - protein, 8 aa, Influenza virus
TAADYKST

SEQ ID NO: 278677 - protein, 8 aa, Influenza virus
AADYKSTQ

SEQ ID NO: 278678 - protein, 8 aa, Influenza virus
ADYKSTQS

SEQ ID NO: 278679 - protein, 8 aa, Influenza virus
DYKSTQSA

SEQ ID NO: 278680 - protein, 8 aa, Influenza virus
YKSTQSAI

SEQ ID NO: 278681 - protein, 8 aa, Influenza virus
KSTQSAID

SEQ ID NO: 278682 - protein, 8 aa, Influenza virus
STQSAIDQ

SEQ ID NO: 278683 - protein, 8 aa, Influenza virus
TQSAIDQI

SEQ ID NO: 278684 - protein, 8 aa, Influenza virus
QSAIDQIT

SEQ ID NO: 278685 - protein, 8 aa, Influenza virus
SAIDQITG

SEQ ID NO: 278686 - protein, 8 aa, Influenza virus
AIDQITGK

SEQ ID NO: 278687 - protein, 8 aa, Influenza virus
IDQITGKL

SEQ ID NO: 278688 - protein, 8 aa, Influenza virus
DQITGKLN

SEQ ID NO: 278689 - protein, 8 aa, Influenza virus
QITGKLNR

SEQ ID NO: 278690 - protein, 8 aa, Influenza virus
ITGKLNRL

SEQ ID NO: 278691 - protein, 8 aa, Influenza virus
TGKLNRLI

SEQ ID NO: 278692 - protein, 8 aa, Influenza virus
GKLNRLIE

SEQ ID NO: 278693 - protein, 8 aa, Influenza virus
KLNRLIEK

SEQ ID NO: 278694 - protein, 8 aa, Influenza virus
LNRLIEKT

SEQ ID NO: 278695 - protein, 8 aa, Influenza virus
NRLIEKTN

SEQ ID NO: 278696 - protein, 8 aa, Influenza virus
RLIEKTNQ

SEQ ID NO: 278697 - protein, 8 aa, Influenza virus
LIEKTNQQ

SEQ ID NO: 278698 - protein, 8 aa, Influenza virus
IEKTNQQF

SEQ ID NO: 278699 - protein, 8 aa, Influenza virus
EKTNQQFE

SEQ ID NO: 278700 - protein, 8 aa, Influenza virus
KTNQQFEL

SEQ ID NO: 278701 - protein, 8 aa, Influenza virus
TNQQFELI

SEQ ID NO: 278702 - protein, 8 aa, Influenza virus
NQQFELID

SEQ ID NO: 278703 - protein, 8 aa, Influenza virus
QQFELIDN

SEQ ID NO: 278704 - protein, 8 aa, Influenza virus
QFELIDNE

SEQ ID NO: 278705 - protein, 8 aa, Influenza virus
FELIDNEF

SEQ ID NO: 278706 - protein, 8 aa, Influenza virus
ELIDNEFT

SEQ ID NO: 278707 - protein, 8 aa, Influenza virus
LIDNEFTE

SEQ ID NO: 278708 - protein, 8 aa, Influenza virus
IDNEFTEV

SEQ ID NO: 278709 - protein, 8 aa, Influenza virus
DNEFTEVE

SEQ ID NO: 278710 - protein, 8 aa, Influenza virus
EVEKQIGN

SEQ ID NO: 278711 - protein, 8 aa, Influenza virus
VEKQIGNV

SEQ ID NO: 278712 - protein, 8 aa, Influenza virus
EKQIGNVI

SEQ ID NO: 278713 - protein, 8 aa, Influenza virus
KQIGNVIN

SEQ ID NO: 278714 - protein, 8 aa, Influenza virus
QIGNVINW

SEQ ID NO: 278715 - protein, 8 aa, Influenza virus
IGNVINWT

SEQ ID NO: 278716 - protein, 8 aa, Influenza virus
GNVINWTR

SEQ ID NO: 278717 - protein, 8 aa, Influenza virus
NVINWTRD

SEQ ID NO: 278718 - protein, 8 aa, Influenza virus
VINWTRDS

SEQ ID NO: 278719 - protein, 8 aa, Influenza virus
INWTRDSM

SEQ ID NO: 278720 - protein, 8 aa, Influenza virus
NWTRDSMT

SEQ ID NO: 278721 - protein, 8 aa, Influenza virus
WTRDSMTE

SEQ ID NO: 278722 - protein, 8 aa, Influenza virus
TEVWSYNA

SEQ ID NO: 278723 - protein, 8 aa, Influenza virus
EVWSYNAE

SEQ ID NO: 278724 - protein, 8 aa, Influenza virus
VWSYNAEL

SEQ ID NO: 278725 - protein, 8 aa, Influenza virus
WSYNAELL

SEQ ID NO: 278726 - protein, 8 aa, Influenza virus
SYNAELLV

SEQ ID NO: 278727 - protein, 8 aa, Influenza virus
YNAELLVA

SEQ ID NO: 278728 - protein, 8 aa, Influenza virus
NAELLVAM

SEQ ID NO: 278729 - protein, 8 aa, Influenza virus
AELLVAME

SEQ ID NO: 278730 - protein, 8 aa, Influenza virus
ELLVAMEN

SEQ ID NO: 278731 - protein, 8 aa, Influenza virus
LLVAMENQ

SEQ ID NO: 278732 - protein, 8 aa, Influenza virus
LVAMENQH

SEQ ID NO: 278733 - protein, 8 aa, Influenza virus
VAMENQHT

SEQ ID NO: 278734 - protein, 8 aa, Influenza virus
AMENQHTI

SEQ ID NO: 278735 - protein, 8 aa, Influenza virus
MENQHTID

SEQ ID NO: 278736 - protein, 8 aa, Influenza virus
ENQHTIDL

SEQ ID NO: 278737 - protein, 8 aa, Influenza virus
NQHTIDLA

SEQ ID NO: 278738 - protein, 8 aa, Influenza virus
QHTIDLAD

SEQ ID NO: 278739 - protein, 8 aa, Influenza virus
HTIDLADS

SEQ ID NO: 278740 - protein, 8 aa, Influenza virus
TIDLADSE

SEQ ID NO: 278741 - protein, 8 aa, Influenza virus
IDLADSEM

SEQ ID NO: 278742 - protein, 8 aa, Influenza virus
DLADSEMN

SEQ ID NO: 278743 - protein, 8 aa, Influenza virus
LADSEMNK

SEQ ID NO: 278744 - protein, 8 aa, Influenza virus
ADSEMNKL

SEQ ID NO: 278745 - protein, 8 aa, Influenza virus
DSEMNKLY

SEQ ID NO: 278746 - protein, 8 aa, Influenza virus
SEMNKLYE

SEQ ID NO: 278747 - protein, 8 aa, Influenza virus
EMNKLYER

SEQ ID NO: 278748 - protein, 8 aa, Influenza virus
MNKLYERV

SEQ ID NO: 278749 - protein, 8 aa, Influenza virus
NKLYERVR

SEQ ID NO: 278750 - protein, 8 aa, Influenza virus
KLYERVKR

SEQ ID NO: 278751 - protein, 8 aa, Influenza virus
LYERVKRQ

SEQ ID NO: 278752 - protein, 8 aa, Influenza virus
YERVKRQL

SEQ ID NO: 278753 - protein, 8 aa, Influenza virus
ERVKRQLR

SEQ ID NO: 278754 - protein, 8 aa, Influenza virus
RVKRQLRE

SEQ ID NO: 278755 - protein, 8 aa, Influenza virus
VRRQLREN

SEQ ID NO: 278756 - protein, 8 aa, Influenza virus
RRQLRENA

SEQ ID NO: 278757 - protein, 8 aa, Influenza virus
RQLRENAE

SEQ ID NO: 278758 - protein, 8 aa, Influenza virus
QLRENAEE

SEQ ID NO: 278759 - protein, 8 aa, Influenza virus
LRENAEED

SEQ ID NO: 278760 - protein, 8 aa, Influenza virus
RENAEEDG

SEQ ID NO: 278761 - protein, 8 aa, Influenza virus
ENAEEDGT

SEQ ID NO: 278762 - protein, 8 aa, Influenza virus
NAEEDGTG

SEQ ID NO: 278763 - protein, 8 aa, Influenza virus
AEEDGTGC

SEQ ID NO: 278764 - protein, 8 aa, Influenza virus
EEDGTGCF

SEQ ID NO: 278765 - protein, 8 aa, Influenza virus
EDGTGCFE

SEQ ID NO: 278766 - protein, 8 aa, Influenza virus
DGTGCFEI

SEQ ID NO: 278767 - protein, 8 aa, Influenza virus
GTGCFEIF

SEQ ID NO: 278768 - protein, 8 aa, Influenza virus
TGCFEIFH

SEQ ID NO: 278769 - protein, 8 aa, Influenza virus
GCFEIFHK

SEQ ID NO: 278770 - protein, 8 aa, Influenza virus
CFEIFHKC

SEQ ID NO: 278771 - protein, 8 aa, Influenza virus
FEIFHKCD

SEQ ID NO: 278772 - protein, 8 aa, Influenza virus
EIFHKCDD

SEQ ID NO: 278773 - protein, 8 aa, Influenza virus
IFHKCDDD

SEQ ID NO: 278774 - protein, 8 aa, Influenza virus
FHKCDDDC

SEQ ID NO: 278775 - protein, 8 aa, Influenza virus
HKCDDDCM

SEQ ID NO: 278776 - protein, 8 aa, Influenza virus
CMASIRNN

SEQ ID NO: 278777 - protein, 8 aa, Influenza virus
MASIRNNT

SEQ ID NO: 278778 - protein, 8 aa, Influenza virus
ASIRNNTY

SEQ ID NO: 278779 - protein, 8 aa, Influenza virus
SIRNNTYD

SEQ ID NO: 278780 - protein, 8 aa, Influenza virus
IRNNTYDH

SEQ ID NO: 278781 - protein, 8 aa, Influenza virus
RNNTYDHS

SEQ ID NO: 278782 - protein, 8 aa, Influenza virus
NNTYDHSK

SEQ ID NO: 278783 - protein, 8 aa, Influenza virus
NTYDHSKY

SEQ ID NO: 278784 - protein, 8 aa, Influenza virus
TYDHSKYR

SEQ ID NO: 278785 - protein, 8 aa, Influenza virus
AMQNRIQI

SEQ ID NO: 278786 - protein, 8 aa, Influenza virus
QNRIQIDP

SEQ ID NO: 278787 - protein, 8 aa, Influenza virus
NRIQIDPV

SEQ ID NO: 278788 - protein, 8 aa, Influenza virus
IQIDPVKL

SEQ ID NO: 278789 - protein, 8 aa, Influenza virus
QIDPVKLS

SEQ ID NO: 278790 - protein, 8 aa, Influenza virus
IDPVKLSS

SEQ ID NO: 278791 - protein, 8 aa, Influenza virus
DPVKLSSG

SEQ ID NO: 278792 - protein, 8 aa, Influenza virus
PVKLSSGY

SEQ ID NO: 278793 - protein, 8 aa, Influenza virus
VKLSSGYK

SEQ ID NO: 278794 - protein, 8 aa, Influenza virus
KLSSGYKD

SEQ ID NO: 278795 - protein, 8 aa, Influenza virus
LSSGYKDV

SEQ ID NO: 278796 - protein, 8 aa, Influenza virus
SSGYKDVI

SEQ ID NO: 278797 - protein, 8 aa, Influenza virus
SGYKDVIL

SEQ ID NO: 278798 - protein, 8 aa, Influenza virus
GYKDVILW

SEQ ID NO: 278799 - protein, 8 aa, Influenza virus
YKDVILWF

SEQ ID NO: 278800 - protein, 8 aa, Influenza virus
KDVILWFS

SEQ ID NO: 278801 - protein, 8 aa, Influenza virus
DVILWFSF

SEQ ID NO: 278802 - protein, 8 aa, Influenza virus
VILWFSFG

SEQ ID NO: 278803 - protein, 8 aa, Influenza virus
ILWFSFGA

SEQ ID NO: 278804 - protein, 8 aa, Influenza virus
LWFSFGAS

SEQ ID NO: 278805 - protein, 8 aa, Influenza virus
WFSFGASC

SEQ ID NO: 278806 - protein, 8 aa, Influenza virus
FSFGASCF

SEQ ID NO: 278807 - protein, 8 aa, Influenza virus
SFGASCFI

SEQ ID NO: 278808 - protein, 8 aa, Influenza virus
FGASCFIL

SEQ ID NO: 278809 - protein, 8 aa, Influenza virus
GASCFILL

SEQ ID NO: 278810 - protein, 8 aa, Influenza virus
ASCFILLA

SEQ ID NO: 278811 - protein, 8 aa, Influenza virus
SCFILLAI

SEQ ID NO: 278812 - protein, 8 aa, Influenza virus
LVFICVKN

SEQ ID NO: 278813 - protein, 8 aa, Influenza virus
VFICVKNG

SEQ ID NO: 278814 - protein, 8 aa, Influenza virus
FICVKNGN

SEQ ID NO: 278815 - protein, 8 aa, Influenza virus
ICVKNGNM

SEQ ID NO: 278816 - protein, 8 aa, Influenza virus
CVKNGNMR

SEQ ID NO: 278817 - protein, 8 aa, Influenza virus
VKNGNMRC

SEQ ID NO: 278818 - protein, 8 aa, Influenza virus
KNGNMRCT

SEQ ID NO: 278819 - protein, 8 aa, Influenza virus
NGNMRCTI

SEQ ID NO: 278820 - protein, 8 aa, Influenza virus
GNMRCTIC

SEQ ID NO: 278821 - protein, 8 aa, Influenza virus
NMRCTICI

SEQ ID NO: 278822 - protein, 8 aa, Influenza virus
MNPNQKLF

SEQ ID NO: 278823 - protein, 8 aa, Influenza virus
NPNQKLFA

SEQ ID NO: 278824 - protein, 8 aa, Influenza virus
PNQKLFAL

SEQ ID NO: 278825 - protein, 8 aa, Influenza virus
NQKLFALS

SEQ ID NO: 278826 - protein, 8 aa, Influenza virus
QKLFALSG

SEQ ID NO: 278827 - protein, 8 aa, Influenza virus
KLFALSGV

SEQ ID NO: 278828 - protein, 8 aa, Influenza virus
LFALSGVA

SEQ ID NO: 278829 - protein, 8 aa, Influenza virus
FALSGVAI

SEQ ID NO: 278830 - protein, 8 aa, Influenza virus
ALSGVAIA

SEQ ID NO: 278831 - protein, 8 aa, Influenza virus
LSGVAIAL

SEQ ID NO: 278832 - protein, 8 aa, Influenza virus
SGVAIALS

SEQ ID NO: 278833 - protein, 8 aa, Influenza virus
GVAIALSV

SEQ ID NO: 278834 - protein, 8 aa, Influenza virus
VAIALSVL

SEQ ID NO: 278835 - protein, 8 aa, Influenza virus
AIALSVLN

SEQ ID NO: 278836 - protein, 8 aa, Influenza virus
IALSVLNL

SEQ ID NO: 278837 - protein, 8 aa, Influenza virus
ALSVLNLL

SEQ ID NO: 278838 - protein, 8 aa, Influenza virus
LSVLNLLI

SEQ ID NO: 278839 - protein, 8 aa, Influenza virus
SVLNLLIG

SEQ ID NO: 278840 - protein, 8 aa, Influenza virus
VLNLLIGI

SEQ ID NO: 278841 - protein, 8 aa, Influenza virus
LNLLIGIS

SEQ ID NO: 278842 - protein, 8 aa, Influenza virus
NLLIGISN

SEQ ID NO: 278843 - protein, 8 aa, Influenza virus
LLIGISNV

SEQ ID NO: 278844 - protein, 8 aa, Influenza virus
LIGISNVG

SEQ ID NO: 278845 - protein, 8 aa, Influenza virus
IGISNVGL

SEQ ID NO: 278846 - protein, 8 aa, Influenza virus
GISNVGLN

SEQ ID NO: 278847 - protein, 8 aa, Influenza virus
SNVGLNVS

SEQ ID NO: 278848 - protein, 8 aa, Influenza virus
NVGLNVSL

SEQ ID NO: 278849 - protein, 8 aa, Influenza virus
VGLNVSLH

SEQ ID NO: 278850 - protein, 8 aa, Influenza virus
GLNVSLHL

SEQ ID NO: 278851 - protein, 8 aa, Influenza virus
LNVSLHLK

SEQ ID NO: 278852 - protein, 8 aa, Influenza virus
ENTYVNNT

SEQ ID NO: 278853 - protein, 8 aa, Influenza virus
NTYVNNTT

SEQ ID NO: 278854 - protein, 8 aa, Influenza virus
TYVNNTTI

SEQ ID NO: 278855 - protein, 8 aa, Influenza virus
YVNNTTII

SEQ ID NO: 278856 - protein, 8 aa, Influenza virus
SYLLLNKS

SEQ ID NO: 278857 - protein, 8 aa, Influenza virus
YLLLNKSL

SEQ ID NO: 278858 - protein, 8 aa, Influenza virus
LLLNKSLC

SEQ ID NO: 278859 - protein, 8 aa, Influenza virus
LLNKSLCN

SEQ ID NO: 278860 - protein, 8 aa, Influenza virus
LNKSLCNV

SEQ ID NO: 278861 - protein, 8 aa, Influenza virus
NKSLCNVE

SEQ ID NO: 278862 - protein, 8 aa, Influenza virus
KSLCNVEG

SEQ ID NO: 278863 - protein, 8 aa, Influenza virus
SLCNVEGW

SEQ ID NO: 278864 - protein, 8 aa, Influenza virus
LCNVEGWV

SEQ ID NO: 278865 - protein, 8 aa, Influenza virus
CNVEGWVV

SEQ ID NO: 278866 - protein, 8 aa, Influenza virus
NVEGWVVI

SEQ ID NO: 278867 - protein, 8 aa, Influenza virus
VEGWVVIA

SEQ ID NO: 278868 - protein, 8 aa, Influenza virus
EGWVVIAK

SEQ ID NO: 278869 - protein, 8 aa, Influenza virus
GWVVIAKD

SEQ ID NO: 278870 - protein, 8 aa, Influenza virus
WVVIAKDN

SEQ ID NO: 278871 - protein, 8 aa, Influenza virus
VVIAKDNA

SEQ ID NO: 278872 - protein, 8 aa, Influenza virus
VIAKDNAV

SEQ ID NO: 278873 - protein, 8 aa, Influenza virus
IAKDNAVR

SEQ ID NO: 278874 - protein, 8 aa, Influenza virus
AKDNAVRF

SEQ ID NO: 278875 - protein, 8 aa, Influenza virus
KDNAVRFG

SEQ ID NO: 278876 - protein, 8 aa, Influenza virus
DNAVRFGE

SEQ ID NO: 278877 - protein, 8 aa, Influenza virus
NAVRFGES

SEQ ID NO: 278878 - protein, 8 aa, Influenza virus
AVRFGESE

SEQ ID NO: 278879 - protein, 8 aa, Influenza virus
VRFGESEQ

SEQ ID NO: 278880 - protein, 8 aa, Influenza virus
RFGESEQI

SEQ ID NO: 278881 - protein, 8 aa, Influenza virus
FGESEQII

SEQ ID NO: 278882 - protein, 8 aa, Influenza virus
GESEQIIV

SEQ ID NO: 278883 - protein, 8 aa, Influenza virus
ESEQIIVT

SEQ ID NO: 278884 - protein, 8 aa, Influenza virus
SEQIIVTR

SEQ ID NO: 278885 - protein, 8 aa, Influenza virus
EQIIVTRE

SEQ ID NO: 278886 - protein, 8 aa, Influenza virus
QIIVTREP

SEQ ID NO: 278887 - protein, 8 aa, Influenza virus
IIVTREPY

SEQ ID NO: 278888 - protein, 8 aa, Influenza virus
IVTREPYV

SEQ ID NO: 278889 - protein, 8 aa, Influenza virus
VTREPYVS

SEQ ID NO: 278890 - protein, 8 aa, Influenza virus
TREPYVSC

SEQ ID NO: 278891 - protein, 8 aa, Influenza virus
REPYVSCD

SEQ ID NO: 278892 - protein, 8 aa, Influenza virus
EPYVSCDP

SEQ ID NO: 278893 - protein, 8 aa, Influenza virus
PYVSCDPT

SEQ ID NO: 278894 - protein, 8 aa, Influenza virus
GCKMYALH

SEQ ID NO: 278895 - protein, 8 aa, Influenza virus
CKMYALHQ

SEQ ID NO: 278896 - protein, 8 aa, Influenza virus
KMYALHQG

SEQ ID NO: 278897 - protein, 8 aa, Influenza virus
MYALHQGT

SEQ ID NO: 278898 - protein, 8 aa, Influenza virus
YALHQGTT

SEQ ID NO: 278899 - protein, 8 aa, Influenza virus
ALHQGTTI

SEQ ID NO: 278900 - protein, 8 aa, Influenza virus
LHQGTTIR

SEQ ID NO: 278901 - protein, 8 aa, Influenza virus
HQGTTIRN

SEQ ID NO: 278902 - protein, 8 aa, Influenza virus
QGTTIRNK

SEQ ID NO: 278903 - protein, 8 aa, Influenza virus
GTTIRNKH

SEQ ID NO: 278904 - protein, 8 aa, Influenza virus
TTIRNKHS

SEQ ID NO: 278905 - protein, 8 aa, Influenza virus
TIRNKHSN

SEQ ID NO: 278906 - protein, 8 aa, Influenza virus
IRNKHSNG

SEQ ID NO: 278907 - protein, 8 aa, Influenza virus
RNKHSNGT

SEQ ID NO: 278908 - protein, 8 aa, Influenza virus
NKHSNGTI

SEQ ID NO: 278909 - protein, 8 aa, Influenza virus
KHSNGTIH

SEQ ID NO: 278910 - protein, 8 aa, Influenza virus
HSNGTIHD

SEQ ID NO: 278911 - protein, 8 aa, Influenza virus
SNGTIHDR

SEQ ID NO: 278912 - protein, 8 aa, Influenza virus
NGTIHDRT

SEQ ID NO: 278913 - protein, 8 aa, Influenza virus
GTIHDRTA

SEQ ID NO: 278914 - protein, 8 aa, Influenza virus
TIHDRTAF

SEQ ID NO: 278915 - protein, 8 aa, Influenza virus
IHDRTAFR

SEQ ID NO: 278916 - protein, 8 aa, Influenza virus
HDRTAFRG

SEQ ID NO: 278917 - protein, 8 aa, Influenza virus
DRTAFRGL

SEQ ID NO: 278918 - protein, 8 aa, Influenza virus
RTAFRGLI

SEQ ID NO: 278919 - protein, 8 aa, Influenza virus
TAFRGLIS

SEQ ID NO: 278920 - protein, 8 aa, Influenza virus
AFRGLIST

SEQ ID NO: 278921 - protein, 8 aa, Influenza virus
FRGLISTP

SEQ ID NO: 278922 - protein, 8 aa, Influenza virus
RGLISTPL

SEQ ID NO: 278923 - protein, 8 aa, Influenza virus
GLISTPLG

SEQ ID NO: 278924 - protein, 8 aa, Influenza virus
SNSDFMCV

SEQ ID NO: 278925 - protein, 8 aa, Influenza virus
NSDFMCVG

SEQ ID NO: 278926 - protein, 8 aa, Influenza virus
SDFMCVGW

SEQ ID NO: 278927 - protein, 8 aa, Influenza virus
DFMCVGWS

SEQ ID NO: 278928 - protein, 8 aa, Influenza virus
FMCVGWSS

SEQ ID NO: 278929 - protein, 8 aa, Influenza virus
MCVGWSST

SEQ ID NO: 278930 - protein, 8 aa, Influenza virus
CVGWSSTT

SEQ ID NO: 278931 - protein, 8 aa, Influenza virus
VGWSSTTC

SEQ ID NO: 278932 - protein, 8 aa, Influenza virus
GWSSTTCH

SEQ ID NO: 278933 - protein, 8 aa, Influenza virus
WSSTTCHD

SEQ ID NO: 278934 - protein, 8 aa, Influenza virus
SSTTCHDG

SEQ ID NO: 278935 - protein, 8 aa, Influenza virus
STTCHDGI

SEQ ID NO: 278936 - protein, 8 aa, Influenza virus
CHDGIGRM

SEQ ID NO: 278937 - protein, 8 aa, Influenza virus
HDGIGRMT

SEQ ID NO: 278938 - protein, 8 aa, Influenza virus
DGIGRMTI

SEQ ID NO: 278939 - protein, 8 aa, Influenza virus
GIGRMTIC

SEQ ID NO: 278940 - protein, 8 aa, Influenza virus
GRMTICIQ

SEQ ID NO: 278941 - protein, 8 aa, Influenza virus
RMTICIQG

SEQ ID NO: 278942 - protein, 8 aa, Influenza virus
MTICIQGN

SEQ ID NO: 278943 - protein, 8 aa, Influenza virus
TICIQGNN

SEQ ID NO: 278944 - protein, 8 aa, Influenza virus
QGNNDNAT

SEQ ID NO: 278945 - protein, 8 aa, Influenza virus
GNNDNATA

SEQ ID NO: 278946 - protein, 8 aa, Influenza virus
NNDNATAT

SEQ ID NO: 278947 - protein, 8 aa, Influenza virus
NDNATATV

SEQ ID NO: 278948 - protein, 8 aa, Influenza virus
DNATATVY

SEQ ID NO: 278949 - protein, 8 aa, Influenza virus
NATATVYY

SEQ ID NO: 278950 - protein, 8 aa, Influenza virus
ATATVYYN

SEQ ID NO: 278951 - protein, 8 aa, Influenza virus
TATVYYNR

SEQ ID NO: 278952 - protein, 8 aa, Influenza virus
ATVYYNRR

SEQ ID NO: 278953 - protein, 8 aa, Influenza virus
TVYYNRRL

SEQ ID NO: 278954 - protein, 8 aa, Influenza virus
VYYNRRLT

SEQ ID NO: 278955 - protein, 8 aa, Influenza virus
YYNRRLTT

SEQ ID NO: 278956 - protein, 8 aa, Influenza virus
YNRRLTTT

SEQ ID NO: 278957 - protein, 8 aa, Influenza virus
NRRLTTTI

SEQ ID NO: 278958 - protein, 8 aa, Influenza virus
RRLTTTIK

SEQ ID NO: 278959 - protein, 8 aa, Influenza virus
RLTTTIKT

SEQ ID NO: 278960 - protein, 8 aa, Influenza virus
LTTTIKTW

SEQ ID NO: 278961 - protein, 8 aa, Influenza virus
TTTIKTWA

SEQ ID NO: 278962 - protein, 8 aa, Influenza virus
TTIKTWAR

SEQ ID NO: 278963 - protein, 8 aa, Influenza virus
TIKTWARN

SEQ ID NO: 278964 - protein, 8 aa, Influenza virus
IKTWARNI

SEQ ID NO: 278965 - protein, 8 aa, Influenza virus
KTWARNIL

SEQ ID NO: 278966 - protein, 8 aa, Influenza virus
TWARNILR

SEQ ID NO: 278967 - protein, 8 aa, Influenza virus
WARNILRT

SEQ ID NO: 278968 - protein, 8 aa, Influenza virus
ARNILRTQ

SEQ ID NO: 278969 - protein, 8 aa, Influenza virus
RNILRTQE

SEQ ID NO: 278970 - protein, 8 aa, Influenza virus
NILRTQES

SEQ ID NO: 278971 - protein, 8 aa, Influenza virus
ILRTQESE

SEQ ID NO: 278972 - protein, 8 aa, Influenza virus
LRTQESEC

SEQ ID NO: 278973 - protein, 8 aa, Influenza virus
RTQESECV

SEQ ID NO: 278974 - protein, 8 aa, Influenza virus
TQESECVC

SEQ ID NO: 278975 - protein, 8 aa, Influenza virus
QESECVCH

SEQ ID NO: 278976 - protein, 8 aa, Influenza virus
ESECVCHN

SEQ ID NO: 278977 - protein, 8 aa, Influenza virus
SECVCHNG

SEQ ID NO: 278978 - protein, 8 aa, Influenza virus
ECVCHNGT

SEQ ID NO: 278979 - protein, 8 aa, Influenza virus
CVCHNGTC

SEQ ID NO: 278980 - protein, 8 aa, Influenza virus
VCHNGTCA

SEQ ID NO: 278981 - protein, 8 aa, Influenza virus
CHNGTCAV

SEQ ID NO: 278982 - protein, 8 aa, Influenza virus
HNGTCAVV

SEQ ID NO: 278983 - protein, 8 aa, Influenza virus
NGTCAVVM

SEQ ID NO: 278984 - protein, 8 aa, Influenza virus
GTCAVVMT

SEQ ID NO: 278985 - protein, 8 aa, Influenza virus
TCAVVMTD

SEQ ID NO: 278986 - protein, 8 aa, Influenza virus
CAVVMTDG

SEQ ID NO: 278987 - protein, 8 aa, Influenza virus
AVVMTDGS

SEQ ID NO: 278988 - protein, 8 aa, Influenza virus
VVMTDGSA

SEQ ID NO: 278989 - protein, 8 aa, Influenza virus
VMTDGSAS

SEQ ID NO: 278990 - protein, 8 aa, Influenza virus
MTDGSASS

SEQ ID NO: 278991 - protein, 8 aa, Influenza virus
TDGSASSQ

SEQ ID NO: 278992 - protein, 8 aa, Influenza virus
DGSASSQA

SEQ ID NO: 278993 - protein, 8 aa, Influenza virus
ASSQAYTK

SEQ ID NO: 278994 - protein, 8 aa, Influenza virus
LKGSARHI

SEQ ID NO: 278995 - protein, 8 aa, Influenza virus
KGSARHIE

SEQ ID NO: 278996 - protein, 8 aa, Influenza virus
GSARHIEE

SEQ ID NO: 278997 - protein, 8 aa, Influenza virus
SARHIEEC

SEQ ID NO: 278998 - protein, 8 aa, Influenza virus
ARHIEECS

SEQ ID NO: 278999 - protein, 8 aa, Influenza virus
RHIEECSC

SEQ ID NO: 279000 - protein, 8 aa, Influenza virus
HIEECSCY

SEQ ID NO: 279001 - protein, 8 aa, Influenza virus
IEECSCYG

SEQ ID NO: 279002 - protein, 8 aa, Influenza virus
EECSCYGH

SEQ ID NO: 279003 - protein, 8 aa, Influenza virus
ECSCYGHN

SEQ ID NO: 279004 - protein, 8 aa, Influenza virus
VTCVCRDN

SEQ ID NO: 279005 - protein, 8 aa, Influenza virus
TCVCRDNW

SEQ ID NO: 279006 - protein, 8 aa, Influenza virus
CVCRDNWQ

SEQ ID NO: 279007 - protein, 8 aa, Influenza virus
VCRDNWQG

SEQ ID NO: 279008 - protein, 8 aa, Influenza virus
CRDNWQGA

SEQ ID NO: 279009 - protein, 8 aa, Influenza virus
RDNWQGAN

SEQ ID NO: 279010 - protein, 8 aa, Influenza virus
DNWQGANR

SEQ ID NO: 279011 - protein, 8 aa, Influenza virus
NWQGANRP

SEQ ID NO: 279012 - protein, 8 aa, Influenza virus
WQGANRPI

SEQ ID NO: 279013 - protein, 8 aa, Influenza virus
QGANRPII

SEQ ID NO: 279014 - protein, 8 aa, Influenza virus
GANRPIIE

SEQ ID NO: 279015 - protein, 8 aa, Influenza virus
ANRPIIEI

SEQ ID NO: 279016 - protein, 8 aa, Influenza virus
NRPIIEID

SEQ ID NO: 279017 - protein, 8 aa, Influenza virus
RPIIEIDM

SEQ ID NO: 279018 - protein, 8 aa, Influenza virus
PIIEIDMN

SEQ ID NO: 279019 - protein, 8 aa, Influenza virus
LEHTSRYV

SEQ ID NO: 279020 - protein, 8 aa, Influenza virus
EHTSRYVC

SEQ ID NO: 279021 - protein, 8 aa, Influenza virus
HTSRYVCT

SEQ ID NO: 279022 - protein, 8 aa, Influenza virus
TSRYVCTG

SEQ ID NO: 279023 - protein, 8 aa, Influenza virus
YVCTGILT

SEQ ID NO: 279024 - protein, 8 aa, Influenza virus
VCTGILTD

SEQ ID NO: 279025 - protein, 8 aa, Influenza virus
CTGILTDT

SEQ ID NO: 279026 - protein, 8 aa, Influenza virus
TGILTDTS

SEQ ID NO: 279027 - protein, 8 aa, Influenza virus
GILTDTSR

SEQ ID NO: 279028 - protein, 8 aa, Influenza virus
ILTDTSRP

SEQ ID NO: 279029 - protein, 8 aa, Influenza virus
LTDTSRPG

SEQ ID NO: 279030 - protein, 8 aa, Influenza virus
TDTSRPGD

SEQ ID NO: 279031 - protein, 8 aa, Influenza virus
DTSRPGDK

SEQ ID NO: 279032 - protein, 8 aa, Influenza virus
GDCSNPIT

SEQ ID NO: 279033 - protein, 8 aa, Influenza virus
DCSNPITG

SEQ ID NO: 279034 - protein, 8 aa, Influenza virus
CSNPITGS

SEQ ID NO: 279035 - protein, 8 aa, Influenza virus
SNPITGSP

SEQ ID NO: 279036 - protein, 8 aa, Influenza virus
NPITGSPG

SEQ ID NO: 279037 - protein, 8 aa, Influenza virus
PITGSPGA

SEQ ID NO: 279038 - protein, 8 aa, Influenza virus
ITGSPGAP

SEQ ID NO: 279039 - protein, 8 aa, Influenza virus
TGSPGAPG

SEQ ID NO: 279040 - protein, 8 aa, Influenza virus
APGVKGFG

SEQ ID NO: 279041 - protein, 8 aa, Influenza virus
PGVKGFGF

SEQ ID NO: 279042 - protein, 8 aa, Influenza virus
GVKGFGFL

SEQ ID NO: 279043 - protein, 8 aa, Influenza virus
VKGFGFLN

SEQ ID NO: 279044 - protein, 8 aa, Influenza virus
KGFGFLNG

SEQ ID NO: 279045 - protein, 8 aa, Influenza virus
DNTWLGRT

SEQ ID NO: 279046 - protein, 8 aa, Influenza virus
NTWLGRTI

SEQ ID NO: 279047 - protein, 8 aa, Influenza virus
TWLGRTIS

SEQ ID NO: 279048 - protein, 8 aa, Influenza virus
WLGRTISP

SEQ ID NO: 279049 - protein, 8 aa, Influenza virus
LGRTISPR

SEQ ID NO: 279050 - protein, 8 aa, Influenza virus
GRTISPRS

SEQ ID NO: 279051 - protein, 8 aa, Influenza virus
RTISPRSR

SEQ ID NO: 279052 - protein, 8 aa, Influenza virus
TISPRSRS

SEQ ID NO: 279053 - protein, 8 aa, Influenza virus
ISPRSRSG

SEQ ID NO: 279054 - protein, 8 aa, Influenza virus
SPRSRSGF

SEQ ID NO: 279055 - protein, 8 aa, Influenza virus
PRSRSGFE

SEQ ID NO: 279056 - protein, 8 aa, Influenza virus
RSRSGFEM

SEQ ID NO: 279057 - protein, 8 aa, Influenza virus
SRSGFEML

SEQ ID NO: 279058 - protein, 8 aa, Influenza virus
RSGFEMLK

SEQ ID NO: 279059 - protein, 8 aa, Influenza virus
SGFEMLKI

SEQ ID NO: 279060 - protein, 8 aa, Influenza virus
GFEMLKIP

SEQ ID NO: 279061 - protein, 8 aa, Influenza virus
FEMLKIPN

SEQ ID NO: 279062 - protein, 8 aa, Influenza virus
EMLKIPNA

SEQ ID NO: 279063 - protein, 8 aa, Influenza virus
MLKIPNAG

SEQ ID NO: 279064 - protein, 8 aa, Influenza virus
LKIPNAGT

SEQ ID NO: 279065 - protein, 8 aa, Influenza virus
KIPNAGTD

SEQ ID NO: 279066 - protein, 8 aa, Influenza virus
IPNAGTDP

SEQ ID NO: 279067 - protein, 8 aa, Influenza virus
NAGTDPNS

SEQ ID NO: 279068 - protein, 8 aa, Influenza virus
ERQEIVDN

SEQ ID NO: 279069 - protein, 8 aa, Influenza virus
RQEIVDNN

SEQ ID NO: 279070 - protein, 8 aa, Influenza virus
QEIVDNNN

SEQ ID NO: 279071 - protein, 8 aa, Influenza virus
EIVDNNNW

SEQ ID NO: 279072 - protein, 8 aa, Influenza virus
IVDNNNWS

SEQ ID NO: 279073 - protein, 8 aa, Influenza virus
VDNNNWSG

SEQ ID NO: 279074 - protein, 8 aa, Influenza virus
DNNNWSGY

SEQ ID NO: 279075 - protein, 8 aa, Influenza virus
NNNWSGYS

SEQ ID NO: 279076 - protein, 8 aa, Influenza virus
NNWSGYSG

SEQ ID NO: 279077 - protein, 8 aa, Influenza virus
NWSGYSGS

SEQ ID NO: 279078 - protein, 8 aa, Influenza virus
WSGYSGSF

SEQ ID NO: 279079 - protein, 8 aa, Influenza virus
SGYSGSFI

SEQ ID NO: 279080 - protein, 8 aa, Influenza virus
GYSGSFID

SEQ ID NO: 279081 - protein, 8 aa, Influenza virus
YSGSFIDY

SEQ ID NO: 279082 - protein, 8 aa, Influenza virus
SGSFIDYW

SEQ ID NO: 279083 - protein, 8 aa, Influenza virus
GSFIDYWN

SEQ ID NO: 279084 - protein, 8 aa, Influenza virus
SFIDYWND

SEQ ID NO: 279085 - protein, 8 aa, Influenza virus
SECYNPCF

SEQ ID NO: 279086 - protein, 8 aa, Influenza virus
ECYNPCFY

SEQ ID NO: 279087 - protein, 8 aa, Influenza virus
CYNPCFYV

SEQ ID NO: 279088 - protein, 8 aa, Influenza virus
YNPCFYVE

SEQ ID NO: 279089 - protein, 8 aa, Influenza virus
NPCFYVEL

SEQ ID NO: 279090 - protein, 8 aa, Influenza virus
PCFYVELI

SEQ ID NO: 279091 - protein, 8 aa, Influenza virus
CFYVELIR

SEQ ID NO: 279092 - protein, 8 aa, Influenza virus
FYVELIRG

SEQ ID NO: 279093 - protein, 8 aa, Influenza virus
YVELIRGR

SEQ ID NO: 279094 - protein, 8 aa, Influenza virus
VELIRGRP

SEQ ID NO: 279095 - protein, 8 aa, Influenza virus
ELIRGRPE

SEQ ID NO: 279096 - protein, 8 aa, Influenza virus
LIRGRPEE

SEQ ID NO: 279097 - protein, 8 aa, Influenza virus
IRGRPEEA

SEQ ID NO: 279098 - protein, 8 aa, Influenza virus
RGRPEEAK

SEQ ID NO: 279099 - protein, 8 aa, Influenza virus
GRPEEAKY

SEQ ID NO: 279100 - protein, 8 aa, Influenza virus
RPEEAKYV

SEQ ID NO: 279101 - protein, 8 aa, Influenza virus
PEEAKYVW

SEQ ID NO: 279102 - protein, 8 aa, Influenza virus
EEAKYVWW

SEQ ID NO: 279103 - protein, 8 aa, Influenza virus
EAKYVWWT

SEQ ID NO: 279104 - protein, 8 aa, Influenza virus
AKYVWWTS

SEQ ID NO: 279105 - protein, 8 aa, Influenza virus
KYVWWTSN

SEQ ID NO: 279106 - protein, 8 aa, Influenza virus
YVWWTSNS

SEQ ID NO: 279107 - protein, 8 aa, Influenza virus
VWWTSNSL

SEQ ID NO: 279108 - protein, 8 aa, Influenza virus
WWTSNSLI

SEQ ID NO: 279109 - protein, 8 aa, Influenza virus
WTSNSLIA

SEQ ID NO: 279110 - protein, 8 aa, Influenza virus
TSNSLIAL

SEQ ID NO: 279111 - protein, 8 aa, Influenza virus
SNSLIALC

SEQ ID NO: 279112 - protein, 8 aa, Influenza virus
NSLIALCG

SEQ ID NO: 279113 - protein, 8 aa, Influenza virus
SLIALCGS

SEQ ID NO: 279114 - protein, 8 aa, Influenza virus
LIALCGSP

SEQ ID NO: 279115 - protein, 8 aa, Influenza virus
PVGSGSFP

SEQ ID NO: 279116 - protein, 8 aa, Influenza virus
VGSGSFPD

SEQ ID NO: 279117 - protein, 8 aa, Influenza virus
GSGSFPDG

SEQ ID NO: 279118 - protein, 8 aa, Influenza virus
SGSFPDGA

SEQ ID NO: 279119 - protein, 8 aa, Influenza virus
GSFPDGAQ

SEQ ID NO: 279120 - protein, 8 aa, Influenza virus
SFPDGAQI

SEQ ID NO: 279121 - protein, 8 aa, Influenza virus
FPDGAQIQ

SEQ ID NO: 279122 - protein, 8 aa, Influenza virus
PDGAQIQY

SEQ ID NO: 279123 - protein, 8 aa, Influenza virus
DGAQIQYF

SEQ ID NO: 279124 - protein, 8 aa, Influenza virus
GAQIQYFS

SEQ ID NO: 279125 - protein, 8 aa, Influenza virus
MLLASTNA

SEQ ID NO: 279126 - protein, 8 aa, Influenza virus
LLASTNAY

SEQ ID NO: 279127 - protein, 8 aa, Influenza virus
LASTNAYD

SEQ ID NO: 279128 - protein, 8 aa, Influenza virus
ASTNAYDR

SEQ ID NO: 279129 - protein, 8 aa, Influenza virus
STNAYDRI

SEQ ID NO: 279130 - protein, 8 aa, Influenza virus
TNAYDRIC

SEQ ID NO: 279131 - protein, 8 aa, Influenza virus
NAYDRICI

SEQ ID NO: 279132 - protein, 8 aa, Influenza virus
AYDRICIG

SEQ ID NO: 279133 - protein, 8 aa, Influenza virus
YDRICIGY

SEQ ID NO: 279134 - protein, 8 aa, Influenza virus
DRICIGYQ

SEQ ID NO: 279135 - protein, 8 aa, Influenza virus
RICIGYQS

SEQ ID NO: 279136 - protein, 8 aa, Influenza virus
ICIGYQSN

SEQ ID NO: 279137 - protein, 8 aa, Influenza virus
CIGYQSNN

SEQ ID NO: 279138 - protein, 8 aa, Influenza virus
IGYQSNNS

SEQ ID NO: 279139 - protein, 8 aa, Influenza virus
GYQSNNST

SEQ ID NO: 279140 - protein, 8 aa, Influenza virus
YQSNNSTD

SEQ ID NO: 279141 - protein, 8 aa, Influenza virus
QSNNSTDT

SEQ ID NO: 279142 - protein, 8 aa, Influenza virus
SNNSTDTV

SEQ ID NO: 279143 - protein, 8 aa, Influenza virus
NNSTDTVN

SEQ ID NO: 279144 - protein, 8 aa, Influenza virus
NSTDTVNT

SEQ ID NO: 279145 - protein, 8 aa, Influenza virus
STDTVNTL

SEQ ID NO: 279146 - protein, 8 aa, Influenza virus
TDTVNTLI

SEQ ID NO: 279147 - protein, 8 aa, Influenza virus
DTVNTLIE

SEQ ID NO: 279148 - protein, 8 aa, Influenza virus
TVNTLIEQ

SEQ ID NO: 279149 - protein, 8 aa, Influenza virus
VNTLIEQN

SEQ ID NO: 279150 - protein, 8 aa, Influenza virus
TLIEQNVP

SEQ ID NO: 279151 - protein, 8 aa, Influenza virus
LIEQNVPV

SEQ ID NO: 279152 - protein, 8 aa, Influenza virus
IEQNVPVT

SEQ ID NO: 279153 - protein, 8 aa, Influenza virus
EQNVPVTQ

SEQ ID NO: 279154 - protein, 8 aa, Influenza virus
QNVPVTQT

SEQ ID NO: 279155 - protein, 8 aa, Influenza virus
NVPVTQTM

SEQ ID NO: 279156 - protein, 8 aa, Influenza virus
VPVTQTME

SEQ ID NO: 279157 - protein, 8 aa, Influenza virus
PVTQTMEL

SEQ ID NO: 279158 - protein, 8 aa, Influenza virus
VTQTMELV

SEQ ID NO: 279159 - protein, 8 aa, Influenza virus
TQTMELVE

SEQ ID NO: 279160 - protein, 8 aa, Influenza virus
QTMELVET

SEQ ID NO: 279161 - protein, 8 aa, Influenza virus
TMELVETE

SEQ ID NO: 279162 - protein, 8 aa, Influenza virus
MELVETEK

SEQ ID NO: 279163 - protein, 8 aa, Influenza virus
ELVETEKH

SEQ ID NO: 279164 - protein, 8 aa, Influenza virus
EKHPAYCN

SEQ ID NO: 279165 - protein, 8 aa, Influenza virus
KHPAYCNT

SEQ ID NO: 279166 - protein, 8 aa, Influenza virus
HPAYCNTD

SEQ ID NO: 279167 - protein, 8 aa, Influenza virus
PAYCNTDL

SEQ ID NO: 279168 - protein, 8 aa, Influenza virus
AYCNTDLG

SEQ ID NO: 279169 - protein, 8 aa, Influenza virus
YCNTDLGA

SEQ ID NO: 279170 - protein, 8 aa, Influenza virus
CNTDLGAP

SEQ ID NO: 279171 - protein, 8 aa, Influenza virus
NTDLGAPL

SEQ ID NO: 279172 - protein, 8 aa, Influenza virus
TDLGAPLE

SEQ ID NO: 279173 - protein, 8 aa, Influenza virus
DLGAPLEL

SEQ ID NO: 279174 - protein, 8 aa, Influenza virus
LGAPLELR

SEQ ID NO: 279175 - protein, 8 aa, Influenza virus
GAPLELRD

SEQ ID NO: 279176 - protein, 8 aa, Influenza virus
APLELRDC

SEQ ID NO: 279177 - protein, 8 aa, Influenza virus
PLELRDCK

SEQ ID NO: 279178 - protein, 8 aa, Influenza virus
LELRDCKI

SEQ ID NO: 279179 - protein, 8 aa, Influenza virus
ELRDCKIE

SEQ ID NO: 279180 - protein, 8 aa, Influenza virus
LRDCKIEA

SEQ ID NO: 279181 - protein, 8 aa, Influenza virus
RDCKIEAV

SEQ ID NO: 279182 - protein, 8 aa, Influenza virus
DCKIEAVI

SEQ ID NO: 279183 - protein, 8 aa, Influenza virus
CKIEAVIY

SEQ ID NO: 279184 - protein, 8 aa, Influenza virus
KIEAVIYG

SEQ ID NO: 279185 - protein, 8 aa, Influenza virus
IEAVIYGN

SEQ ID NO: 279186 - protein, 8 aa, Influenza virus
EAVIYGNP

SEQ ID NO: 279187 - protein, 8 aa, Influenza virus
AVIYGNPK

SEQ ID NO: 279188 - protein, 8 aa, Influenza virus
VIYGNPKC

SEQ ID NO: 279189 - protein, 8 aa, Influenza virus
IYGNPKCD

SEQ ID NO: 279190 - protein, 8 aa, Influenza virus
YGNPKCDI

SEQ ID NO: 279191 - protein, 8 aa, Influenza virus
GNPKCDIH

SEQ ID NO: 279192 - protein, 8 aa, Influenza virus
NPKCDIHL

SEQ ID NO: 279193 - protein, 8 aa, Influenza virus
PKCDIHLK

SEQ ID NO: 279194 - protein, 8 aa, Influenza virus
KCDIHLKD

SEQ ID NO: 279195 - protein, 8 aa, Influenza virus
CDIHLKDQ

SEQ ID NO: 279196 - protein, 8 aa, Influenza virus
HLKDQGWS

SEQ ID NO: 279197 - protein, 8 aa, Influenza virus
LKDQGWSY

SEQ ID NO: 279198 - protein, 8 aa, Influenza virus
KDQGWSYI

SEQ ID NO: 279199 - protein, 8 aa, Influenza virus
DQGWSYIV

SEQ ID NO: 279200 - protein, 8 aa, Influenza virus
QGWSYIVE

SEQ ID NO: 279201 - protein, 8 aa, Influenza virus
GWSYIVER

SEQ ID NO: 279202 - protein, 8 aa, Influenza virus
WSYIVERP

SEQ ID NO: 279203 - protein, 8 aa, Influenza virus
SYIVERPS

SEQ ID NO: 279204 - protein, 8 aa, Influenza virus
YIVERPSA

SEQ ID NO: 279205 - protein, 8 aa, Influenza virus
IVERPSAP

SEQ ID NO: 279206 - protein, 8 aa, Influenza virus
VERPSAPE

SEQ ID NO: 279207 - protein, 8 aa, Influenza virus
ERPSAPEG

SEQ ID NO: 279208 - protein, 8 aa, Influenza virus
RPSAPEGM

SEQ ID NO: 279209 - protein, 8 aa, Influenza virus
PSAPEGMC

SEQ ID NO: 279210 - protein, 8 aa, Influenza virus
SAPEGMCY

SEQ ID NO: 279211 - protein, 8 aa, Influenza virus
APEGMCYP

SEQ ID NO: 279212 - protein, 8 aa, Influenza virus
PEGMCYPG

SEQ ID NO: 279213 - protein, 8 aa, Influenza virus
EGMCYPGS

SEQ ID NO: 279214 - protein, 8 aa, Influenza virus
GMCYPGSV

SEQ ID NO: 279215 - protein, 8 aa, Influenza virus
MCYPGSVE

SEQ ID NO: 279216 - protein, 8 aa, Influenza virus
CYPGSVEN

SEQ ID NO: 279217 - protein, 8 aa, Influenza virus
YPGSVENL

SEQ ID NO: 279218 - protein, 8 aa, Influenza virus
PGSVENLE

SEQ ID NO: 279219 - protein, 8 aa, Influenza virus
GSVENLEE

SEQ ID NO: 279220 - protein, 8 aa, Influenza virus
SVENLEEL

SEQ ID NO: 279221 - protein, 8 aa, Influenza virus
VENLEELR

SEQ ID NO: 279222 - protein, 8 aa, Influenza virus
ENLEELRF

SEQ ID NO: 279223 - protein, 8 aa, Influenza virus
NLEELRFV

SEQ ID NO: 279224 - protein, 8 aa, Influenza virus
LEELRFVF

SEQ ID NO: 279225 - protein, 8 aa, Influenza virus
EELRFVFS

SEQ ID NO: 279226 - protein, 8 aa, Influenza virus
ELRFVFSN

SEQ ID NO: 279227 - protein, 8 aa, Influenza virus
LRFVFSNA

SEQ ID NO: 279228 - protein, 8 aa, Influenza virus
RFVFSNAA

SEQ ID NO: 279229 - protein, 8 aa, Influenza virus
FVFSNAAS

SEQ ID NO: 279230 - protein, 8 aa, Influenza virus
VFSNAASY

SEQ ID NO: 279231 - protein, 8 aa, Influenza virus
FSNAASYK

SEQ ID NO: 279232 - protein, 8 aa, Influenza virus
SNAASYKR

SEQ ID NO: 279233 - protein, 8 aa, Influenza virus
NAASYKRI

SEQ ID NO: 279234 - protein, 8 aa, Influenza virus
AASYKRIR

SEQ ID NO: 279235 - protein, 8 aa, Influenza virus
ASYKRIRL

SEQ ID NO: 279236 - protein, 8 aa, Influenza virus
SYKRIRLF

SEQ ID NO: 279237 - protein, 8 aa, Influenza virus
YKRIRLFD

SEQ ID NO: 279238 - protein, 8 aa, Influenza virus
KRIRLFDY

SEQ ID NO: 279239 - protein, 8 aa, Influenza virus
RIRLFDYS

SEQ ID NO: 279240 - protein, 8 aa, Influenza virus
IRLFDYSR

SEQ ID NO: 279241 - protein, 8 aa, Influenza virus
RLFDYSRW

SEQ ID NO: 279242 - protein, 8 aa, Influenza virus
LFDYSRWN

SEQ ID NO: 279243 - protein, 8 aa, Influenza virus
FDYSRWNV

SEQ ID NO: 279244 - protein, 8 aa, Influenza virus
DYSRWNVT

SEQ ID NO: 279245 - protein, 8 aa, Influenza virus
WNVTSSGT

SEQ ID NO: 279246 - protein, 8 aa, Influenza virus
NVTSSGTS

SEQ ID NO: 279247 - protein, 8 aa, Influenza virus
VTSSGTSK

SEQ ID NO: 279248 - protein, 8 aa, Influenza virus
TSSGTSKA

SEQ ID NO: 279249 - protein, 8 aa, Influenza virus
SSGTSKAC

SEQ ID NO: 279250 - protein, 8 aa, Influenza virus
SGTSKACN

SEQ ID NO: 279251 - protein, 8 aa, Influenza virus
GTSKACNA

SEQ ID NO: 279252 - protein, 8 aa, Influenza virus
TSKACNAS

SEQ ID NO: 279253 - protein, 8 aa, Influenza virus
SKACNAST

SEQ ID NO: 279254 - protein, 8 aa, Influenza virus
KACNASTG

SEQ ID NO: 279255 - protein, 8 aa, Influenza virus
ACNASTGG

SEQ ID NO: 279256 - protein, 8 aa, Influenza virus
CNASTGGQ

SEQ ID NO: 279257 - protein, 8 aa, Influenza virus
NASTGGQS

SEQ ID NO: 279258 - protein, 8 aa, Influenza virus
ASTGGQSF

SEQ ID NO: 279259 - protein, 8 aa, Influenza virus
STGGQSFY

SEQ ID NO: 279260 - protein, 8 aa, Influenza virus
TGGQSFYR

SEQ ID NO: 279261 - protein, 8 aa, Influenza virus
GGQSFYRS

SEQ ID NO: 279262 - protein, 8 aa, Influenza virus
GQSFYRSI

SEQ ID NO: 279263 - protein, 8 aa, Influenza virus
QSFYRSIN

SEQ ID NO: 279264 - protein, 8 aa, Influenza virus
SFYRSINW

SEQ ID NO: 279265 - protein, 8 aa, Influenza virus
FYRSINWL

SEQ ID NO: 279266 - protein, 8 aa, Influenza virus
YRSINWLT

SEQ ID NO: 279267 - protein, 8 aa, Influenza virus
RSINWLTK

SEQ ID NO: 279268 - protein, 8 aa, Influenza virus
SINWLTKK

SEQ ID NO: 279269 - protein, 8 aa, Influenza virus
INWLTKKK

SEQ ID NO: 279270 - protein, 8 aa, Influenza virus
NWLTKKKP

SEQ ID NO: 279271 - protein, 8 aa, Influenza virus
WLTKKKPD

SEQ ID NO: 279272 - protein, 8 aa, Influenza virus
LTKKKPDT

SEQ ID NO: 279273 - protein, 8 aa, Influenza virus
TKKKPDTY

SEQ ID NO: 279274 - protein, 8 aa, Influenza virus
KKKPDTYD

SEQ ID NO: 279275 - protein, 8 aa, Influenza virus
KKPDTYDF

SEQ ID NO: 279276 - protein, 8 aa, Influenza virus
KPDTYDFN

SEQ ID NO: 279277 - protein, 8 aa, Influenza virus
NPEAYNFN

SEQ ID NO: 279278 - protein, 8 aa, Influenza virus
PDTYDFNE

SEQ ID NO: 279279 - protein, 8 aa, Influenza virus
DTYDFNEG

SEQ ID NO: 279280 - protein, 8 aa, Influenza virus
TYDFNEGS

SEQ ID NO: 279281 - protein, 8 aa, Influenza virus
YDFNEGSY

SEQ ID NO: 279282 - protein, 8 aa, Influenza virus
FNEGSYVN

SEQ ID NO: 279283 - protein, 8 aa, Influenza virus
NEGSYVNN

SEQ ID NO: 279284 - protein, 8 aa, Influenza virus
NNEDGDII

SEQ ID NO: 279285 - protein, 8 aa, Influenza virus
NEDGDIIF

SEQ ID NO: 279286 - protein, 8 aa, Influenza virus
EDGDIIFL

SEQ ID NO: 279287 - protein, 8 aa, Influenza virus
DGDIIFLW

SEQ ID NO: 279288 - protein, 8 aa, Influenza virus
GDIIFLWG

SEQ ID NO: 279289 - protein, 8 aa, Influenza virus
DIIFLWGI

SEQ ID NO: 279290 - protein, 8 aa, Influenza virus
IIFLWGIH

SEQ ID NO: 279291 - protein, 8 aa, Influenza virus
IFLWGIHH

SEQ ID NO: 279292 - protein, 8 aa, Influenza virus
FLWGIHHP

SEQ ID NO: 279293 - protein, 8 aa, Influenza virus
LWGIHHPP

SEQ ID NO: 279294 - protein, 8 aa, Influenza virus
WGIHHPPD

SEQ ID NO: 279295 - protein, 8 aa, Influenza virus
GIHHPPDT

SEQ ID NO: 279296 - protein, 8 aa, Influenza virus
IHHPPDTK

SEQ ID NO: 279297 - protein, 8 aa, Influenza virus
HHPPDTKE

SEQ ID NO: 279298 - protein, 8 aa, Influenza virus
HPPDTKEQ

SEQ ID NO: 279299 - protein, 8 aa, Influenza virus
PPDTKEQT

SEQ ID NO: 279300 - protein, 8 aa, Influenza virus
TKEQTTLY

SEQ ID NO: 279301 - protein, 8 aa, Influenza virus
KEQTTLYK

SEQ ID NO: 279302 - protein, 8 aa, Influenza virus
EQTTLYKN

SEQ ID NO: 279303 - protein, 8 aa, Influenza virus
QTTLYKNA

SEQ ID NO: 279304 - protein, 8 aa, Influenza virus
TTLYKNAN

SEQ ID NO: 279305 - protein, 8 aa, Influenza virus
TLYKNANT

SEQ ID NO: 279306 - protein, 8 aa, Influenza virus
LYKNANTL

SEQ ID NO: 279307 - protein, 8 aa, Influenza virus
YKNANTLS

SEQ ID NO: 279308 - protein, 8 aa, Influenza virus
KNANTLSS

SEQ ID NO: 279309 - protein, 8 aa, Influenza virus
NANTLSSV

SEQ ID NO: 279310 - protein, 8 aa, Influenza virus
ANTLSSVT

SEQ ID NO: 279311 - protein, 8 aa, Influenza virus
NTLSSVTT

SEQ ID NO: 279312 - protein, 8 aa, Influenza virus
TLSSVTTN

SEQ ID NO: 279313 - protein, 8 aa, Influenza virus
LSSVTTNT

SEQ ID NO: 279314 - protein, 8 aa, Influenza virus
SSVTTNTI

SEQ ID NO: 279315 - protein, 8 aa, Influenza virus
SVTTNTIN

SEQ ID NO: 279316 - protein, 8 aa, Influenza virus
VTTNTINR

SEQ ID NO: 279317 - protein, 8 aa, Influenza virus
TTNTINRS

SEQ ID NO: 279318 - protein, 8 aa, Influenza virus
TNTINRSF

SEQ ID NO: 279319 - protein, 8 aa, Influenza virus
NTINRSFQ

SEQ ID NO: 279320 - protein, 8 aa, Influenza virus
TINRSFQP

SEQ ID NO: 279321 - protein, 8 aa, Influenza virus
INRSFQPN

SEQ ID NO: 279322 - protein, 8 aa, Influenza virus
NRSFQPNI

SEQ ID NO: 279323 - protein, 8 aa, Influenza virus
RSFQPNIG

SEQ ID NO: 279324 - protein, 8 aa, Influenza virus
SFQPNIGP

SEQ ID NO: 279325 - protein, 8 aa, Influenza virus
FQPNIGPR

SEQ ID NO: 279326 - protein, 8 aa, Influenza virus
QPNIGPRP

SEQ ID NO: 279327 - protein, 8 aa, Influenza virus
PNIGPRPL

SEQ ID NO: 279328 - protein, 8 aa, Influenza virus
NIGPRPLV

SEQ ID NO: 279329 - protein, 8 aa, Influenza virus
IGPRPLVR

SEQ ID NO: 279330 - protein, 8 aa, Influenza virus
GPRPLVRG

SEQ ID NO: 279331 - protein, 8 aa, Influenza virus
PRPLVRGQ

SEQ ID NO: 279332 - protein, 8 aa, Influenza virus
RPLVRGQQ

SEQ ID NO: 279333 - protein, 8 aa, Influenza virus
PLVRGQQG

SEQ ID NO: 279334 - protein, 8 aa, Influenza virus
LVRGQQGR

SEQ ID NO: 279335 - protein, 8 aa, Influenza virus
VRGQQGRM

SEQ ID NO: 279336 - protein, 8 aa, Influenza virus
RGQQGRMD

SEQ ID NO: 279337 - protein, 8 aa, Influenza virus
GQQGRMDY

SEQ ID NO: 279338 - protein, 8 aa, Influenza virus
QQGRMDYY

SEQ ID NO: 279339 - protein, 8 aa, Influenza virus
QGRMDYYW

SEQ ID NO: 279340 - protein, 8 aa, Influenza virus
GRMDYYWG

SEQ ID NO: 279341 - protein, 8 aa, Influenza virus
RMDYYWGI

SEQ ID NO: 279342 - protein, 8 aa, Influenza virus
MDYYWGIL

SEQ ID NO: 279343 - protein, 8 aa, Influenza virus
DYYWGILK

SEQ ID NO: 279344 - protein, 8 aa, Influenza virus
YYWGILKR

SEQ ID NO: 279345 - protein, 8 aa, Influenza virus
YWGILKRG

SEQ ID NO: 279346 - protein, 8 aa, Influenza virus
WGILKRGE

SEQ ID NO: 279347 - protein, 8 aa, Influenza virus
GILKRGET

SEQ ID NO: 279348 - protein, 8 aa, Influenza virus
ILKRGETL

SEQ ID NO: 279349 - protein, 8 aa, Influenza virus
LKRGETLK

SEQ ID NO: 279350 - protein, 8 aa, Influenza virus
KRGETLKI

SEQ ID NO: 279351 - protein, 8 aa, Influenza virus
RGETLKIR

SEQ ID NO: 279352 - protein, 8 aa, Influenza virus
GETLKIRT

SEQ ID NO: 279353 - protein, 8 aa, Influenza virus
ETLKIRTN

SEQ ID NO: 279354 - protein, 8 aa, Influenza virus
TLKIRTNG

SEQ ID NO: 279355 - protein, 8 aa, Influenza virus
LKIRTNGN

SEQ ID NO: 279356 - protein, 8 aa, Influenza virus
KIRTNGNL

SEQ ID NO: 279357 - protein, 8 aa, Influenza virus
IRTNGNLI

SEQ ID NO: 279358 - protein, 8 aa, Influenza virus
RTNGNLIA

SEQ ID NO: 279359 - protein, 8 aa, Influenza virus
TNGNLIAP

SEQ ID NO: 279360 - protein, 8 aa, Influenza virus
NGNLIAPE

SEQ ID NO: 279361 - protein, 8 aa, Influenza virus
GNLIAPEF

SEQ ID NO: 279362 - protein, 8 aa, Influenza virus
NLIAPEFG

SEQ ID NO: 279363 - protein, 8 aa, Influenza virus
LIAPEFGY

SEQ ID NO: 279364 - protein, 8 aa, Influenza virus
IAPEFGYL

SEQ ID NO: 279365 - protein, 8 aa, Influenza virus
APEFGYLL

SEQ ID NO: 279366 - protein, 8 aa, Influenza virus
PEFGYLLK

SEQ ID NO: 279367 - protein, 8 aa, Influenza virus
EFGYLLKG

SEQ ID NO: 279368 - protein, 8 aa, Influenza virus
FGYLLKGE

SEQ ID NO: 279369 - protein, 8 aa, Influenza virus
GYLLKGES

SEQ ID NO: 279370 - protein, 8 aa, Influenza virus
YLLKGESH

SEQ ID NO: 279371 - protein, 8 aa, Influenza virus
LLKGESHG

SEQ ID NO: 279372 - protein, 8 aa, Influenza virus
LKGESHGR

SEQ ID NO: 279373 - protein, 8 aa, Influenza virus
GESHGRII

SEQ ID NO: 279374 - protein, 8 aa, Influenza virus
ESHGRIIQ

SEQ ID NO: 279375 - protein, 8 aa, Influenza virus
SHGRIIQN

SEQ ID NO: 279376 - protein, 8 aa, Influenza virus
HGRIIQNE

SEQ ID NO: 279377 - protein, 8 aa, Influenza virus
GRIIQNED

SEQ ID NO: 279378 - protein, 8 aa, Influenza virus
RIIQNEDI

SEQ ID NO: 279379 - protein, 8 aa, Influenza virus
IIQNEDIP

SEQ ID NO: 279380 - protein, 8 aa, Influenza virus
IQNEDIPI

SEQ ID NO: 279381 - protein, 8 aa, Influenza virus
QNEDIPIG

SEQ ID NO: 279382 - protein, 8 aa, Influenza virus
NEDIPIGN

SEQ ID NO: 279383 - protein, 8 aa, Influenza virus
EDIPIGNC

SEQ ID NO: 279384 - protein, 8 aa, Influenza virus
NCHTKCQT

SEQ ID NO: 279385 - protein, 8 aa, Influenza virus
CHTKCQTY

SEQ ID NO: 279386 - protein, 8 aa, Influenza virus
HTKCQTYA

SEQ ID NO: 279387 - protein, 8 aa, Influenza virus
TKCQTYAG

SEQ ID NO: 279388 - protein, 8 aa, Influenza virus
KCQTYAGA

SEQ ID NO: 279389 - protein, 8 aa, Influenza virus
CQTYAGAI

SEQ ID NO: 279390 - protein, 8 aa, Influenza virus
QTYAGAIN

SEQ ID NO: 279391 - protein, 8 aa, Influenza virus
TYAGAINS

SEQ ID NO: 279392 - protein, 8 aa, Influenza virus
YAGAINSS

SEQ ID NO: 279393 - protein, 8 aa, Influenza virus
AGAINSSK

SEQ ID NO: 279394 - protein, 8 aa, Influenza virus
GAINSSKP

SEQ ID NO: 279395 - protein, 8 aa, Influenza virus
AINSSKPF

SEQ ID NO: 279396 - protein, 8 aa, Influenza virus
INSSKPFQ

SEQ ID NO: 279397 - protein, 8 aa, Influenza virus
NSSKPFQN

SEQ ID NO: 279398 - protein, 8 aa, Influenza virus
SSKPFQNA

SEQ ID NO: 279399 - protein, 8 aa, Influenza virus
SKPFQNAS

SEQ ID NO: 279400 - protein, 8 aa, Influenza virus
KPFQNASR

SEQ ID NO: 279401 - protein, 8 aa, Influenza virus
PFQNASRH

SEQ ID NO: 279402 - protein, 8 aa, Influenza virus
FQNASRHY

SEQ ID NO: 279403 - protein, 8 aa, Influenza virus
QNASRHYM

SEQ ID NO: 279404 - protein, 8 aa, Influenza virus
NASRHYMG

SEQ ID NO: 279405 - protein, 8 aa, Influenza virus
ASRHYMGE

SEQ ID NO: 279406 - protein, 8 aa, Influenza virus
SRHYMGEC

SEQ ID NO: 279407 - protein, 8 aa, Influenza virus
RHYMGECP

SEQ ID NO: 279408 - protein, 8 aa, Influenza virus
HYMGECPK

SEQ ID NO: 279409 - protein, 8 aa, Influenza virus
YMGECPKY

SEQ ID NO: 279410 - protein, 8 aa, Influenza virus
MGECPKYV

SEQ ID NO: 279411 - protein, 8 aa, Influenza virus
GECPKYVK

SEQ ID NO: 279412 - protein, 8 aa, Influenza virus
ECPKYVKK

SEQ ID NO: 279413 - protein, 8 aa, Influenza virus
YVKKASLR

SEQ ID NO: 279414 - protein, 8 aa, Influenza virus
VKKASLRL

SEQ ID NO: 279415 - protein, 8 aa, Influenza virus
KKASLRLA

SEQ ID NO: 279416 - protein, 8 aa, Influenza virus
KASLRLAV

SEQ ID NO: 279417 - protein, 8 aa, Influenza virus
ASLRLAVG

SEQ ID NO: 279418 - protein, 8 aa, Influenza virus
SLRLAVGL

SEQ ID NO: 279419 - protein, 8 aa, Influenza virus
LRLAVGLR

SEQ ID NO: 279420 - protein, 8 aa, Influenza virus
RLAVGLRN

SEQ ID NO: 279421 - protein, 8 aa, Influenza virus
LAVGLRNT

SEQ ID NO: 279422 - protein, 8 aa, Influenza virus
AVGLRNTP

SEQ ID NO: 279423 - protein, 8 aa, Influenza virus
VGLRNTPS

SEQ ID NO: 279424 - protein, 8 aa, Influenza virus
GLRNTPSI

SEQ ID NO: 279425 - protein, 8 aa, Influenza virus
LRNTPSIE

SEQ ID NO: 279426 - protein, 8 aa, Influenza virus
RNTPSIEP

SEQ ID NO: 279427 - protein, 8 aa, Influenza virus
NTPSIEPK

SEQ ID NO: 279428 - protein, 8 aa, Influenza virus
TPSIEPKG

SEQ ID NO: 279429 - protein, 8 aa, Influenza virus
PSIEPKGL

SEQ ID NO: 279430 - protein, 8 aa, Influenza virus
SIEPKGLF

SEQ ID NO: 279431 - protein, 8 aa, Influenza virus
IEPKGLFG

SEQ ID NO: 279432 - protein, 8 aa, Influenza virus
EPKGLFGA

SEQ ID NO: 279433 - protein, 8 aa, Influenza virus
PKGLFGAI

SEQ ID NO: 279434 - protein, 8 aa, Influenza virus
KGLFGAIA

SEQ ID NO: 279435 - protein, 8 aa, Influenza virus
GLFGAIAG

SEQ ID NO: 279436 - protein, 8 aa, Influenza virus
LFGAIAGF

SEQ ID NO: 279437 - protein, 8 aa, Influenza virus
FGAIAGFI

SEQ ID NO: 279438 - protein, 8 aa, Influenza virus
GAIAGFIE

SEQ ID NO: 279439 - protein, 8 aa, Influenza virus
AIAGFIEG

SEQ ID NO: 279440 - protein, 8 aa, Influenza virus
IAGFIEGG

SEQ ID NO: 279441 - protein, 8 aa, Influenza virus
AGFIEGGW

SEQ ID NO: 279442 - protein, 8 aa, Influenza virus
GFIEGGWS

SEQ ID NO: 279443 - protein, 8 aa, Influenza virus
FIEGGWSG

SEQ ID NO: 279444 - protein, 8 aa, Influenza virus
IEGGWSGM

SEQ ID NO: 279445 - protein, 8 aa, Influenza virus
EGGWSGMI

SEQ ID NO: 279446 - protein, 8 aa, Influenza virus
GGWSGMID

SEQ ID NO: 279447 - protein, 8 aa, Influenza virus
GWSGMIDG

SEQ ID NO: 279448 - protein, 8 aa, Influenza virus
WSGMIDGW

SEQ ID NO: 279449 - protein, 8 aa, Influenza virus
SGMIDGWY

SEQ ID NO: 279450 - protein, 8 aa, Influenza virus
GMIDGWYG

SEQ ID NO: 279451 - protein, 8 aa, Influenza virus
MIDGWYGF

SEQ ID NO: 279452 - protein, 8 aa, Influenza virus
IDGWYGFH

SEQ ID NO: 279453 - protein, 8 aa, Influenza virus
DGWYGFHH

SEQ ID NO: 279454 - protein, 8 aa, Influenza virus
GWYGFHHS

SEQ ID NO: 279455 - protein, 8 aa, Influenza virus
WYGFHHSN

SEQ ID NO: 279456 - protein, 8 aa, Influenza virus
YGFHHSNS

SEQ ID NO: 279457 - protein, 8 aa, Influenza virus
GFHHSNSE

SEQ ID NO: 279458 - protein, 8 aa, Influenza virus
FHHSNSEG

SEQ ID NO: 279459 - protein, 8 aa, Influenza virus
HHSNSEGT

SEQ ID NO: 279460 - protein, 8 aa, Influenza virus
HSNSEGTG

SEQ ID NO: 279461 - protein, 8 aa, Influenza virus
SNSEGTGM

SEQ ID NO: 279462 - protein, 8 aa, Influenza virus
NSEGTGMA

SEQ ID NO: 279463 - protein, 8 aa, Influenza virus
SEGTGMAA

SEQ ID NO: 279464 - protein, 8 aa, Influenza virus
EGTGMAAD

SEQ ID NO: 279465 - protein, 8 aa, Influenza virus
GTGMAADQ

SEQ ID NO: 279466 - protein, 8 aa, Influenza virus
TGMAADQK

SEQ ID NO: 279467 - protein, 8 aa, Influenza virus
GMAADQKS

SEQ ID NO: 279468 - protein, 8 aa, Influenza virus
MAADQKST

SEQ ID NO: 279469 - protein, 8 aa, Influenza virus
AADQKSTQ

SEQ ID NO: 279470 - protein, 8 aa, Influenza virus
ADQKSTQE

SEQ ID NO: 279471 - protein, 8 aa, Influenza virus
DQKSTQEA

SEQ ID NO: 279472 - protein, 8 aa, Influenza virus
QKSTQEAI

SEQ ID NO: 279473 - protein, 8 aa, Influenza virus
KSTQEAID

SEQ ID NO: 279474 - protein, 8 aa, Influenza virus
STQEAIDK

SEQ ID NO: 279475 - protein, 8 aa, Influenza virus
TQEAIDKI

SEQ ID NO: 279476 - protein, 8 aa, Influenza virus
QEAIDKIT

SEQ ID NO: 279477 - protein, 8 aa, Influenza virus
EAIDKITN

SEQ ID NO: 279478 - protein, 8 aa, Influenza virus
AIDKITNK

SEQ ID NO: 279479 - protein, 8 aa, Influenza virus
IDKITNKV

SEQ ID NO: 279480 - protein, 8 aa, Influenza virus
DKITNKVN

SEQ ID NO: 279481 - protein, 8 aa, Influenza virus
KITNKVNN

SEQ ID NO: 279482 - protein, 8 aa, Influenza virus
ITNKVNNI

SEQ ID NO: 279483 - protein, 8 aa, Influenza virus
TNKVNNIV

SEQ ID NO: 279484 - protein, 8 aa, Influenza virus
NKVNNIVD

SEQ ID NO: 279485 - protein, 8 aa, Influenza virus
KVNNIVDK

SEQ ID NO: 279486 - protein, 8 aa, Influenza virus
VNNIVDKM

SEQ ID NO: 279487 - protein, 8 aa, Influenza virus
NNIVDKMN

SEQ ID NO: 279488 - protein, 8 aa, Influenza virus
NIVDKMNR

SEQ ID NO: 279489 - protein, 8 aa, Influenza virus
IVDKMNRE

SEQ ID NO: 279490 - protein, 8 aa, Influenza virus
VDKMNREF

SEQ ID NO: 279491 - protein, 8 aa, Influenza virus
DKMNREFE

SEQ ID NO: 279492 - protein, 8 aa, Influenza virus
KMNREFEV

SEQ ID NO: 279493 - protein, 8 aa, Influenza virus
MNREFEVV

SEQ ID NO: 279494 - protein, 8 aa, Influenza virus
NREFEVVN

SEQ ID NO: 279495 - protein, 8 aa, Influenza virus
REFEVVNH

SEQ ID NO: 279496 - protein, 8 aa, Influenza virus
EFEVVNHE

SEQ ID NO: 279497 - protein, 8 aa, Influenza virus
FEVVNHEF

SEQ ID NO: 279498 - protein, 8 aa, Influenza virus
EVVNHEFS

SEQ ID NO: 279499 - protein, 8 aa, Influenza virus
VVNHEFSE

SEQ ID NO: 279500 - protein, 8 aa, Influenza virus
HEFSEVEK

SEQ ID NO: 279501 - protein, 8 aa, Influenza virus
EKRINMIN

SEQ ID NO: 279502 - protein, 8 aa, Influenza virus
KRINMIND

SEQ ID NO: 279503 - protein, 8 aa, Influenza virus
RINMINDK

SEQ ID NO: 279504 - protein, 8 aa, Influenza virus
INMINDKI

SEQ ID NO: 279505 - protein, 8 aa, Influenza virus
NMINDKID

SEQ ID NO: 279506 - protein, 8 aa, Influenza virus
MINDKIDD

SEQ ID NO: 279507 - protein, 8 aa, Influenza virus
INDKIDDQ

SEQ ID NO: 279508 - protein, 8 aa, Influenza virus
NDKIDDQI

SEQ ID NO: 279509 - protein, 8 aa, Influenza virus
DKIDDQIE

SEQ ID NO: 279510 - protein, 8 aa, Influenza virus
KIDDQIED

SEQ ID NO: 279511 - protein, 8 aa, Influenza virus
IDDQIEDL

SEQ ID NO: 279512 - protein, 8 aa, Influenza virus
DDQIEDLW

SEQ ID NO: 279513 - protein, 8 aa, Influenza virus
DQIEDLWA

SEQ ID NO: 279514 - protein, 8 aa, Influenza virus
QIEDLWAY

SEQ ID NO: 279515 - protein, 8 aa, Influenza virus
IEDLWAYN

SEQ ID NO: 279516 - protein, 8 aa, Influenza virus
EDLWAYNA

SEQ ID NO: 279517 - protein, 8 aa, Influenza virus
DLWAYNAE

SEQ ID NO: 279518 - protein, 8 aa, Influenza virus
LWAYNAEL

SEQ ID NO: 279519 - protein, 8 aa, Influenza virus
WAYNAELL

SEQ ID NO: 279520 - protein, 8 aa, Influenza virus
AYNAELLV

SEQ ID NO: 279521 - protein, 8 aa, Influenza virus
YNAELLVL

SEQ ID NO: 279522 - protein, 8 aa, Influenza virus
NAELLVLL

SEQ ID NO: 279523 - protein, 8 aa, Influenza virus
AELLVLLE

SEQ ID NO: 279524 - protein, 8 aa, Influenza virus
ELLVLLEN

SEQ ID NO: 279525 - protein, 8 aa, Influenza virus
LLVLLENQ

SEQ ID NO: 279526 - protein, 8 aa, Influenza virus
LVLLENQK

SEQ ID NO: 279527 - protein, 8 aa, Influenza virus
VLLENQKT

SEQ ID NO: 279528 - protein, 8 aa, Influenza virus
LLENQKTL

SEQ ID NO: 279529 - protein, 8 aa, Influenza virus
LENQKTLD

SEQ ID NO: 279530 - protein, 8 aa, Influenza virus
ENQKTLDE

SEQ ID NO: 279531 - protein, 8 aa, Influenza virus
NQKTLDEH

SEQ ID NO: 279532 - protein, 8 aa, Influenza virus
QKTLDEHD

SEQ ID NO: 279533 - protein, 8 aa, Influenza virus
KTLDEHDS

SEQ ID NO: 279534 - protein, 8 aa, Influenza virus
TLDEHDSN

SEQ ID NO: 279535 - protein, 8 aa, Influenza virus
LDEHDSNV

SEQ ID NO: 279536 - protein, 8 aa, Influenza virus
DEHDSNVK

SEQ ID NO: 279537 - protein, 8 aa, Influenza virus
EHDSNVKN

SEQ ID NO: 279538 - protein, 8 aa, Influenza virus
HDSNVKNL

SEQ ID NO: 279539 - protein, 8 aa, Influenza virus
DSNVKNLF

SEQ ID NO: 279540 - protein, 8 aa, Influenza virus
SNVKNLFD

SEQ ID NO: 279541 - protein, 8 aa, Influenza virus
NVKNLFDE

SEQ ID NO: 279542 - protein, 8 aa, Influenza virus
VKNLFDEV

SEQ ID NO: 279543 - protein, 8 aa, Influenza virus
KNLFDEVK

SEQ ID NO: 279544 - protein, 8 aa, Influenza virus
NLFDEVKR

SEQ ID NO: 279545 - protein, 8 aa, Influenza virus
LFDEVKRR

SEQ ID NO: 279546 - protein, 8 aa, Influenza virus
FDEVKRRL

SEQ ID NO: 279547 - protein, 8 aa, Influenza virus
DEVKRRLS

SEQ ID NO: 279548 - protein, 8 aa, Influenza virus
EVKRRLSA

SEQ ID NO: 279549 - protein, 8 aa, Influenza virus
VKRRLSAN

SEQ ID NO: 279550 - protein, 8 aa, Influenza virus
KRRLSANA

SEQ ID NO: 279551 - protein, 8 aa, Influenza virus
RRLSANAI

SEQ ID NO: 279552 - protein, 8 aa, Influenza virus
RLSANAID

SEQ ID NO: 279553 - protein, 8 aa, Influenza virus
NAIDAGNG

SEQ ID NO: 279554 - protein, 8 aa, Influenza virus
AIDAGNGC

SEQ ID NO: 279555 - protein, 8 aa, Influenza virus
IDAGNGCF

SEQ ID NO: 279556 - protein, 8 aa, Influenza virus
DAGNGCFD

SEQ ID NO: 279557 - protein, 8 aa, Influenza virus
AGNGCFDI

SEQ ID NO: 279558 - protein, 8 aa, Influenza virus
GNGCFDIL

SEQ ID NO: 279559 - protein, 8 aa, Influenza virus
NGCFDILH

SEQ ID NO: 279560 - protein, 8 aa, Influenza virus
GCFDILHK

SEQ ID NO: 279561 - protein, 8 aa, Influenza virus
CFDILHKC

SEQ ID NO: 279562 - protein, 8 aa, Influenza virus
FDILHKCN

SEQ ID NO: 279563 - protein, 8 aa, Influenza virus
DILHKCNN

SEQ ID NO: 279564 - protein, 8 aa, Influenza virus
ILHKCNNE

SEQ ID NO: 279565 - protein, 8 aa, Influenza virus
LHKCNNEC

SEQ ID NO: 279566 - protein, 8 aa, Influenza virus
HKCNNECM

SEQ ID NO: 279567 - protein, 8 aa, Influenza virus
KCNNECME

SEQ ID NO: 279568 - protein, 8 aa, Influenza virus
CNNECMET

SEQ ID NO: 279569 - protein, 8 aa, Influenza virus
NNECMETI

SEQ ID NO: 279570 - protein, 8 aa, Influenza virus
NECMETIK

SEQ ID NO: 279571 - protein, 8 aa, Influenza virus
ECMETIKN

SEQ ID NO: 279572 - protein, 8 aa, Influenza virus
CMETIKNG

SEQ ID NO: 279573 - protein, 8 aa, Influenza virus
METIKNGT

SEQ ID NO: 279574 - protein, 8 aa, Influenza virus
ETIKNGTY

SEQ ID NO: 279575 - protein, 8 aa, Influenza virus
TIKNGTYN

SEQ ID NO: 279576 - protein, 8 aa, Influenza virus
IKNGTYNH

SEQ ID NO: 279577 - protein, 8 aa, Influenza virus
KNGTYNHK

SEQ ID NO: 279578 - protein, 8 aa, Influenza virus
NGTYDHKE

SEQ ID NO: 279579 - protein, 8 aa, Influenza virus
GTYDHKEY

SEQ ID NO: 279580 - protein, 8 aa, Influenza virus
TYNHKEYE

SEQ ID NO: 279581 - protein, 8 aa, Influenza virus
YDHKEYEE

SEQ ID NO: 279582 - protein, 8 aa, Influenza virus
DHKEYEEE

SEQ ID NO: 279583 - protein, 8 aa, Influenza virus
HKEYEEEA

SEQ ID NO: 279584 - protein, 8 aa, Influenza virus
KEYEEEAK

SEQ ID NO: 279585 - protein, 8 aa, Influenza virus
EYEEEAKL

SEQ ID NO: 279586 - protein, 8 aa, Influenza virus
YEEEAKLE

SEQ ID NO: 279587 - protein, 8 aa, Influenza virus
EEEAKLER

SEQ ID NO: 279588 - protein, 8 aa, Influenza virus
EEAKLERS

SEQ ID NO: 279589 - protein, 8 aa, Influenza virus
EAKLERSK

SEQ ID NO: 279590 - protein, 8 aa, Influenza virus
AKLERSKI

SEQ ID NO: 279591 - protein, 8 aa, Influenza virus
KLERSKIN

SEQ ID NO: 279592 - protein, 8 aa, Influenza virus
LERSKING

SEQ ID NO: 279593 - protein, 8 aa, Influenza virus
ERSKINGV

SEQ ID NO: 279594 - protein, 8 aa, Influenza virus
RSKINGVK

SEQ ID NO: 279595 - protein, 8 aa, Influenza virus
SKINGVKL

SEQ ID NO: 279596 - protein, 8 aa, Influenza virus
KINGVKLE

SEQ ID NO: 279597 - protein, 8 aa, Influenza virus
INGVKLEE

SEQ ID NO: 279598 - protein, 8 aa, Influenza virus
NGVKLEEN

SEQ ID NO: 279599 - protein, 8 aa, Influenza virus
GVKLEENT

SEQ ID NO: 279600 - protein, 8 aa, Influenza virus
VKLEENTT

SEQ ID NO: 279601 - protein, 8 aa, Influenza virus
KLEENTTY

SEQ ID NO: 279602 - protein, 8 aa, Influenza virus
LEENTTYK

SEQ ID NO: 279603 - protein, 8 aa, Influenza virus
EENTTYKI

SEQ ID NO: 279604 - protein, 8 aa, Influenza virus
ENTTYKIL

SEQ ID NO: 279605 - protein, 8 aa, Influenza virus
NTTYKILS

SEQ ID NO: 279606 - protein, 8 aa, Influenza virus
TTYKILSI

SEQ ID NO: 279607 - protein, 8 aa, Influenza virus
TYKILSIY

SEQ ID NO: 279608 - protein, 8 aa, Influenza virus
YKILSIYS

SEQ ID NO: 279609 - protein, 8 aa, Influenza virus
KILSIYST

SEQ ID NO: 279610 - protein, 8 aa, Influenza virus
ILSIYSTV

SEQ ID NO: 279611 - protein, 8 aa, Influenza virus
LSIYSTVA

SEQ ID NO: 279612 - protein, 8 aa, Influenza virus
SIYSTVAA

SEQ ID NO: 279613 - protein, 8 aa, Influenza virus
IYSTVAAS

SEQ ID NO: 279614 - protein, 8 aa, Influenza virus
YSTVAASL

SEQ ID NO: 279615 - protein, 8 aa, Influenza virus
STVAASLC

SEQ ID NO: 279616 - protein, 8 aa, Influenza virus
TVAASLCL

SEQ ID NO: 279617 - protein, 8 aa, Influenza virus
VAASLCLA

SEQ ID NO: 279618 - protein, 8 aa, Influenza virus
AASLCLAI

SEQ ID NO: 279619 - protein, 8 aa, Influenza virus
ASLCLAIL

SEQ ID NO: 279620 - protein, 8 aa, Influenza virus
SLCLAILI

SEQ ID NO: 279621 - protein, 8 aa, Influenza virus
LCLAILIA

SEQ ID NO: 279622 - protein, 8 aa, Influenza virus
CLAILIAG

SEQ ID NO: 279623 - protein, 8 aa, Influenza virus
LAILIAGG

SEQ ID NO: 279624 - protein, 8 aa, Influenza virus
AILIAGGL

SEQ ID NO: 279625 - protein, 8 aa, Influenza virus
ILIAGGLI

SEQ ID NO: 279626 - protein, 8 aa, Influenza virus
LIAGGLIL

SEQ ID NO: 279627 - protein, 8 aa, Influenza virus
IAGGLILG

SEQ ID NO: 279628 - protein, 8 aa, Influenza virus
AGGLILGM

SEQ ID NO: 279629 - protein, 8 aa, Influenza virus
GGLILGMQ

SEQ ID NO: 279630 - protein, 8 aa, Influenza virus
GLILGMQN

SEQ ID NO: 279631 - protein, 8 aa, Influenza virus
LILGMQNG

SEQ ID NO: 279632 - protein, 8 aa, Influenza virus
ILGMQNGS

SEQ ID NO: 279633 - protein, 8 aa, Influenza virus
LGMQNGSC

SEQ ID NO: 279634 - protein, 8 aa, Influenza virus
GMQNGSCR

SEQ ID NO: 279635 - protein, 8 aa, Influenza virus
MQNGSCRC

SEQ ID NO: 279636 - protein, 8 aa, Influenza virus
QNGSCRCM

SEQ ID NO: 279637 - protein, 8 aa, Influenza virus
NGSCRCMF

SEQ ID NO: 279638 - protein, 8 aa, Influenza virus
GSCRCMFC

SEQ ID NO: 279639 - protein, 8 aa, Influenza virus
SCRCMFCI

SEQ ID NO: 279640 - protein, 8 aa, Influenza virus
RWKHVTNT

SEQ ID NO: 279641 - protein, 8 aa, Influenza virus
WKHVTNTI

SEQ ID NO: 279642 - protein, 8 aa, Influenza virus
GYQSTNST

SEQ ID NO: 279643 - protein, 8 aa, Influenza virus
YQSTNSTE

SEQ ID NO: 279644 - protein, 8 aa, Influenza virus
QSTNSTET

SEQ ID NO: 279645 - protein, 8 aa, Influenza virus
STNSTETV

SEQ ID NO: 279646 - protein, 8 aa, Influenza virus
TNSTETVD

SEQ ID NO: 279647 - protein, 8 aa, Influenza virus
NSTETVDT

SEQ ID NO: 279648 - protein, 8 aa, Influenza virus
EHNGMLCA

SEQ ID NO: 279649 - protein, 8 aa, Influenza virus
HNGMLCAT

SEQ ID NO: 279650 - protein, 8 aa, Influenza virus
IEGLIYGN

SEQ ID NO: 279651 - protein, 8 aa, Influenza virus
EGLIYGNP

SEQ ID NO: 279652 - protein, 8 aa, Influenza virus
GLIYGNPS

SEQ ID NO: 279653 - protein, 8 aa, Influenza virus
LIYGNPSC

SEQ ID NO: 279654 - protein, 8 aa, Influenza virus
IYGNPSCD

SEQ ID NO: 279655 - protein, 8 aa, Influenza virus
EWSYIVER

SEQ ID NO: 279656 - protein, 8 aa, Influenza virus
WSYIVERP

SEQ ID NO: 279657 - protein, 8 aa, Influenza virus
SYIVERPS

SEQ ID NO: 279658 - protein, 8 aa, Influenza virus
YIVERPSA

SEQ ID NO: 279659 - protein, 8 aa, Influenza virus
SFYRSMRW

SEQ ID NO: 279660 - protein, 8 aa, Influenza virus
FYRSMRWL

SEQ ID NO: 279661 - protein, 8 aa, Influenza virus
YRSMRWLT

SEQ ID NO: 279662 - protein, 8 aa, Influenza virus
GRIDYYWS

SEQ ID NO: 279663 - protein, 8 aa, Influenza virus
SVLKPGQT

SEQ ID NO: 279664 - protein, 8 aa, Influenza virus
VLKPGQTL

SEQ ID NO: 279665 - protein, 8 aa, Influenza virus
LKPGQTLR

SEQ ID NO: 279666 - protein, 8 aa, Influenza virus
KPGQTLRI

SEQ ID NO: 279667 - protein, 8 aa, Influenza virus
PGQTLRIR

SEQ ID NO: 279668 - protein, 8 aa, Influenza virus
GQTLRIRS

SEQ ID NO: 279669 - protein, 8 aa, Influenza virus
QTLRIRSN

SEQ ID NO: 279670 - protein, 8 aa, Influenza virus
TLRIRSNG

SEQ ID NO: 279671 - protein, 8 aa, Influenza virus
LRIRSNGN

SEQ ID NO: 279672 - protein, 8 aa, Influenza virus
RIRSNGNL

SEQ ID NO: 279673 - protein, 8 aa, Influenza virus
IRSNGNLI

SEQ ID NO: 279674 - protein, 8 aa, Influenza virus
RSNGNLIA

SEQ ID NO: 279675 - protein, 8 aa, Influenza virus
SNGNLIAP

SEQ ID NO: 279676 - protein, 8 aa, Influenza virus
NGNLIAPW

SEQ ID NO: 279677 - protein, 8 aa, Influenza virus
GNLIAPWY

SEQ ID NO: 279678 - protein, 8 aa, Influenza virus
NLIAPWYG

SEQ ID NO: 279679 - protein, 8 aa, Influenza virus
LIAPWYGH

SEQ ID NO: 279680 - protein, 8 aa, Influenza virus
GGLNTTLP

SEQ ID NO: 279681 - protein, 8 aa, Influenza virus
GLNTTLPF

SEQ ID NO: 279682 - protein, 8 aa, Influenza virus
LNTTLPFQ

SEQ ID NO: 279683 - protein, 8 aa, Influenza virus
NTTLPFQN

SEQ ID NO: 279684 - protein, 8 aa, Influenza virus
TLPFQNVS

SEQ ID NO: 279685 - protein, 8 aa, Influenza virus
LPFQNVSK

SEQ ID NO: 279686 - protein, 8 aa, Influenza virus
PFQNVSKY

SEQ ID NO: 279687 - protein, 8 aa, Influenza virus
FQNVSKYA

SEQ ID NO: 279688 - protein, 8 aa, Influenza virus
QNVSKYAF

SEQ ID NO: 279689 - protein, 8 aa, Influenza virus
NVSKYAFG

SEQ ID NO: 279690 - protein, 8 aa, Influenza virus
VSKYAFGN

SEQ ID NO: 279691 - protein, 8 aa, Influenza virus
SKYAFGNC

SEQ ID NO: 279692 - protein, 8 aa, Influenza virus
KYAFGNCS

SEQ ID NO: 279693 - protein, 8 aa, Influenza virus
YAFGNCSK

SEQ ID NO: 279694 - protein, 8 aa, Influenza virus
AFGNCSKY

SEQ ID NO: 279695 - protein, 8 aa, Influenza virus
KSLKLAVG

SEQ ID NO: 279696 - protein, 8 aa, Influenza virus
SLKLAVGL

SEQ ID NO: 279697 - protein, 8 aa, Influenza virus
LKLAVGLR

SEQ ID NO: 279698 - protein, 8 aa, Influenza virus
KLAVGLRN

SEQ ID NO: 279699 - protein, 8 aa, Influenza virus
RGLFGAIA

SEQ ID NO: 279700 - protein, 8 aa, Influenza virus
GLFGAIAG

SEQ ID NO: 279701 - protein, 8 aa, Influenza virus
LFGAIAGF

SEQ ID NO: 279702 - protein, 8 aa, Influenza virus
FGAIAGFI

SEQ ID NO: 279703 - protein, 8 aa, Influenza virus
GAIAGFIE

SEQ ID NO: 279704 - protein, 8 aa, Influenza virus
AIAGFIEG

SEQ ID NO: 279705 - protein, 8 aa, Influenza virus
IAGFIEGG

SEQ ID NO: 279706 - protein, 8 aa, Influenza virus
AGFIEGGW

SEQ ID NO: 279707 - protein, 8 aa, Influenza virus
GFIEGGWS

SEQ ID NO: 279708 - protein, 8 aa, Influenza virus
FIEGGWSG

SEQ ID NO: 279709 - protein, 8 aa, Influenza virus
IEGGWSGL

SEQ ID NO: 279710 - protein, 8 aa, Influenza virus
EGGWSGLV

SEQ ID NO: 279711 - protein, 8 aa, Influenza virus
GGWSGLVA

SEQ ID NO: 279712 - protein, 8 aa, Influenza virus
GWSGLVAG

SEQ ID NO: 279713 - protein, 8 aa, Influenza virus
WSGLVAGW

SEQ ID NO: 279714 - protein, 8 aa, Influenza virus
SGLVAGWY

SEQ ID NO: 279715 - protein, 8 aa, Influenza virus
GLVAGWYG

SEQ ID NO: 279716 - protein, 8 aa, Influenza virus
LVAGWYGF

SEQ ID NO: 279717 - protein, 8 aa, Influenza virus
VAGWYGFQ

SEQ ID NO: 279718 - protein, 8 aa, Influenza virus
AGWYGFQH

SEQ ID NO: 279719 - protein, 8 aa, Influenza virus
GWYGFQHS

SEQ ID NO: 279720 - protein, 8 aa, Influenza virus
WYGFQHSN

SEQ ID NO: 279721 - protein, 8 aa, Influenza virus
YGFQHSND

SEQ ID NO: 279722 - protein, 8 aa, Influenza virus
GFQHSNDQ

SEQ ID NO: 279723 - protein, 8 aa, Influenza virus
FQHSNDQG

SEQ ID NO: 279724 - protein, 8 aa, Influenza virus
QGVGMAAD

SEQ ID NO: 279725 - protein, 8 aa, Influenza virus
NKIDDQIQ

SEQ ID NO: 279726 - protein, 8 aa, Influenza virus
KIDDQIQD

SEQ ID NO: 279727 - protein, 8 aa, Influenza virus
DDQIQDIW

SEQ ID NO: 279728 - protein, 8 aa, Influenza virus
DQIQDIWA

SEQ ID NO: 279729 - protein, 8 aa, Influenza virus
QIQDIWAY

SEQ ID NO: 279730 - protein, 8 aa, Influenza virus
IQDIWAYN

SEQ ID NO: 279731 - protein, 8 aa, Influenza virus
QDIWAYNA

SEQ ID NO: 279732 - protein, 8 aa, Influenza virus
DIWAYNAE

SEQ ID NO: 279733 - protein, 8 aa, Influenza virus
IWAYNAEL

SEQ ID NO: 279734 - protein, 8 aa, Influenza virus
WAYNAELL

SEQ ID NO: 279735 - protein, 8 aa, Influenza virus
AYNAELLV

SEQ ID NO: 279736 - protein, 8 aa, Influenza virus
YNAELLVL

SEQ ID NO: 279737 - protein, 8 aa, Influenza virus
NAELLVLL

SEQ ID NO: 279738 - protein, 8 aa, Influenza virus
AELLVLLE

SEQ ID NO: 279739 - protein, 8 aa, Influenza virus
ELLVLLEN

SEQ ID NO: 279740 - protein, 8 aa, Influenza virus
LLVLLENQ

SEQ ID NO: 279741 - protein, 8 aa, Influenza virus
LVLLENQK

SEQ ID NO: 279742 - protein, 8 aa, Influenza virus
VLLENQKT

SEQ ID NO: 279743 - protein, 8 aa, Influenza virus
LLENQKTL

SEQ ID NO: 279744 - protein, 8 aa, Influenza virus
LENQKTLD

SEQ ID NO: 279745 - protein, 8 aa, Influenza virus
ENQKTLDE

SEQ ID NO: 279746 - protein, 8 aa, Influenza virus
NQKTLDEH

SEQ ID NO: 279747 - protein, 8 aa, Influenza virus
QKTLDEHD

SEQ ID NO: 279748 - protein, 8 aa, Influenza virus
KTLDEHDA

SEQ ID NO: 279749 - protein, 8 aa, Influenza virus
TLDEHDAN

SEQ ID NO: 279750 - protein, 8 aa, Influenza virus
LDEHDANV

SEQ ID NO: 279751 - protein, 8 aa, Influenza virus
DEHDANVN

SEQ ID NO: 279752 - protein, 8 aa, Influenza virus
NNLYNKVK

SEQ ID NO: 279753 - protein, 8 aa, Influenza virus
EDGKGCFE

SEQ ID NO: 279754 - protein, 8 aa, Influenza virus
DGKGCFEL

SEQ ID NO: 279755 - protein, 8 aa, Influenza virus
GKGCFELY

SEQ ID NO: 279756 - protein, 8 aa, Influenza virus
KGCFELYH

SEQ ID NO: 279757 - protein, 8 aa, Influenza virus
GCFELYHK

SEQ ID NO: 279758 - protein, 8 aa, Influenza virus
CFELYHKC

SEQ ID NO: 279759 - protein, 8 aa, Influenza virus
FELYHKCD

SEQ ID NO: 279760 - protein, 8 aa, Influenza virus
ELYHKCDD

SEQ ID NO: 279761 - protein, 8 aa, Influenza virus
CMETIRNG

SEQ ID NO: 279762 - protein, 8 aa, Influenza virus
METIRNGT

SEQ ID NO: 279763 - protein, 8 aa, Influenza virus
ETIRNGTY

SEQ ID NO: 279764 - protein, 8 aa, Influenza virus
TIRNGTYN

SEQ ID NO: 279765 - protein, 8 aa, Influenza virus
EGTYKILT

SEQ ID NO: 279766 - protein, 8 aa, Influenza virus
GTYKILTI

SEQ ID NO: 279767 - protein, 8 aa, Influenza virus
TYKILTIY

SEQ ID NO: 279768 - protein, 8 aa, Influenza virus
YKILTIYS

SEQ ID NO: 279769 - protein, 8 aa, Influenza virus
KILTIYST

SEQ ID NO: 279770 - protein, 8 aa, Influenza virus
ILTIYSTV

SEQ ID NO: 279771 - protein, 8 aa, Influenza virus
LTIYSTVA

SEQ ID NO: 279772 - protein, 8 aa, Influenza virus
TIYSTVAS

SEQ ID NO: 279773 - protein, 8 aa, Influenza virus
IYSTVASS

SEQ ID NO: 279774 - protein, 8 aa, Influenza virus
YSTVASSL

SEQ ID NO: 279775 - protein, 8 aa, Influenza virus
STVASSLV

SEQ ID NO: 279776 - protein, 8 aa, Influenza virus
AAFLFWAM

SEQ ID NO: 279777 - protein, 8 aa, Influenza virus
AFLFWAMS

SEQ ID NO: 279778 - protein, 8 aa, Influenza virus
RWKHVTNT

SEQ ID NO: 279779 - protein, 8 aa, Influenza virus
WKHVTNTI

SEQ ID NO: 279780 - protein, 8 aa, Influenza virus
GYQSTNST

SEQ ID NO: 279781 - protein, 8 aa, Influenza virus
YQSTNSTE

SEQ ID NO: 279782 - protein, 8 aa, Influenza virus
QSTNSTET

SEQ ID NO: 279783 - protein, 8 aa, Influenza virus
STNSTETV

SEQ ID NO: 279784 - protein, 8 aa, Influenza virus
TNSTETVD

SEQ ID NO: 279785 - protein, 8 aa, Influenza virus
NSTETVDT

SEQ ID NO: 279786 - protein, 8 aa, Influenza virus
ELLHTEHN

SEQ ID NO: 279787 - protein, 8 aa, Influenza virus
EHNGMLCA

SEQ ID NO: 279788 - protein, 8 aa, Influenza virus
HNGMLCAT

SEQ ID NO: 279789 - protein, 8 aa, Influenza virus
IEGLIYGN

SEQ ID NO: 279790 - protein, 8 aa, Influenza virus
EGLIYGNP

SEQ ID NO: 279791 - protein, 8 aa, Influenza virus
GLIYGNPS

SEQ ID NO: 279792 - protein, 8 aa, Influenza virus
LIYGNPSC

SEQ ID NO: 279793 - protein, 8 aa, Influenza virus
IYGNPSCD

SEQ ID NO: 279794 - protein, 8 aa, Influenza virus
EWSYIVER

SEQ ID NO: 279795 - protein, 8 aa, Influenza virus
WSYIVERP

SEQ ID NO: 279796 - protein, 8 aa, Influenza virus
SYIVERPS

SEQ ID NO: 279797 - protein, 8 aa, Influenza virus
YIVERPSA

SEQ ID NO: 279798 - protein, 8 aa, Influenza virus
SFYRSMRW

SEQ ID NO: 279799 - protein, 8 aa, Influenza virus
FYRSMRWL

SEQ ID NO: 279800 - protein, 8 aa, Influenza virus
YRSMRWLT

SEQ ID NO: 279801 - protein, 8 aa, Influenza virus
GRIDYYWS

SEQ ID NO: 279802 - protein, 8 aa, Influenza virus
YYWSVLKP

SEQ ID NO: 279803 - protein, 8 aa, Influenza virus
SVLKPGQT

SEQ ID NO: 279804 - protein, 8 aa, Influenza virus
VLKPGQTL

SEQ ID NO: 279805 - protein, 8 aa, Influenza virus
LKPGQTLR

SEQ ID NO: 279806 - protein, 8 aa, Influenza virus
KPGQTLRI

SEQ ID NO: 279807 - protein, 8 aa, Influenza virus
PGQTLRIR

SEQ ID NO: 279808 - protein, 8 aa, Influenza virus
GQTLRIRS

SEQ ID NO: 279809 - protein, 8 aa, Influenza virus
QTLRIRSN

SEQ ID NO: 279810 - protein, 8 aa, Influenza virus
TLRIRSNG

SEQ ID NO: 279811 - protein, 8 aa, Influenza virus
LRIRSNGN

SEQ ID NO: 279812 - protein, 8 aa, Influenza virus
RIRSNGNL

SEQ ID NO: 279813 - protein, 8 aa, Influenza virus
IRSNGNLI

SEQ ID NO: 279814 - protein, 8 aa, Influenza virus
RSNGNLIA

SEQ ID NO: 279815 - protein, 8 aa, Influenza virus
SNGNLIAP

SEQ ID NO: 279816 - protein, 8 aa, Influenza virus
NGNLIAPW

SEQ ID NO: 279817 - protein, 8 aa, Influenza virus
GNLIAPWY

SEQ ID NO: 279818 - protein, 8 aa, Influenza virus
NLIAPWYG

SEQ ID NO: 279819 - protein, 8 aa, Influenza virus
LIAPWYGH

SEQ ID NO: 279820 - protein, 8 aa, Influenza virus
GGLNTTLP

SEQ ID NO: 279821 - protein, 8 aa, Influenza virus
GLNTTLPF

SEQ ID NO: 279822 - protein, 8 aa, Influenza virus
LNTTLPFQ

SEQ ID NO: 279823 - protein, 8 aa, Influenza virus
NTTLPFQN

SEQ ID NO: 279824 - protein, 8 aa, Influenza virus
TLPFQNVS

SEQ ID NO: 279825 - protein, 8 aa, Influenza virus
LPFQNVSK

SEQ ID NO: 279826 - protein, 8 aa, Influenza virus
PFQNVSKY

SEQ ID NO: 279827 - protein, 8 aa, Influenza virus
FQNVSKYA

SEQ ID NO: 279828 - protein, 8 aa, Influenza virus
QNVSKYAF

SEQ ID NO: 279829 - protein, 8 aa, Influenza virus
NVSKYAFG

SEQ ID NO: 279830 - protein, 8 aa, Influenza virus
VSKYAFGN

SEQ ID NO: 279831 - protein, 8 aa, Influenza virus
SKYAFGNC

SEQ ID NO: 279832 - protein, 8 aa, Influenza virus
KYAFGNCS

SEQ ID NO: 279833 - protein, 8 aa, Influenza virus
YAFGNCSK

SEQ ID NO: 279834 - protein, 8 aa, Influenza virus
AFGNCSKY

SEQ ID NO: 279835 - protein, 8 aa, Influenza virus
KSLKLAVG

SEQ ID NO: 279836 - protein, 8 aa, Influenza virus
SLKLAVGL

SEQ ID NO: 279837 - protein, 8 aa, Influenza virus
LKLAVGLR

SEQ ID NO: 279838 - protein, 8 aa, Influenza virus
KLAVGLRN

SEQ ID NO: 279839 - protein, 8 aa, Influenza virus
LAVGLRNV

SEQ ID NO: 279840 - protein, 8 aa, Influenza virus
RGLFGAIA

SEQ ID NO: 279841 - protein, 8 aa, Influenza virus
GLFGAIAG

SEQ ID NO: 279842 - protein, 8 aa, Influenza virus
LFGAIAGF

SEQ ID NO: 279843 - protein, 8 aa, Influenza virus
FGAIAGFI

SEQ ID NO: 279844 - protein, 8 aa, Influenza virus
GAIAGFIE

SEQ ID NO: 279845 - protein, 8 aa, Influenza virus
AIAGFIEG

SEQ ID NO: 279846 - protein, 8 aa, Influenza virus
IAGFIEGG

SEQ ID NO: 279847 - protein, 8 aa, Influenza virus
AGFIEGGW

SEQ ID NO: 279848 - protein, 8 aa, Influenza virus
GFIEGGWS

SEQ ID NO: 279849 - protein, 8 aa, Influenza virus
FIEGGWSG

SEQ ID NO: 279850 - protein, 8 aa, Influenza virus
IEGGWSGL

SEQ ID NO: 279851 - protein, 8 aa, Influenza virus
EGGWSGLV

SEQ ID NO: 279852 - protein, 8 aa, Influenza virus
GGWSGLVA

SEQ ID NO: 279853 - protein, 8 aa, Influenza virus
GWSGLVAG

SEQ ID NO: 279854 - protein, 8 aa, Influenza virus
WSGLVAGW

SEQ ID NO: 279855 - protein, 8 aa, Influenza virus
SGLVAGWY

SEQ ID NO: 279856 - protein, 8 aa, Influenza virus
GLVAGWYG

SEQ ID NO: 279857 - protein, 8 aa, Influenza virus
LVAGWYGF

SEQ ID NO: 279858 - protein, 8 aa, Influenza virus
VAGWYGFQ

SEQ ID NO: 279859 - protein, 8 aa, Influenza virus
AGWYGFQH

SEQ ID NO: 279860 - protein, 8 aa, Influenza virus
GWYGFQHS

SEQ ID NO: 279861 - protein, 8 aa, Influenza virus
WYGFQHSN

SEQ ID NO: 279862 - protein, 8 aa, Influenza virus
YGFQHSND

SEQ ID NO: 279863 - protein, 8 aa, Influenza virus
GFQHSNDQ

SEQ ID NO: 279864 - protein, 8 aa, Influenza virus
FQHSNDQG

SEQ ID NO: 279865 - protein, 8 aa, Influenza virus
QGVGMAAD

SEQ ID NO: 279866 - protein, 8 aa, Influenza virus
KVNNIVDK

SEQ ID NO: 279867 - protein, 8 aa, Influenza virus
NKIDDQIQ

SEQ ID NO: 279868 - protein, 8 aa, Influenza virus
KIDDQIQD

SEQ ID NO: 279869 - protein, 8 aa, Influenza virus
DDQIQDIW

SEQ ID NO: 279870 - protein, 8 aa, Influenza virus
DQIQDIWA

SEQ ID NO: 279871 - protein, 8 aa, Influenza virus
QIQDIWAY

SEQ ID NO: 279872 - protein, 8 aa, Influenza virus
IQDIWAYN

SEQ ID NO: 279873 - protein, 8 aa, Influenza virus
QDIWAYNA

SEQ ID NO: 279874 - protein, 8 aa, Influenza virus
DIWAYNAE

SEQ ID NO: 279875 - protein, 8 aa, Influenza virus
IWAYNAEL

SEQ ID NO: 279876 - protein, 8 aa, Influenza virus
WAYNAELL

SEQ ID NO: 279877 - protein, 8 aa, Influenza virus
AYNAELLV

SEQ ID NO: 279878 - protein, 8 aa, Influenza virus
YNAELLVL

SEQ ID NO: 279879 - protein, 8 aa, Influenza virus
NAELLVLL

SEQ ID NO: 279880 - protein, 8 aa, Influenza virus
AELLVLLE

SEQ ID NO: 279881 - protein, 8 aa, Influenza virus
ELLVLLEN

SEQ ID NO: 279882 - protein, 8 aa, Influenza virus
LLVLLENQ

SEQ ID NO: 279883 - protein, 8 aa, Influenza virus
LVLLENQK

SEQ ID NO: 279884 - protein, 8 aa, Influenza virus
VLLENQKT

SEQ ID NO: 279885 - protein, 8 aa, Influenza virus
LLENQKTL

SEQ ID NO: 279886 - protein, 8 aa, Influenza virus
LENQKTLD

SEQ ID NO: 279887 - protein, 8 aa, Influenza virus
ENQKTLDE

SEQ ID NO: 279888 - protein, 8 aa, Influenza virus
NQKTLDEH

SEQ ID NO: 279889 - protein, 8 aa, Influenza virus
QKTLDEHD

SEQ ID NO: 279890 - protein, 8 aa, Influenza virus
KTLDEHDA

SEQ ID NO: 279891 - protein, 8 aa, Influenza virus
TLDEHDAN

SEQ ID NO: 279892 - protein, 8 aa, Influenza virus
LDEHDANV

SEQ ID NO: 279893 - protein, 8 aa, Influenza virus
DEHDANVN

SEQ ID NO: 279894 - protein, 8 aa, Influenza virus
DANVNNLY

SEQ ID NO: 279895 - protein, 8 aa, Influenza virus
ANVNNLYN

SEQ ID NO: 279896 - protein, 8 aa, Influenza virus
VNNLYNKV

SEQ ID NO: 279897 - protein, 8 aa, Influenza virus
NNLYNKVK

SEQ ID NO: 279898 - protein, 8 aa, Influenza virus
EDGKGCFE

SEQ ID NO: 279899 - protein, 8 aa, Influenza virus
DGKGCFEL

SEQ ID NO: 279900 - protein, 8 aa, Influenza virus
GKGCFELY

SEQ ID NO: 279901 - protein, 8 aa, Influenza virus
KGCFELYH

SEQ ID NO: 279902 - protein, 8 aa, Influenza virus
GCFELYHK

SEQ ID NO: 279903 - protein, 8 aa, Influenza virus
CFELYHKC

SEQ ID NO: 279904 - protein, 8 aa, Influenza virus
FELYHKCD

SEQ ID NO: 279905 - protein, 8 aa, Influenza virus
ELYHKCDD

SEQ ID NO: 279906 - protein, 8 aa, Influenza virus
CMETIRNG

SEQ ID NO: 279907 - protein, 8 aa, Influenza virus
METIRNGT

SEQ ID NO: 279908 - protein, 8 aa, Influenza virus
ETIRNGTY

SEQ ID NO: 279909 - protein, 8 aa, Influenza virus
TIRNGTYN

SEQ ID NO: 279910 - protein, 8 aa, Influenza virus
SEGTYKIL

SEQ ID NO: 279911 - protein, 8 aa, Influenza virus
EGTYKILT

SEQ ID NO: 279912 - protein, 8 aa, Influenza virus
GTYKILTI

SEQ ID NO: 279913 - protein, 8 aa, Influenza virus
TYKILTIY

SEQ ID NO: 279914 - protein, 8 aa, Influenza virus
YKILTIYS

SEQ ID NO: 279915 - protein, 8 aa, Influenza virus
KILTIYST

SEQ ID NO: 279916 - protein, 8 aa, Influenza virus
ILTIYSTV

SEQ ID NO: 279917 - protein, 8 aa, Influenza virus
LTIYSTVA

SEQ ID NO: 279918 - protein, 8 aa, Influenza virus
TIYSTVAS

SEQ ID NO: 279919 - protein, 8 aa, Influenza virus
IYSTVASS

SEQ ID NO: 279920 - protein, 8 aa, Influenza virus
YSTVASSL

SEQ ID NO: 279921 - protein, 8 aa, Influenza virus
STVASSLV

SEQ ID NO: 279922 - protein, 8 aa, Influenza virus
AAFLFWAM

SEQ ID NO: 279923 - protein, 8 aa, Influenza virus
AFLFWAMS

SEQ ID NO: 279924 - protein, 8 aa, Influenza virus
IAIGSVSR

SEQ ID NO: 279925 - protein, 8 aa, Influenza virus
VPLVPCEP

SEQ ID NO: 279926 - protein, 8 aa, Influenza virus
PLVPCEPI

SEQ ID NO: 279927 - protein, 8 aa, Influenza virus
LVPCEPII

SEQ ID NO: 279928 - protein, 8 aa, Influenza virus
WSKPQCQI

SEQ ID NO: 279929 - protein, 8 aa, Influenza virus
SKPQCQIT

SEQ ID NO: 279930 - protein, 8 aa, Influenza virus
KPQCQITG

SEQ ID NO: 279931 - protein, 8 aa, Influenza virus
PQCQITGF

SEQ ID NO: 279932 - protein, 8 aa, Influenza virus
QCQITGFA

SEQ ID NO: 279933 - protein, 8 aa, Influenza virus
CQITGFAP

SEQ ID NO: 279934 - protein, 8 aa, Influenza virus
GFAPFSKD

SEQ ID NO: 279935 - protein, 8 aa, Influenza virus
SIRLSAGG

SEQ ID NO: 279936 - protein, 8 aa, Influenza virus
RLSAGGDI

SEQ ID NO: 279937 - protein, 8 aa, Influenza virus
LSAGGDIW

SEQ ID NO: 279938 - protein, 8 aa, Influenza virus
VTREPYVS

SEQ ID NO: 279939 - protein, 8 aa, Influenza virus
TREPYVSC

SEQ ID NO: 279940 - protein, 8 aa, Influenza virus
REPYVSCG

SEQ ID NO: 279941 - protein, 8 aa, Influenza virus
KCYQFALG

SEQ ID NO: 279942 - protein, 8 aa, Influenza virus
CYQFALGQ

SEQ ID NO: 279943 - protein, 8 aa, Influenza virus
YQFALGQG

SEQ ID NO: 279944 - protein, 8 aa, Influenza virus
QFALGQGT

SEQ ID NO: 279945 - protein, 8 aa, Influenza virus
FALGQGTT

SEQ ID NO: 279946 - protein, 8 aa, Influenza virus
ALGQGTTL

SEQ ID NO: 279947 - protein, 8 aa, Influenza virus
PHRTLLMN

SEQ ID NO: 279948 - protein, 8 aa, Influenza virus
HRTLLMNE

SEQ ID NO: 279949 - protein, 8 aa, Influenza virus
RTLLMNEL

SEQ ID NO: 279950 - protein, 8 aa, Influenza virus
TLLMNELG

SEQ ID NO: 279951 - protein, 8 aa, Influenza virus
LLMNELGV

SEQ ID NO: 279952 - protein, 8 aa, Influenza virus
LMNELGVP

SEQ ID NO: 279953 - protein, 8 aa, Influenza virus
MNELGVPF

SEQ ID NO: 279954 - protein, 8 aa, Influenza virus
NELGVPFH

SEQ ID NO: 279955 - protein, 8 aa, Influenza virus
ELGVPFHL

SEQ ID NO: 279956 - protein, 8 aa, Influenza virus
TKQVCIAW

SEQ ID NO: 279957 - protein, 8 aa, Influenza virus
KQVCIAWS

SEQ ID NO: 279958 - protein, 8 aa, Influenza virus
QVCIAWSS

SEQ ID NO: 279959 - protein, 8 aa, Influenza virus
VCIAWSSS

SEQ ID NO: 279960 - protein, 8 aa, Influenza virus
CIAWSSSS

SEQ ID NO: 279961 - protein, 8 aa, Influenza virus
IAWSSSSC

SEQ ID NO: 279962 - protein, 8 aa, Influenza virus
AWSSSSCH

SEQ ID NO: 279963 - protein, 8 aa, Influenza virus
WSSSSCHD

SEQ ID NO: 279964 - protein, 8 aa, Influenza virus
SSSSCHDG

SEQ ID NO: 279965 - protein, 8 aa, Influenza virus
SSSCHDGK

SEQ ID NO: 279966 - protein, 8 aa, Influenza virus
SSCHDGKA

SEQ ID NO: 279967 - protein, 8 aa, Influenza virus
SCHDGKAW

SEQ ID NO: 279968 - protein, 8 aa, Influenza virus
CHDGKAWL

SEQ ID NO: 279969 - protein, 8 aa, Influenza virus
HDGKAWLH

SEQ ID NO: 279970 - protein, 8 aa, Influenza virus
WLHVCVTG

SEQ ID NO: 279971 - protein, 8 aa, Influenza virus
LHVCVTGD

SEQ ID NO: 279972 - protein, 8 aa, Influenza virus
HVCVTGDD

SEQ ID NO: 279973 - protein, 8 aa, Influenza virus
NILRTQES

SEQ ID NO: 279974 - protein, 8 aa, Influenza virus
ILRTQESE

SEQ ID NO: 279975 - protein, 8 aa, Influenza virus
LRTQESEC

SEQ ID NO: 279976 - protein, 8 aa, Influenza virus
RTQESECV

SEQ ID NO: 279977 - protein, 8 aa, Influenza virus
TQESECVC

SEQ ID NO: 279978 - protein, 8 aa, Influenza virus
QESECVCI

SEQ ID NO: 279979 - protein, 8 aa, Influenza virus
ESECVCIN

SEQ ID NO: 279980 - protein, 8 aa, Influenza virus
SECVCING

SEQ ID NO: 279981 - protein, 8 aa, Influenza virus
ECVCINGT

SEQ ID NO: 279982 - protein, 8 aa, Influenza virus
CVCINGTC

SEQ ID NO: 279983 - protein, 8 aa, Influenza virus
INGTCTVV

SEQ ID NO: 279984 - protein, 8 aa, Influenza virus
NGTCTVVM

SEQ ID NO: 279985 - protein, 8 aa, Influenza virus
GTCTVVMT

SEQ ID NO: 279986 - protein, 8 aa, Influenza virus
TCTVVMTD

SEQ ID NO: 279987 - protein, 8 aa, Influenza virus
CTVVMTDG

SEQ ID NO: 279988 - protein, 8 aa, Influenza virus
TVVMTDGS

SEQ ID NO: 279989 - protein, 8 aa, Influenza virus
VVMTDGSA

SEQ ID NO: 279990 - protein, 8 aa, Influenza virus
VMTDGSAS

SEQ ID NO: 279991 - protein, 8 aa, Influenza virus
GSAQHVEE

SEQ ID NO: 279992 - protein, 8 aa, Influenza virus
SAQHVEEC

SEQ ID NO: 279993 - protein, 8 aa, Influenza virus
AQHVEECS

SEQ ID NO: 279994 - protein, 8 aa, Influenza virus
QHVEECSC

SEQ ID NO: 279995 - protein, 8 aa, Influenza virus
HVEECSCY

SEQ ID NO: 279996 - protein, 8 aa, Influenza virus
VEECSCYP

SEQ ID NO: 279997 - protein, 8 aa, Influenza virus
EECSCYPR

SEQ ID NO: 279998 - protein, 8 aa, Influenza virus
ECSCYPRY

SEQ ID NO: 279999 - protein, 8 aa, Influenza virus
CVCRDNWK

SEQ ID NO: 280000 - protein, 8 aa, Influenza virus
VCRDNWKG

SEQ ID NO: 280001 - protein, 8 aa, Influenza virus
CRDNWKGS

SEQ ID NO: 280002 - protein, 8 aa, Influenza virus
RDNWKGSN

SEQ ID NO: 280003 - protein, 8 aa, Influenza virus
DNWKGSNR

SEQ ID NO: 280004 - protein, 8 aa, Influenza virus
NWKGSNRP

SEQ ID NO: 280005 - protein, 8 aa, Influenza virus
WKGSNRPV

SEQ ID NO: 280006 - protein, 8 aa, Influenza virus
YVCSGLVG

SEQ ID NO: 280007 - protein, 8 aa, Influenza virus
VCSGLVGD

SEQ ID NO: 280008 - protein, 8 aa, Influenza virus
CSGLVGDT

SEQ ID NO: 280009 - protein, 8 aa, Influenza virus
SGLVGDTP

SEQ ID NO: 280010 - protein, 8 aa, Influenza virus
GLVGDTPR

SEQ ID NO: 280011 - protein, 8 aa, Influenza virus
LVGDTPRN

SEQ ID NO: 280012 - protein, 8 aa, Influenza virus
PGVKGWAF

SEQ ID NO: 280013 - protein, 8 aa, Influenza virus
GVKGWAFD

SEQ ID NO: 280014 - protein, 8 aa, Influenza virus
DIWMGRTI

SEQ ID NO: 280015 - protein, 8 aa, Influenza virus
CINRCFYV

SEQ ID NO: 280016 - protein, 8 aa, Influenza virus
INRCFYVE

SEQ ID NO: 280017 - protein, 8 aa, Influenza virus
NRCFYVEL

SEQ ID NO: 280018 - protein, 8 aa, Influenza virus
RCFYVELI

SEQ ID NO: 280019 - protein, 8 aa, Influenza virus
CFYVELIR

SEQ ID NO: 280020 - protein, 8 aa, Influenza virus
FYVELIRG

SEQ ID NO: 280021 - protein, 8 aa, Influenza virus
YVELIRGR

SEQ ID NO: 280022 - protein, 8 aa, Influenza virus
VELIRGRP

SEQ ID NO: 280023 - protein, 8 aa, Influenza virus
RVWWTSNS

SEQ ID NO: 280024 - protein, 8 aa, Influenza virus
VWWTSNSI

SEQ ID NO: 280025 - protein, 8 aa, Influenza virus
FCGTSGTY

SEQ ID NO: 280026 - protein, 8 aa, Influenza virus
CGTSGTYG

SEQ ID NO: 280027 - protein, 8 aa, Influenza virus
TSGTYGTG

SEQ ID NO: 280028 - protein, 8 aa, Influenza virus
GTYGTGSW

SEQ ID NO: 280029 - protein, 8 aa, Influenza virus
TYGTGSWP

SEQ ID NO: 280030 - protein, 8 aa, Influenza virus
YGTGSWPD

SEQ ID NO: 280031 - protein, 8 aa, Influenza virus
GTGSWPDG

SEQ ID NO: 280032 - protein, 8 aa, Influenza virus
TGSWPDGA

SEQ ID NO: 280033 - protein, 8 aa, Influenza virus
GSWPDGAN

SEQ ID NO: 280034 - protein, 8 aa, Influenza virus
SWPDGANI

SEQ ID NO: 280035 - protein, 8 aa, Influenza virus
MLKMSLLT

SEQ ID NO: 280036 - protein, 8 aa, Influenza virus
LKMSLLTE

SEQ ID NO: 280037 - protein, 8 aa, Influenza virus
KMSLLTEV

SEQ ID NO: 280038 - protein, 8 aa, Influenza virus
MSLLTEVE

SEQ ID NO: 280039 - protein, 8 aa, Influenza virus
SLLTEVET

SEQ ID NO: 280040 - protein, 8 aa, Influenza virus
LLTEVETY

SEQ ID NO: 280041 - protein, 8 aa, Influenza virus
LTEVETYV

SEQ ID NO: 280042 - protein, 8 aa, Influenza virus
TEVETYVL

SEQ ID NO: 280043 - protein, 8 aa, Influenza virus
EVETYVLS

SEQ ID NO: 280044 - protein, 8 aa, Influenza virus
VETYVLSI

SEQ ID NO: 280045 - protein, 8 aa, Influenza virus
ETYVLSIV

SEQ ID NO: 280046 - protein, 8 aa, Influenza virus
TYVLSIVP

SEQ ID NO: 280047 - protein, 8 aa, Influenza virus
YVLSIVPS

SEQ ID NO: 280048 - protein, 8 aa, Influenza virus
VLSIVPSG

SEQ ID NO: 280049 - protein, 8 aa, Influenza virus
LSIVPSGP

SEQ ID NO: 280050 - protein, 8 aa, Influenza virus
SIVPSGPL

SEQ ID NO: 280051 - protein, 8 aa, Influenza virus
IVPSGPLK

SEQ ID NO: 280052 - protein, 8 aa, Influenza virus
VPSGPLKA

SEQ ID NO: 280053 - protein, 8 aa, Influenza virus
PSGPLKAE

SEQ ID NO: 280054 - protein, 8 aa, Influenza virus
SGPLKAEI

SEQ ID NO: 280055 - protein, 8 aa, Influenza virus
GPLKAEIA

SEQ ID NO: 280056 - protein, 8 aa, Influenza virus
PLKAEIAQ

SEQ ID NO: 280057 - protein, 8 aa, Influenza virus
LKAEIAQR

SEQ ID NO: 280058 - protein, 8 aa, Influenza virus
KAEIAQRL

SEQ ID NO: 280059 - protein, 8 aa, Influenza virus
AEIAQRLE

SEQ ID NO: 280060 - protein, 8 aa, Influenza virus
EIAQRLED

SEQ ID NO: 280061 - protein, 8 aa, Influenza virus
IAQRLEDV

SEQ ID NO: 280062 - protein, 8 aa, Influenza virus
AQRLEDVF

SEQ ID NO: 280063 - protein, 8 aa, Influenza virus
QRLEDVFA

SEQ ID NO: 280064 - protein, 8 aa, Influenza virus
RLEDVFAG

SEQ ID NO: 280065 - protein, 8 aa, Influenza virus
LEDVFAGK

SEQ ID NO: 280066 - protein, 8 aa, Influenza virus
EDVFAGKN

SEQ ID NO: 280067 - protein, 8 aa, Influenza virus
VFAGKNTD

SEQ ID NO: 280068 - protein, 8 aa, Influenza virus
FAGKNTDL

SEQ ID NO: 280069 - protein, 8 aa, Influenza virus
AGKNTDLE

SEQ ID NO: 280070 - protein, 8 aa, Influenza virus
GKNTDLEA

SEQ ID NO: 280071 - protein, 8 aa, Influenza virus
KNTDLEAL

SEQ ID NO: 280072 - protein, 8 aa, Influenza virus
NTDLEALM

SEQ ID NO: 280073 - protein, 8 aa, Influenza virus
TDLEALME

SEQ ID NO: 280074 - protein, 8 aa, Influenza virus
DLEALMEW

SEQ ID NO: 280075 - protein, 8 aa, Influenza virus
LEALMEWL

SEQ ID NO: 280076 - protein, 8 aa, Influenza virus
EALMEWLK

SEQ ID NO: 280077 - protein, 8 aa, Influenza virus
ALMEWLKT

SEQ ID NO: 280078 - protein, 8 aa, Influenza virus
LMEWLKTR

SEQ ID NO: 280079 - protein, 8 aa, Influenza virus
MEWLKTRP

SEQ ID NO: 280080 - protein, 8 aa, Influenza virus
EWLKTRPI

SEQ ID NO: 280081 - protein, 8 aa, Influenza virus
WLKTRPIL

SEQ ID NO: 280082 - protein, 8 aa, Influenza virus
LKTRPILS

SEQ ID NO: 280083 - protein, 8 aa, Influenza virus
KTRPILSP

SEQ ID NO: 280084 - protein, 8 aa, Influenza virus
TRPILSPL

SEQ ID NO: 280085 - protein, 8 aa, Influenza virus
RPILSPLT

SEQ ID NO: 280086 - protein, 8 aa, Influenza virus
PILSPLTK

SEQ ID NO: 280087 - protein, 8 aa, Influenza virus
ILSPLTKG

SEQ ID NO: 280088 - protein, 8 aa, Influenza virus
LSPLTKGI

SEQ ID NO: 280089 - protein, 8 aa, Influenza virus
SPLTKGIL

SEQ ID NO: 280090 - protein, 8 aa, Influenza virus
PLTKGILG

SEQ ID NO: 280091 - protein, 8 aa, Influenza virus
LTKGILGF

SEQ ID NO: 280092 - protein, 8 aa, Influenza virus
TKGILGFV

SEQ ID NO: 280093 - protein, 8 aa, Influenza virus
KGILGFVF

SEQ ID NO: 280094 - protein, 8 aa, Influenza virus
GILGFVFT

SEQ ID NO: 280095 - protein, 8 aa, Influenza virus
ILGFVFTL

SEQ ID NO: 280096 - protein, 8 aa, Influenza virus
LGFVFTLT

SEQ ID NO: 280097 - protein, 8 aa, Influenza virus
GFVFTLTV

SEQ ID NO: 280098 - protein, 8 aa, Influenza virus
FVFTLTVP

SEQ ID NO: 280099 - protein, 8 aa, Influenza virus
VFTLTVPS

SEQ ID NO: 280100 - protein, 8 aa, Influenza virus
FTLTVPSE

SEQ ID NO: 280101 - protein, 8 aa, Influenza virus
TLTVPSER

SEQ ID NO: 280102 - protein, 8 aa, Influenza virus
LTVPSERG

SEQ ID NO: 280103 - protein, 8 aa, Influenza virus
TVPSERGL

SEQ ID NO: 280104 - protein, 8 aa, Influenza virus
VPSERGLQ

SEQ ID NO: 280105 - protein, 8 aa, Influenza virus
PSERGLQR

SEQ ID NO: 280106 - protein, 8 aa, Influenza virus
SERGLQRR

SEQ ID NO: 280107 - protein, 8 aa, Influenza virus
ERGLQRRR

SEQ ID NO: 280108 - protein, 8 aa, Influenza virus
RGLQRRRF

SEQ ID NO: 280109 - protein, 8 aa, Influenza virus
GLQRRRFV

SEQ ID NO: 280110 - protein, 8 aa, Influenza virus
LQRRRFVQ

SEQ ID NO: 280111 - protein, 8 aa, Influenza virus
QRRRFVQN

SEQ ID NO: 280112 - protein, 8 aa, Influenza virus
RRRFVQNA

SEQ ID NO: 280113 - protein, 8 aa, Influenza virus
RRFVQNAL

SEQ ID NO: 280114 - protein, 8 aa, Influenza virus
RFVQNALN

SEQ ID NO: 280115 - protein, 8 aa, Influenza virus
FVQNALNG

SEQ ID NO: 280116 - protein, 8 aa, Influenza virus
VQNALNGN

SEQ ID NO: 280117 - protein, 8 aa, Influenza virus
QNALNGNG

SEQ ID NO: 280118 - protein, 8 aa, Influenza virus
NALNGNGD

SEQ ID NO: 280119 - protein, 8 aa, Influenza virus
ALNGNGDP

SEQ ID NO: 280120 - protein, 8 aa, Influenza virus
LNGNGDPN

SEQ ID NO: 280121 - protein, 8 aa, Influenza virus
NGNGDPNN

SEQ ID NO: 280122 - protein, 8 aa, Influenza virus
GNGDPNNM

SEQ ID NO: 280123 - protein, 8 aa, Influenza virus
NGDPNNMD

SEQ ID NO: 280124 - protein, 8 aa, Influenza virus
GDPNNMDR

SEQ ID NO: 280125 - protein, 8 aa, Influenza virus
DPNNMDRA

SEQ ID NO: 280126 - protein, 8 aa, Influenza virus
PNNMDRAV

SEQ ID NO: 280127 - protein, 8 aa, Influenza virus
NNMDRAVK

SEQ ID NO: 280128 - protein, 8 aa, Influenza virus
NMDRAVKL

SEQ ID NO: 280129 - protein, 8 aa, Influenza virus
MDRAVKLY

SEQ ID NO: 280130 - protein, 8 aa, Influenza virus
DRAVKLYR

SEQ ID NO: 280131 - protein, 8 aa, Influenza virus
RAVKLYRK

SEQ ID NO: 280132 - protein, 8 aa, Influenza virus
AVKLYRKL

SEQ ID NO: 280133 - protein, 8 aa, Influenza virus
VKLYRKLK

SEQ ID NO: 280134 - protein, 8 aa, Influenza virus
KLYRKLKR

SEQ ID NO: 280135 - protein, 8 aa, Influenza virus
LYRKLKRE

SEQ ID NO: 280136 - protein, 8 aa, Influenza virus
YRKLKREI

SEQ ID NO: 280137 - protein, 8 aa, Influenza virus
RKLKREIT

SEQ ID NO: 280138 - protein, 8 aa, Influenza virus
KLKREITF

SEQ ID NO: 280139 - protein, 8 aa, Influenza virus
LKREITFH

SEQ ID NO: 280140 - protein, 8 aa, Influenza virus
KREITFHG

SEQ ID NO: 280141 - protein, 8 aa, Influenza virus
REITFHGA

SEQ ID NO: 280142 - protein, 8 aa, Influenza virus
EITFHGAK

SEQ ID NO: 280143 - protein, 8 aa, Influenza virus
ITFHGAKE

SEQ ID NO: 280144 - protein, 8 aa, Influenza virus
TFHGAKEV

SEQ ID NO: 280145 - protein, 8 aa, Influenza virus
FHGAKEVA

SEQ ID NO: 280146 - protein, 8 aa, Influenza virus
HGAKEVAL

SEQ ID NO: 280147 - protein, 8 aa, Influenza virus
GAKEVALS

SEQ ID NO: 280148 - protein, 8 aa, Influenza virus
AKEVALSY

SEQ ID NO: 280149 - protein, 8 aa, Influenza virus
KEVALSYS

SEQ ID NO: 280150 - protein, 8 aa, Influenza virus
EVALSYST

SEQ ID NO: 280151 - protein, 8 aa, Influenza virus
VALSYSTG

SEQ ID NO: 280152 - protein, 8 aa, Influenza virus
ALSYSTGA

SEQ ID NO: 280153 - protein, 8 aa, Influenza virus
LSYSTGAL

SEQ ID NO: 280154 - protein, 8 aa, Influenza virus
SYSTGALA

SEQ ID NO: 280155 - protein, 8 aa, Influenza virus
YSTGALAS

SEQ ID NO: 280156 - protein, 8 aa, Influenza virus
STGALASC

SEQ ID NO: 280157 - protein, 8 aa, Influenza virus
TGALASCM

SEQ ID NO: 280158 - protein, 8 aa, Influenza virus
GALASCMG

SEQ ID NO: 280159 - protein, 8 aa, Influenza virus
ALASCMGL

SEQ ID NO: 280160 - protein, 8 aa, Influenza virus
LASCMGLI

SEQ ID NO: 280161 - protein, 8 aa, Influenza virus
ASCMGLIY

SEQ ID NO: 280162 - protein, 8 aa, Influenza virus
SCMGLIYN

SEQ ID NO: 280163 - protein, 8 aa, Influenza virus
CMGLIYNR

SEQ ID NO: 280164 - protein, 8 aa, Influenza virus
MGLIYNRM

SEQ ID NO: 280165 - protein, 8 aa, Influenza virus
GLIYNRMG

SEQ ID NO: 280166 - protein, 8 aa, Influenza virus
LIYNRMGT

SEQ ID NO: 280167 - protein, 8 aa, Influenza virus
IYNRMGTV

SEQ ID NO: 280168 - protein, 8 aa, Influenza virus
YNRMGTVT

SEQ ID NO: 280169 - protein, 8 aa, Influenza virus
AFGLVCAT

SEQ ID NO: 280170 - protein, 8 aa, Influenza virus
FGLVCATC

SEQ ID NO: 280171 - protein, 8 aa, Influenza virus
GLVCATCE

SEQ ID NO: 280172 - protein, 8 aa, Influenza virus
LVCATCEQ

SEQ ID NO: 280173 - protein, 8 aa, Influenza virus
VCATCEQI

SEQ ID NO: 280174 - protein, 8 aa, Influenza virus
CATCEQIA

SEQ ID NO: 280175 - protein, 8 aa, Influenza virus
ATCEQIAD

SEQ ID NO: 280176 - protein, 8 aa, Influenza virus
TCEQIADS

SEQ ID NO: 280177 - protein, 8 aa, Influenza virus
CEQIADSQ

SEQ ID NO: 280178 - protein, 8 aa, Influenza virus
EQIADSQH

SEQ ID NO: 280179 - protein, 8 aa, Influenza virus
QIADSQHR

SEQ ID NO: 280180 - protein, 8 aa, Influenza virus
IADSQHRS

SEQ ID NO: 280181 - protein, 8 aa, Influenza virus
ADSQHRSH

SEQ ID NO: 280182 - protein, 8 aa, Influenza virus
DSQHRSHR

SEQ ID NO: 280183 - protein, 8 aa, Influenza virus
SQHRSHRQ

SEQ ID NO: 280184 - protein, 8 aa, Influenza virus
QHRSHRQM

SEQ ID NO: 280185 - protein, 8 aa, Influenza virus
HRSHRQMV

SEQ ID NO: 280186 - protein, 8 aa, Influenza virus
TTTNPLIR

SEQ ID NO: 280187 - protein, 8 aa, Influenza virus
TTNPLIRH

SEQ ID NO: 280188 - protein, 8 aa, Influenza virus
TNPLIRHE

SEQ ID NO: 280189 - protein, 8 aa, Influenza virus
NPLIRHEN

SEQ ID NO: 280190 - protein, 8 aa, Influenza virus
PLIRHENR

SEQ ID NO: 280191 - protein, 8 aa, Influenza virus
LIRHENRM

SEQ ID NO: 280192 - protein, 8 aa, Influenza virus
IRHENRMV

SEQ ID NO: 280193 - protein, 8 aa, Influenza virus
RHENRMVL

SEQ ID NO: 280194 - protein, 8 aa, Influenza virus
HENRMVLA

SEQ ID NO: 280195 - protein, 8 aa, Influenza virus
ENRMVLAS

SEQ ID NO: 280196 - protein, 8 aa, Influenza virus
NRMVLAST

SEQ ID NO: 280197 - protein, 8 aa, Influenza virus
RMVLASTT

SEQ ID NO: 280198 - protein, 8 aa, Influenza virus
MVLASTTA

SEQ ID NO: 280199 - protein, 8 aa, Influenza virus
VLASTTAK

SEQ ID NO: 280200 - protein, 8 aa, Influenza virus
LASTTAKA

SEQ ID NO: 280201 - protein, 8 aa, Influenza virus
ASTTAKAM

SEQ ID NO: 280202 - protein, 8 aa, Influenza virus
STTAKAME

SEQ ID NO: 280203 - protein, 8 aa, Influenza virus
TTAKAMEQ

SEQ ID NO: 280204 - protein, 8 aa, Influenza virus
TAKAMEQM

SEQ ID NO: 280205 - protein, 8 aa, Influenza virus
AKAMEQMA

SEQ ID NO: 280206 - protein, 8 aa, Influenza virus
KAMEQMAG

SEQ ID NO: 280207 - protein, 8 aa, Influenza virus
AMEQMAGS

SEQ ID NO: 280208 - protein, 8 aa, Influenza virus
MEQMAGSS

SEQ ID NO: 280209 - protein, 8 aa, Influenza virus
EQMAGSSE

SEQ ID NO: 280210 - protein, 8 aa, Influenza virus
QMAGSSEQ

SEQ ID NO: 280211 - protein, 8 aa, Influenza virus
MAGSSEQA

SEQ ID NO: 280212 - protein, 8 aa, Influenza virus
AGSSEQAA

SEQ ID NO: 280213 - protein, 8 aa, Influenza virus
GSSEQAAE

SEQ ID NO: 280214 - protein, 8 aa, Influenza virus
SSEQAAEA

SEQ ID NO: 280215 - protein, 8 aa, Influenza virus
SEQAAEAM

SEQ ID NO: 280216 - protein, 8 aa, Influenza virus
EQAAEAME

SEQ ID NO: 280217 - protein, 8 aa, Influenza virus
QAAEAMEV

SEQ ID NO: 280218 - protein, 8 aa, Influenza virus
AAEAMEVA

SEQ ID NO: 280219 - protein, 8 aa, Influenza virus
ARQMVQAM

SEQ ID NO: 280220 - protein, 8 aa, Influenza virus
RQMVQAMR

SEQ ID NO: 280221 - protein, 8 aa, Influenza virus
QMVQAMRT

SEQ ID NO: 280222 - protein, 8 aa, Influenza virus
MVQAMRTI

SEQ ID NO: 280223 - protein, 8 aa, Influenza virus
VQAMRTIG

SEQ ID NO: 280224 - protein, 8 aa, Influenza virus
QAMRTIGT

SEQ ID NO: 280225 - protein, 8 aa, Influenza virus
AMRTIGTH

SEQ ID NO: 280226 - protein, 8 aa, Influenza virus
MRTIGTHP

SEQ ID NO: 280227 - protein, 8 aa, Influenza virus
DDLLENLQ

SEQ ID NO: 280228 - protein, 8 aa, Influenza virus
DLLENLQA

SEQ ID NO: 280229 - protein, 8 aa, Influenza virus
LLENLQAY

SEQ ID NO: 280230 - protein, 8 aa, Influenza virus
LENLQAYQ

SEQ ID NO: 280231 - protein, 8 aa, Influenza virus
ENLQAYQK

SEQ ID NO: 280232 - protein, 8 aa, Influenza virus
NLQAYQKR

SEQ ID NO: 280233 - protein, 8 aa, Influenza virus
LQAYQKRM

SEQ ID NO: 280234 - protein, 8 aa, Influenza virus
QAYQKRMG

SEQ ID NO: 280235 - protein, 8 aa, Influenza virus
AYQKRMGV

SEQ ID NO: 280236 - protein, 8 aa, Influenza virus
YQKRMGVQ

SEQ ID NO: 280237 - protein, 8 aa, Influenza virus
QKRMGVQM

SEQ ID NO: 280238 - protein, 8 aa, Influenza virus
KRMGVQMQ

SEQ ID NO: 280239 - protein, 8 aa, Influenza virus
RMGVQMQR

SEQ ID NO: 280240 - protein, 8 aa, Influenza virus
MGVQMQRF

SEQ ID NO: 280241 - protein, 8 aa, Influenza virus
GVQMQRFK

SEQ ID NO: 280242 - protein, 8 aa, Influenza virus
VQMQRFRR

SEQ ID NO: 280243 - protein, 8 aa, Influenza virus
QMQRFRRP

SEQ ID NO: 280244 - protein, 8 aa, Influenza virus
MQRFRRPD

SEQ ID NO: 280245 - protein, 8 aa, Influenza virus
QRFRRPDS

SEQ ID NO: 280246 - protein, 8 aa, Influenza virus
RFRRPDSS

SEQ ID NO: 280247 - protein, 8 aa, Influenza virus
FRRPDSSW

SEQ ID NO: 280248 - protein, 8 aa, Influenza virus
RRPDSSWL

SEQ ID NO: 280249 - protein, 8 aa, Influenza virus
RPDSSWLF

SEQ ID NO: 280250 - protein, 8 aa, Influenza virus
SSRHCSKY

SEQ ID NO: 280251 - protein, 8 aa, Influenza virus
DSSWLFGG

SEQ ID NO: 280252 - protein, 8 aa, Influenza virus
RHCSKYHW

SEQ ID NO: 280253 - protein, 8 aa, Influenza virus
HCSKYHWN

SEQ ID NO: 280254 - protein, 8 aa, Influenza virus
CSKYHWNL

SEQ ID NO: 280255 - protein, 8 aa, Influenza virus
SKYHWNLA

SEQ ID NO: 280256 - protein, 8 aa, Influenza virus
KYHWNLAL

SEQ ID NO: 280257 - protein, 8 aa, Influenza virus
YHWNLALD

SEQ ID NO: 280258 - protein, 8 aa, Influenza virus
HWNLALDI

SEQ ID NO: 280259 - protein, 8 aa, Influenza virus
WNLALDIV

SEQ ID NO: 280260 - protein, 8 aa, Influenza virus
NLALDIVD

SEQ ID NO: 280261 - protein, 8 aa, Influenza virus
LALDIVDS

SEQ ID NO: 280262 - protein, 8 aa, Influenza virus
MSLLTEVE

SEQ ID NO: 280263 - protein, 8 aa, Influenza virus
SLLTEVET

SEQ ID NO: 280264 - protein, 8 aa, Influenza virus
LLTEVETP

SEQ ID NO: 280265 - protein, 8 aa, Influenza virus
LTEVETPT

SEQ ID NO: 280266 - protein, 8 aa, Influenza virus
RPTRNGWG

SEQ ID NO: 280267 - protein, 8 aa, Influenza virus
GILHLILW

SEQ ID NO: 280268 - protein, 8 aa, Influenza virus
ILHLILWI

SEQ ID NO: 280269 - protein, 8 aa, Influenza virus
GVPESMRE

SEQ ID NO: 280270 - protein, 8 aa, Influenza virus
VPESMREE

SEQ ID NO: 280271 - protein, 8 aa, Influenza virus
PESMREEY

SEQ ID NO: 280272 - protein, 8 aa, Influenza virus
ESMREEYR

SEQ ID NO: 280273 - protein, 8 aa, Influenza virus
SMREEYRQ

SEQ ID NO: 280274 - protein, 8 aa, Influenza virus
MREEYRQE

SEQ ID NO: 280275 - protein, 8 aa, Influenza virus
REEYRQEQ

SEQ ID NO: 280276 - protein, 8 aa, Influenza virus
FVSIELEG

SEQ ID NO: 280277 - protein, 8 aa, Influenza virus
SKSRVDNH

SEQ ID NO: 280278 - protein, 8 aa, Influenza virus
KSRVDNHS

SEQ ID NO: 280279 - protein, 8 aa, Influenza virus
SRVDNHSM

SEQ ID NO: 280280 - protein, 8 aa, Influenza virus
RVDNHSMS

SEQ ID NO: 280281 - protein, 8 aa, Influenza virus
VDNHSMSD

SEQ ID NO: 280282 - protein, 8 aa, Influenza virus
DNHSMSDI

SEQ ID NO: 280283 - protein, 8 aa, Influenza virus
NHSMSDIE

SEQ ID NO: 280284 - protein, 8 aa, Influenza virus
HSMSDIEA

SEQ ID NO: 280285 - protein, 8 aa, Influenza virus
SMSDIEAM

SEQ ID NO: 280286 - protein, 8 aa, Influenza virus
MSDIEAMA

SEQ ID NO: 280287 - protein, 8 aa, Influenza virus
SDIEAMAS

SEQ ID NO: 280288 - protein, 8 aa, Influenza virus
DIEAMASQ

SEQ ID NO: 280289 - protein, 8 aa, Influenza virus
IEAMASQG

SEQ ID NO: 280290 - protein, 8 aa, Influenza virus
EAMASQGT

SEQ ID NO: 280291 - protein, 8 aa, Influenza virus
AMASQGTK

SEQ ID NO: 280292 - protein, 8 aa, Influenza virus
MASQGTKR

SEQ ID NO: 280293 - protein, 8 aa, Influenza virus
ASQGTKRS

SEQ ID NO: 280294 - protein, 8 aa, Influenza virus
SQGTKRSY

SEQ ID NO: 280295 - protein, 8 aa, Influenza virus
QGTKRSYE

SEQ ID NO: 280296 - protein, 8 aa, Influenza virus
GTKRSYEQ

SEQ ID NO: 280297 - protein, 8 aa, Influenza virus
TKRSYEQM

SEQ ID NO: 280298 - protein, 8 aa, Influenza virus
KRSYEQME

SEQ ID NO: 280299 - protein, 8 aa, Influenza virus
RSYEQMET

SEQ ID NO: 280300 - protein, 8 aa, Influenza virus
SYEQMETG

SEQ ID NO: 280301 - protein, 8 aa, Influenza virus
YEQMETGG

SEQ ID NO: 280302 - protein, 8 aa, Influenza virus
SEQMETGG

SEQ ID NO: 280303 - protein, 8 aa, Influenza virus
EQMETGGE

SEQ ID NO: 280304 - protein, 8 aa, Influenza virus
QMETGGER

SEQ ID NO: 280305 - protein, 8 aa, Influenza virus
METGGERQ

SEQ ID NO: 280306 - protein, 8 aa, Influenza virus
RQNATEIR

SEQ ID NO: 280307 - protein, 8 aa, Influenza virus
ATEIRASV

SEQ ID NO: 280308 - protein, 8 aa, Influenza virus
TEIRASVG

SEQ ID NO: 280309 - protein, 8 aa, Influenza virus
EIRASVGR

SEQ ID NO: 280310 - protein, 8 aa, Influenza virus
IRASVGRM

SEQ ID NO: 280311 - protein, 8 aa, Influenza virus
RASVGRMV

SEQ ID NO: 280312 - protein, 8 aa, Influenza virus
GGIGRFYI

SEQ ID NO: 280313 - protein, 8 aa, Influenza virus
GIGRFYIQ

SEQ ID NO: 280314 - protein, 8 aa, Influenza virus
IGRFYIQM

SEQ ID NO: 280315 - protein, 8 aa, Influenza virus
GRFYIQMC

SEQ ID NO: 280316 - protein, 8 aa, Influenza virus
RFYIQMCT

SEQ ID NO: 280317 - protein, 8 aa, Influenza virus
FYIQMCTE

SEQ ID NO: 280318 - protein, 8 aa, Influenza virus
YIQMCTEL

SEQ ID NO: 280319 - protein, 8 aa, Influenza virus
IQMCTELK

SEQ ID NO: 280320 - protein, 8 aa, Influenza virus
QMCTELKL

SEQ ID NO: 280321 - protein, 8 aa, Influenza virus
MCTELKLS

SEQ ID NO: 280322 - protein, 8 aa, Influenza virus
CTELKLSD

SEQ ID NO: 280323 - protein, 8 aa, Influenza virus
YEGRLIQN

SEQ ID NO: 280324 - protein, 8 aa, Influenza virus
EGRLIQNS

SEQ ID NO: 280325 - protein, 8 aa, Influenza virus
GRLIQNSI

SEQ ID NO: 280326 - protein, 8 aa, Influenza virus
RLIQNSIT

SEQ ID NO: 280327 - protein, 8 aa, Influenza virus
LIQNSITI

SEQ ID NO: 280328 - protein, 8 aa, Influenza virus
IQNSITIE

SEQ ID NO: 280329 - protein, 8 aa, Influenza virus
QNSITIER

SEQ ID NO: 280330 - protein, 8 aa, Influenza virus
NSITIERM

SEQ ID NO: 280331 - protein, 8 aa, Influenza virus
TIERMVLS

SEQ ID NO: 280332 - protein, 8 aa, Influenza virus
IERMVLSA

SEQ ID NO: 280333 - protein, 8 aa, Influenza virus
ERMVLSAF

SEQ ID NO: 280334 - protein, 8 aa, Influenza virus
RMVLSAFD

SEQ ID NO: 280335 - protein, 8 aa, Influenza virus
MVLSAFDE

SEQ ID NO: 280336 - protein, 8 aa, Influenza virus
VLSAFDER

SEQ ID NO: 280337 - protein, 8 aa, Influenza virus
LSAFDERR

SEQ ID NO: 280338 - protein, 8 aa, Influenza virus
SAFDERRN

SEQ ID NO: 280339 - protein, 8 aa, Influenza virus
AFDERRNK

SEQ ID NO: 280340 - protein, 8 aa, Influenza virus
FDERRNKY

SEQ ID NO: 280341 - protein, 8 aa, Influenza virus
DERRNKYL

SEQ ID NO: 280342 - protein, 8 aa, Influenza virus
ERRNKYLE

SEQ ID NO: 280343 - protein, 8 aa, Influenza virus
RRNKYLEE

SEQ ID NO: 280344 - protein, 8 aa, Influenza virus
RNKYLEEH

SEQ ID NO: 280345 - protein, 8 aa, Influenza virus
NKYLEEHP

SEQ ID NO: 280346 - protein, 8 aa, Influenza virus
KYLEEHPS

SEQ ID NO: 280347 - protein, 8 aa, Influenza virus
YLEEHPSA

SEQ ID NO: 280348 - protein, 8 aa, Influenza virus
LEEHPSAG

SEQ ID NO: 280349 - protein, 8 aa, Influenza virus
EEHPSAGK

SEQ ID NO: 280350 - protein, 8 aa, Influenza virus
EHPSAGKD

SEQ ID NO: 280351 - protein, 8 aa, Influenza virus
HPSAGKDP

SEQ ID NO: 280352 - protein, 8 aa, Influenza virus
PSAGKDPK

SEQ ID NO: 280353 - protein, 8 aa, Influenza virus
SAGKDPKK

SEQ ID NO: 280354 - protein, 8 aa, Influenza virus
AGKDPKKT

SEQ ID NO: 280355 - protein, 8 aa, Influenza virus
GKDPKKTG

SEQ ID NO: 280356 - protein, 8 aa, Influenza virus
KDPKKTGG

SEQ ID NO: 280357 - protein, 8 aa, Influenza virus
DPKKTGGP

SEQ ID NO: 280358 - protein, 8 aa, Influenza virus
PKKTGGPI

SEQ ID NO: 280359 - protein, 8 aa, Influenza virus
KKTGGPIY

SEQ ID NO: 280360 - protein, 8 aa, Influenza virus
KTGGPIYR

SEQ ID NO: 280361 - protein, 8 aa, Influenza virus
TGGPIYRR

SEQ ID NO: 280362 - protein, 8 aa, Influenza virus
RELILYDK

SEQ ID NO: 280363 - protein, 8 aa, Influenza virus
ELILYDKE

SEQ ID NO: 280364 - protein, 8 aa, Influenza virus
LILYDKEE

SEQ ID NO: 280365 - protein, 8 aa, Influenza virus
KEEIRRIW

SEQ ID NO: 280366 - protein, 8 aa, Influenza virus
EIRRIWRQ

SEQ ID NO: 280367 - protein, 8 aa, Influenza virus
IRRIWRQA

SEQ ID NO: 280368 - protein, 8 aa, Influenza virus
RRIWRQAN

SEQ ID NO: 280369 - protein, 8 aa, Influenza virus
RIWRQANN

SEQ ID NO: 280370 - protein, 8 aa, Influenza virus
IWRQANNG

SEQ ID NO: 280371 - protein, 8 aa, Influenza virus
WRQANNGE

SEQ ID NO: 280372 - protein, 8 aa, Influenza virus
RQANNGED

SEQ ID NO: 280373 - protein, 8 aa, Influenza virus
QANNGEDA

SEQ ID NO: 280374 - protein, 8 aa, Influenza virus
AGLTHIMI

SEQ ID NO: 280375 - protein, 8 aa, Influenza virus
GLTHIMIW

SEQ ID NO: 280376 - protein, 8 aa, Influenza virus
LTHIMIWH

SEQ ID NO: 280377 - protein, 8 aa, Influenza virus
THIMIWHS

SEQ ID NO: 280378 - protein, 8 aa, Influenza virus
HIMIWHSN

SEQ ID NO: 280379 - protein, 8 aa, Influenza virus
IMIWHSNL

SEQ ID NO: 280380 - protein, 8 aa, Influenza virus
MIWHSNLN

SEQ ID NO: 280381 - protein, 8 aa, Influenza virus
IWHSNLND

SEQ ID NO: 280382 - protein, 8 aa, Influenza virus
WHSNLNDA

SEQ ID NO: 280383 - protein, 8 aa, Influenza virus
HSNLNDAT

SEQ ID NO: 280384 - protein, 8 aa, Influenza virus
SNLNDATY

SEQ ID NO: 280385 - protein, 8 aa, Influenza virus
NLNDATYQ

SEQ ID NO: 280386 - protein, 8 aa, Influenza virus
LNDATYQR

SEQ ID NO: 280387 - protein, 8 aa, Influenza virus
NDATYQRT

SEQ ID NO: 280388 - protein, 8 aa, Influenza virus
DATYQRTR

SEQ ID NO: 280389 - protein, 8 aa, Influenza virus
ATYQRTRA

SEQ ID NO: 280390 - protein, 8 aa, Influenza virus
TYQRTRAL

SEQ ID NO: 280391 - protein, 8 aa, Influenza virus
YQRTRALV

SEQ ID NO: 280392 - protein, 8 aa, Influenza virus
QRTRALVR

SEQ ID NO: 280393 - protein, 8 aa, Influenza virus
RTRALVRT

SEQ ID NO: 280394 - protein, 8 aa, Influenza virus
TRALVRTG

SEQ ID NO: 280395 - protein, 8 aa, Influenza virus
RALVRTGM

SEQ ID NO: 280396 - protein, 8 aa, Influenza virus
ALVRTGMD

SEQ ID NO: 280397 - protein, 8 aa, Influenza virus
LVRTGMDP

SEQ ID NO: 280398 - protein, 8 aa, Influenza virus
VRTGMDPR

SEQ ID NO: 280399 - protein, 8 aa, Influenza virus
RTGMDPRM

SEQ ID NO: 280400 - protein, 8 aa, Influenza virus
TGMDPRMC

SEQ ID NO: 280401 - protein, 8 aa, Influenza virus
GMDPRMCS

SEQ ID NO: 280402 - protein, 8 aa, Influenza virus
MDPRMCSL

SEQ ID NO: 280403 - protein, 8 aa, Influenza virus
DPRMCSLM

SEQ ID NO: 280404 - protein, 8 aa, Influenza virus
PRMCSLMQ

SEQ ID NO: 280405 - protein, 8 aa, Influenza virus
RMCSLMQG

SEQ ID NO: 280406 - protein, 8 aa, Influenza virus
MCSLMQGS

SEQ ID NO: 280407 - protein, 8 aa, Influenza virus
CSLMQGST

SEQ ID NO: 280408 - protein, 8 aa, Influenza virus
SLMQGSTL

SEQ ID NO: 280409 - protein, 8 aa, Influenza virus
LMQGSTLP

SEQ ID NO: 280410 - protein, 8 aa, Influenza virus
MQGSTLPR

SEQ ID NO: 280411 - protein, 8 aa, Influenza virus
QGSTLPRR

SEQ ID NO: 280412 - protein, 8 aa, Influenza virus
GSTLPRRS

SEQ ID NO: 280413 - protein, 8 aa, Influenza virus
STLPRRSG

SEQ ID NO: 280414 - protein, 8 aa, Influenza virus
TLPRRSGA

SEQ ID NO: 280415 - protein, 8 aa, Influenza virus
LPRRSGAA

SEQ ID NO: 280416 - protein, 8 aa, Influenza virus
PRRSGAAG

SEQ ID NO: 280417 - protein, 8 aa, Influenza virus
RRSGAAGA

SEQ ID NO: 280418 - protein, 8 aa, Influenza virus
RSGAAGAA

SEQ ID NO: 280419 - protein, 8 aa, Influenza virus
SGAAGAAV

SEQ ID NO: 280420 - protein, 8 aa, Influenza virus
GAAGAAVK

SEQ ID NO: 280421 - protein, 8 aa, Influenza virus
AAGAAVKG

SEQ ID NO: 280422 - protein, 8 aa, Influenza virus
AGAAVKGV

SEQ ID NO: 280423 - protein, 8 aa, Influenza virus
GAAVKGVG

SEQ ID NO: 280424 - protein, 8 aa, Influenza virus
AAVKGVGT

SEQ ID NO: 280425 - protein, 8 aa, Influenza virus
AVKGVGTM

SEQ ID NO: 280426 - protein, 8 aa, Influenza virus
VMELIRMI

SEQ ID NO: 280427 - protein, 8 aa, Influenza virus
MELIRMIK

SEQ ID NO: 280428 - protein, 8 aa, Influenza virus
ELIRMIKR

SEQ ID NO: 280429 - protein, 8 aa, Influenza virus
LIRMIKRG

SEQ ID NO: 280430 - protein, 8 aa, Influenza virus
IRMIKRGI

SEQ ID NO: 280431 - protein, 8 aa, Influenza virus
RMIKRGIN

SEQ ID NO: 280432 - protein, 8 aa, Influenza virus
MIKRGIND

SEQ ID NO: 280433 - protein, 8 aa, Influenza virus
IKRGINDR

SEQ ID NO: 280434 - protein, 8 aa, Influenza virus
KRGINDRN

SEQ ID NO: 280435 - protein, 8 aa, Influenza virus
RGINDRNF

SEQ ID NO: 280436 - protein, 8 aa, Influenza virus
GINDRNFW

SEQ ID NO: 280437 - protein, 8 aa, Influenza virus
INDRNFWR

SEQ ID NO: 280438 - protein, 8 aa, Influenza virus
NDRNFWRG

SEQ ID NO: 280439 - protein, 8 aa, Influenza virus
DRNFWRGE

SEQ ID NO: 280440 - protein, 8 aa, Influenza virus
RNFWRGEN

SEQ ID NO: 280441 - protein, 8 aa, Influenza virus
NFWRGENG

SEQ ID NO: 280442 - protein, 8 aa, Influenza virus
FWRGENGR

SEQ ID NO: 280443 - protein, 8 aa, Influenza virus
WRGENGRR

SEQ ID NO: 280444 - protein, 8 aa, Influenza virus
RGENGRRT

SEQ ID NO: 280445 - protein, 8 aa, Influenza virus
GENGRRTR

SEQ ID NO: 280446 - protein, 8 aa, Influenza virus
TRIAYERM

SEQ ID NO: 280447 - protein, 8 aa, Influenza virus
RIAYERMC

SEQ ID NO: 280448 - protein, 8 aa, Influenza virus
IAYERMCN

SEQ ID NO: 280449 - protein, 8 aa, Influenza virus
AYERMCNI

SEQ ID NO: 280450 - protein, 8 aa, Influenza virus
YERMCNIL

SEQ ID NO: 280451 - protein, 8 aa, Influenza virus
ERMCNILK

SEQ ID NO: 280452 - protein, 8 aa, Influenza virus
RMCNILKG

SEQ ID NO: 280453 - protein, 8 aa, Influenza virus
MCNILKGK

SEQ ID NO: 280454 - protein, 8 aa, Influenza virus
CNILKGKF

SEQ ID NO: 280455 - protein, 8 aa, Influenza virus
NILKGKFQ

SEQ ID NO: 280456 - protein, 8 aa, Influenza virus
ILKGKFQT

SEQ ID NO: 280457 - protein, 8 aa, Influenza virus
LKGKFQTA

SEQ ID NO: 280458 - protein, 8 aa, Influenza virus
SKGSSKQQ

SEQ ID NO: 280459 - protein, 8 aa, Influenza virus
KGKFQTAA

SEQ ID NO: 280460 - protein, 8 aa, Influenza virus
GKFQTAAQ

SEQ ID NO: 280461 - protein, 8 aa, Influenza virus
KFQTAAQR

SEQ ID NO: 280462 - protein, 8 aa, Influenza virus
FQTAAQRA

SEQ ID NO: 280463 - protein, 8 aa, Influenza virus
QTAAQRAM

SEQ ID NO: 280464 - protein, 8 aa, Influenza virus
TAAQRAMM

SEQ ID NO: 280465 - protein, 8 aa, Influenza virus
AAQRAMMD

SEQ ID NO: 280466 - protein, 8 aa, Influenza virus
AQRAMMDQ

SEQ ID NO: 280467 - protein, 8 aa, Influenza virus
QRAMMDQV

SEQ ID NO: 280468 - protein, 8 aa, Influenza virus
RAMMDQVR

SEQ ID NO: 280469 - protein, 8 aa, Influenza virus
AMMDQVRE

SEQ ID NO: 280470 - protein, 8 aa, Influenza virus
MMDQVRES

SEQ ID NO: 280471 - protein, 8 aa, Influenza virus
MDQVRESR

SEQ ID NO: 280472 - protein, 8 aa, Influenza virus
DQVRESRN

SEQ ID NO: 280473 - protein, 8 aa, Influenza virus
QVRESRNP

SEQ ID NO: 280474 - protein, 8 aa, Influenza virus
VRESRNPG

SEQ ID NO: 280475 - protein, 8 aa, Influenza virus
RESRNPGN

SEQ ID NO: 280476 - protein, 8 aa, Influenza virus
ESRNPGNA

SEQ ID NO: 280477 - protein, 8 aa, Influenza virus
SRNPGNAE

SEQ ID NO: 280478 - protein, 8 aa, Influenza virus
RNPGNAEI

SEQ ID NO: 280479 - protein, 8 aa, Influenza virus
NPGNAEIE

SEQ ID NO: 280480 - protein, 8 aa, Influenza virus
PGNAEIED

SEQ ID NO: 280481 - protein, 8 aa, Influenza virus
GNAEIEDL

SEQ ID NO: 280482 - protein, 8 aa, Influenza virus
NAEIEDLI

SEQ ID NO: 280483 - protein, 8 aa, Influenza virus
AEIEDLIF

SEQ ID NO: 280484 - protein, 8 aa, Influenza virus
EIEDLIFL

SEQ ID NO: 280485 - protein, 8 aa, Influenza virus
IEDLIFLA

SEQ ID NO: 280486 - protein, 8 aa, Influenza virus
EDLIFLAR

SEQ ID NO: 280487 - protein, 8 aa, Influenza virus
DLIFLARS

SEQ ID NO: 280488 - protein, 8 aa, Influenza virus
LIFLARSA

SEQ ID NO: 280489 - protein, 8 aa, Influenza virus
IFLARSAL

SEQ ID NO: 280490 - protein, 8 aa, Influenza virus
FLARSALI

SEQ ID NO: 280491 - protein, 8 aa, Influenza virus
LARSALIL

SEQ ID NO: 280492 - protein, 8 aa, Influenza virus
ARSALILR

SEQ ID NO: 280493 - protein, 8 aa, Influenza virus
RSALILRG

SEQ ID NO: 280494 - protein, 8 aa, Influenza virus
SASALILR

SEQ ID NO: 280495 - protein, 8 aa, Influenza virus
ASALILRG

SEQ ID NO: 280496 - protein, 8 aa, Influenza virus
SALILRGS

SEQ ID NO: 280497 - protein, 8 aa, Influenza virus
ALILRGSV

SEQ ID NO: 280498 - protein, 8 aa, Influenza virus
LILRGSVA

SEQ ID NO: 280499 - protein, 8 aa, Influenza virus
ILRGSVAH

SEQ ID NO: 280500 - protein, 8 aa, Influenza virus
LRGSVAHK

SEQ ID NO: 280501 - protein, 8 aa, Influenza virus
RGSVAHKS

SEQ ID NO: 280502 - protein, 8 aa, Influenza virus
GSVAHKSC

SEQ ID NO: 280503 - protein, 8 aa, Influenza virus
SVAHKSCL

SEQ ID NO: 280504 - protein, 8 aa, Influenza virus
VAHKSCLP

SEQ ID NO: 280505 - protein, 8 aa, Influenza virus
AHKSCLPA

SEQ ID NO: 280506 - protein, 8 aa, Influenza virus
HKSCLPAC

SEQ ID NO: 280507 - protein, 8 aa, Influenza virus
KSCLPACV

SEQ ID NO: 280508 - protein, 8 aa, Influenza virus
SCLPACVY

SEQ ID NO: 280509 - protein, 8 aa, Influenza virus
CLPACVYG

SEQ ID NO: 280510 - protein, 8 aa, Influenza virus
LPACVYGL

SEQ ID NO: 280511 - protein, 8 aa, Influenza virus
PACVYGLA

SEQ ID NO: 280512 - protein, 8 aa, Influenza virus
ACVYGLAV

SEQ ID NO: 280513 - protein, 8 aa, Influenza virus
SGYDFERE

SEQ ID NO: 280514 - protein, 8 aa, Influenza virus
GYDFEREG

SEQ ID NO: 280515 - protein, 8 aa, Influenza virus
YDFEREGY

SEQ ID NO: 280516 - protein, 8 aa, Influenza virus
DFEREGYS

SEQ ID NO: 280517 - protein, 8 aa, Influenza virus
FEREGYSL

SEQ ID NO: 280518 - protein, 8 aa, Influenza virus
EREGYSLV

SEQ ID NO: 280519 - protein, 8 aa, Influenza virus
REGYSLVG

SEQ ID NO: 280520 - protein, 8 aa, Influenza virus
EGYSLVGI

SEQ ID NO: 280521 - protein, 8 aa, Influenza virus
GYSLVGID

SEQ ID NO: 280522 - protein, 8 aa, Influenza virus
YSLVGIDP

SEQ ID NO: 280523 - protein, 8 aa, Influenza virus
SLVGIDPF

SEQ ID NO: 280524 - protein, 8 aa, Influenza virus
LVGIDPFK

SEQ ID NO: 280525 - protein, 8 aa, Influenza virus
VGIDPFKL

SEQ ID NO: 280526 - protein, 8 aa, Influenza virus
GIDPFKLL

SEQ ID NO: 280527 - protein, 8 aa, Influenza virus
IDPFKLLQ

SEQ ID NO: 280528 - protein, 8 aa, Influenza virus
DPDPFRLL

SEQ ID NO: 280529 - protein, 8 aa, Influenza virus
PDPFRLLQ

SEQ ID NO: 280530 - protein, 8 aa, Influenza virus
DPFKLLQN

SEQ ID NO: 280531 - protein, 8 aa, Influenza virus
PFKLLQNS

SEQ ID NO: 280532 - protein, 8 aa, Influenza virus
FKLLQNSQ

SEQ ID NO: 280533 - protein, 8 aa, Influenza virus
PRLLQNSQ

SEQ ID NO: 280534 - protein, 8 aa, Influenza virus
RLLQNSQV

SEQ ID NO: 280535 - protein, 8 aa, Influenza virus
SLIRPNEN

SEQ ID NO: 280536 - protein, 8 aa, Influenza virus
LIRPNENP

SEQ ID NO: 280537 - protein, 8 aa, Influenza virus
RPNENPAH

SEQ ID NO: 280538 - protein, 8 aa, Influenza virus
PNENPAHK

SEQ ID NO: 280539 - protein, 8 aa, Influenza virus
NENPAHKS

SEQ ID NO: 280540 - protein, 8 aa, Influenza virus
ENPAHKSQ

SEQ ID NO: 280541 - protein, 8 aa, Influenza virus
NPAHKSQL

SEQ ID NO: 280542 - protein, 8 aa, Influenza virus
PAHKSQLV

SEQ ID NO: 280543 - protein, 8 aa, Influenza virus
AHKSQLVW

SEQ ID NO: 280544 - protein, 8 aa, Influenza virus
HKSQLVWM

SEQ ID NO: 280545 - protein, 8 aa, Influenza virus
KSQLVWMA

SEQ ID NO: 280546 - protein, 8 aa, Influenza virus
SQLVWMAC

SEQ ID NO: 280547 - protein, 8 aa, Influenza virus
QLVWMACH

SEQ ID NO: 280548 - protein, 8 aa, Influenza virus
LVWMACHS

SEQ ID NO: 280549 - protein, 8 aa, Influenza virus
VWMACHSA

SEQ ID NO: 280550 - protein, 8 aa, Influenza virus
WMACHSAA

SEQ ID NO: 280551 - protein, 8 aa, Influenza virus
MACHSAAF

SEQ ID NO: 280552 - protein, 8 aa, Influenza virus
ACHSAAFE

SEQ ID NO: 280553 - protein, 8 aa, Influenza virus
CHSAAFED

SEQ ID NO: 280554 - protein, 8 aa, Influenza virus
HSAAFEDL

SEQ ID NO: 280555 - protein, 8 aa, Influenza virus
SAAFEDLR

SEQ ID NO: 280556 - protein, 8 aa, Influenza virus
AAFEDLRV

SEQ ID NO: 280557 - protein, 8 aa, Influenza virus
AFEDLRVS

SEQ ID NO: 280558 - protein, 8 aa, Influenza virus
PRGKLSTR

SEQ ID NO: 280559 - protein, 8 aa, Influenza virus
RGKLSTRG

SEQ ID NO: 280560 - protein, 8 aa, Influenza virus
LSTRGVQI

SEQ ID NO: 280561 - protein, 8 aa, Influenza virus
STRGVQIA

SEQ ID NO: 280562 - protein, 8 aa, Influenza virus
TRGVQIAS

SEQ ID NO: 280563 - protein, 8 aa, Influenza virus
RGVQIASN

SEQ ID NO: 280564 - protein, 8 aa, Influenza virus
GVQIASNE

SEQ ID NO: 280565 - protein, 8 aa, Influenza virus
VQIASNEN

SEQ ID NO: 280566 - protein, 8 aa, Influenza virus
QIASNENM

SEQ ID NO: 280567 - protein, 8 aa, Influenza virus
SSTLELRS

SEQ ID NO: 280568 - protein, 8 aa, Influenza virus
TLELRSRY

SEQ ID NO: 280569 - protein, 8 aa, Influenza virus
LELRSRYW

SEQ ID NO: 280570 - protein, 8 aa, Influenza virus
ELRSRYWA

SEQ ID NO: 280571 - protein, 8 aa, Influenza virus
LRSRYWAI

SEQ ID NO: 280572 - protein, 8 aa, Influenza virus
RSRYWAIR

SEQ ID NO: 280573 - protein, 8 aa, Influenza virus
SRYWAIRT

SEQ ID NO: 280574 - protein, 8 aa, Influenza virus
RYWAIRTR

SEQ ID NO: 280575 - protein, 8 aa, Influenza virus
YWAIRTRS

SEQ ID NO: 280576 - protein, 8 aa, Influenza virus
WAIRTRSG

SEQ ID NO: 280577 - protein, 8 aa, Influenza virus
AIRTRSGG

SEQ ID NO: 280578 - protein, 8 aa, Influenza virus
IRTRSGGN

SEQ ID NO: 280579 - protein, 8 aa, Influenza virus
RTRSGGNT

SEQ ID NO: 280580 - protein, 8 aa, Influenza virus
TRSGGNTN

SEQ ID NO: 280581 - protein, 8 aa, Influenza virus
RSGGNTNQ

SEQ ID NO: 280582 - protein, 8 aa, Influenza virus
SGGNTNQQ

SEQ ID NO: 280583 - protein, 8 aa, Influenza virus
QQRASAGQ

SEQ ID NO: 280584 - protein, 8 aa, Influenza virus
RASAGQIS

SEQ ID NO: 280585 - protein, 8 aa, Influenza virus
ASAGQISV

SEQ ID NO: 280586 - protein, 8 aa, Influenza virus
SAGQISVQ

SEQ ID NO: 280587 - protein, 8 aa, Influenza virus
AGQISVQP

SEQ ID NO: 280588 - protein, 8 aa, Influenza virus
SVQPTFSV

SEQ ID NO: 280589 - protein, 8 aa, Influenza virus
VQPTFSVQ

SEQ ID NO: 280590 - protein, 8 aa, Influenza virus
QPTFSVQR

SEQ ID NO: 280591 - protein, 8 aa, Influenza virus
PTFSVQRN

SEQ ID NO: 280592 - protein, 8 aa, Influenza virus
TFSVQRNL

SEQ ID NO: 280593 - protein, 8 aa, Influenza virus
FSVQRNLP

SEQ ID NO: 280594 - protein, 8 aa, Influenza virus
SVQRNLPF

SEQ ID NO: 280595 - protein, 8 aa, Influenza virus
VQRNLPFE

SEQ ID NO: 280596 - protein, 8 aa, Influenza virus
QRNLPFER

SEQ ID NO: 280597 - protein, 8 aa, Influenza virus
GNTEGRTS

SEQ ID NO: 280598 - protein, 8 aa, Influenza virus
NTEGRTSD

SEQ ID NO: 280599 - protein, 8 aa, Influenza virus
TEGRTSDM

SEQ ID NO: 280600 - protein, 8 aa, Influenza virus
EGRTSDMR

SEQ ID NO: 280601 - protein, 8 aa, Influenza virus
GRTSDMRT

SEQ ID NO: 280602 - protein, 8 aa, Influenza virus
RTSDMRTE

SEQ ID NO: 280603 - protein, 8 aa, Influenza virus
TSDMRTEI

SEQ ID NO: 280604 - protein, 8 aa, Influenza virus
SDMRTEII

SEQ ID NO: 280605 - protein, 8 aa, Influenza virus
DMRTEIIR

SEQ ID NO: 280606 - protein, 8 aa, Influenza virus
RRAEIIKM

SEQ ID NO: 280607 - protein, 8 aa, Influenza virus
TEIIIRMM

SEQ ID NO: 280608 - protein, 8 aa, Influenza virus
EIIIRMME

SEQ ID NO: 280609 - protein, 8 aa, Influenza virus
IIIRMMEN

SEQ ID NO: 280610 - protein, 8 aa, Influenza virus
DVSFQGRG

SEQ ID NO: 280611 - protein, 8 aa, Influenza virus
VSFQGRGV

SEQ ID NO: 280612 - protein, 8 aa, Influenza virus
SFQGRGVF

SEQ ID NO: 280613 - protein, 8 aa, Influenza virus
FQGRGVFE

SEQ ID NO: 280614 - protein, 8 aa, Influenza virus
QGRGVFEL

SEQ ID NO: 280615 - protein, 8 aa, Influenza virus
GRGVFELS

SEQ ID NO: 280616 - protein, 8 aa, Influenza virus
RRGQGHLD

SEQ ID NO: 280617 - protein, 8 aa, Influenza virus
RGVFELSD

SEQ ID NO: 280618 - protein, 8 aa, Influenza virus
GVFELSDE

SEQ ID NO: 280619 - protein, 8 aa, Influenza virus
VFELSDEK

SEQ ID NO: 280620 - protein, 8 aa, Influenza virus
FELSDEKA

SEQ ID NO: 280621 - protein, 8 aa, Influenza virus
ELSDEKAT

SEQ ID NO: 280622 - protein, 8 aa, Influenza virus
SDEKATNP

SEQ ID NO: 280623 - protein, 8 aa, Influenza virus
ATNPIVPS

SEQ ID NO: 280624 - protein, 8 aa, Influenza virus
TNPIVPSF

SEQ ID NO: 280625 - protein, 8 aa, Influenza virus
NPIVPSFD

SEQ ID NO: 280626 - protein, 8 aa, Influenza virus
PIVPSFDM

SEQ ID NO: 280627 - protein, 8 aa, Influenza virus
IVPSFDMS

SEQ ID NO: 280628 - protein, 8 aa, Influenza virus
VPSFDMSN

SEQ ID NO: 280629 - protein, 8 aa, Influenza virus
PSFDMSNE

SEQ ID NO: 280630 - protein, 8 aa, Influenza virus
SFDMSNEG

SEQ ID NO: 280631 - protein, 8 aa, Influenza virus
FDMSNEGS

SEQ ID NO: 280632 - protein, 8 aa, Influenza virus
DMSNEGSY

SEQ ID NO: 280633 - protein, 8 aa, Influenza virus
MSNEGSYF

SEQ ID NO: 280634 - protein, 8 aa, Influenza virus
SNEGSYFF

SEQ ID NO: 280635 - protein, 8 aa, Influenza virus
NEGSYFFG

SEQ ID NO: 280636 - protein, 8 aa, Influenza virus
EGSYFFGD

SEQ ID NO: 280637 - protein, 8 aa, Influenza virus
GSYFFGDN

SEQ ID NO: 280638 - protein, 8 aa, Influenza virus
SYFFGDNA

SEQ ID NO: 280639 - protein, 8 aa, Influenza virus
YFFGDNAE

SEQ ID NO: 280640 - protein, 8 aa, Influenza virus
FFGDNAEE

SEQ ID NO: 280641 - protein, 8 aa, Influenza virus
FGDNAEEY

SEQ ID NO: 280642 - protein, 8 aa, Influenza virus
AEEYRRLR

SEQ ID NO: 280643 - protein, 8 aa, Influenza virus
MLFVQSYF

SEQ ID NO: 280644 - protein, 8 aa, Influenza virus
LFVQSYFQ

SEQ ID NO: 280645 - protein, 8 aa, Influenza virus
FVQSYFQL

SEQ ID NO: 280646 - protein, 8 aa, Influenza virus
VQSYFQLF

SEQ ID NO: 280647 - protein, 8 aa, Influenza virus
QSYFQLFL

SEQ ID NO: 280648 - protein, 8 aa, Influenza virus
SYFQLFLV

SEQ ID NO: 280649 - protein, 8 aa, Influenza virus
YFQLFLVC

SEQ ID NO: 280650 - protein, 8 aa, Influenza virus
FQLFLVCV

SEQ ID NO: 280651 - protein, 8 aa, Influenza virus
QLFLVCVS

SEQ ID NO: 280652 - protein, 8 aa, Influenza virus
LFLVCVSL

SEQ ID NO: 280653 - protein, 8 aa, Influenza virus
FLVCVSLL

SEQ ID NO: 280654 - protein, 8 aa, Influenza virus
LVCVSLLQ

SEQ ID NO: 280655 - protein, 8 aa, Influenza virus
VCVSLLQS

SEQ ID NO: 280656 - protein, 8 aa, Influenza virus
CVSLLQSA

SEQ ID NO: 280657 - protein, 8 aa, Influenza virus
VSLLQSAI

SEQ ID NO: 280658 - protein, 8 aa, Influenza virus
SLLQSAIL

SEQ ID NO: 280659 - protein, 8 aa, Influenza virus
LLQSAILS

SEQ ID NO: 280660 - protein, 8 aa, Influenza virus
SSFQVDCF

SEQ ID NO: 280661 - protein, 8 aa, Influenza virus
SFQVDCFL

SEQ ID NO: 280662 - protein, 8 aa, Influenza virus
FQVDCFLW

SEQ ID NO: 280663 - protein, 8 aa, Influenza virus
QVDCFLWH

SEQ ID NO: 280664 - protein, 8 aa, Influenza virus
VDCFLWHV

SEQ ID NO: 280665 - protein, 8 aa, Influenza virus
DCFLWHVR

SEQ ID NO: 280666 - protein, 8 aa, Influenza virus
GDAPFLDR

SEQ ID NO: 280667 - protein, 8 aa, Influenza virus
DAPFLDRL

SEQ ID NO: 280668 - protein, 8 aa, Influenza virus
APFLDRLR

SEQ ID NO: 280669 - protein, 8 aa, Influenza virus
PFLDRLRR

SEQ ID NO: 280670 - protein, 8 aa, Influenza virus
FLDRLRRD

SEQ ID NO: 280671 - protein, 8 aa, Influenza virus
SLLLLQAN

SEQ ID NO: 280672 - protein, 8 aa, Influenza virus
LLLLQANL

SEQ ID NO: 280673 - protein, 8 aa, Influenza virus
LLLQANLC

SEQ ID NO: 280674 - protein, 8 aa, Influenza virus
LLQANLCR

SEQ ID NO: 280675 - protein, 8 aa, Influenza virus
LQANLCRF

SEQ ID NO: 280676 - protein, 8 aa, Influenza virus
QANLCRFL

SEQ ID NO: 280677 - protein, 8 aa, Influenza virus
ANLCRFLE

SEQ ID NO: 280678 - protein, 8 aa, Influenza virus
NLCRFLET

SEQ ID NO: 280679 - protein, 8 aa, Influenza virus
LDRLRRDQ

SEQ ID NO: 280680 - protein, 8 aa, Influenza virus
DRLRRDQK

SEQ ID NO: 280681 - protein, 8 aa, Influenza virus
RLRRDQKS

SEQ ID NO: 280682 - protein, 8 aa, Influenza virus
LRRDQKSL

SEQ ID NO: 280683 - protein, 8 aa, Influenza virus
RRDQKSLR

SEQ ID NO: 280684 - protein, 8 aa, Influenza virus
RDQKSLRG

SEQ ID NO: 280685 - protein, 8 aa, Influenza virus
DQKSLRGR

SEQ ID NO: 280686 - protein, 8 aa, Influenza virus
PMRTPIAF

SEQ ID NO: 280687 - protein, 8 aa, Influenza virus
MRTPIAFL

SEQ ID NO: 280688 - protein, 8 aa, Influenza virus
RTPIAFLT

SEQ ID NO: 280689 - protein, 8 aa, Influenza virus
TPIAFLTS

SEQ ID NO: 280690 - protein, 8 aa, Influenza virus
PIAFLTSS

SEQ ID NO: 280691 - protein, 8 aa, Influenza virus
IAFLTSSI

SEQ ID NO: 280692 - protein, 8 aa, Influenza virus
AFLTSSIV

SEQ ID NO: 280693 - protein, 8 aa, Influenza virus
FLTSSIVC

SEQ ID NO: 280694 - protein, 8 aa, Influenza virus
IASVPASR

SEQ ID NO: 280695 - protein, 8 aa, Influenza virus
ASVPASRY

SEQ ID NO: 280696 - protein, 8 aa, Influenza virus
SKITLKFA

SEQ ID NO: 280697 - protein, 8 aa, Influenza virus
KITLKFAF

SEQ ID NO: 280698 - protein, 8 aa, Influenza virus
ITLKFAFN

SEQ ID NO: 280699 - protein, 8 aa, Influenza virus
AGVETMVI

SEQ ID NO: 280700 - protein, 8 aa, Influenza virus
GVETMVIL

SEQ ID NO: 280701 - protein, 8 aa, Influenza virus
NWPSSSGG

SEQ ID NO: 280702 - protein, 8 aa, Influenza virus
SRNGKWRE

SEQ ID NO: 280703 - protein, 8 aa, Influenza virus
RNGKWREQ

SEQ ID NO: 280704 - protein, 8 aa, Influenza virus
NGKWREQL

SEQ ID NO: 280705 - protein, 8 aa, Influenza virus
GKWREQLS

SEQ ID NO: 280706 - protein, 8 aa, Influenza virus
KWREQLSQ

SEQ ID NO: 280707 - protein, 8 aa, Influenza virus
WREQLSQK

SEQ ID NO: 280708 - protein, 8 aa, Influenza virus
REQLSQKF

SEQ ID NO: 280709 - protein, 8 aa, Influenza virus
EQLSQKFE

SEQ ID NO: 280710 - protein, 8 aa, Influenza virus
QLSQKFEE

SEQ ID NO: 280711 - protein, 8 aa, Influenza virus
LSQKFEEI

SEQ ID NO: 280712 - protein, 8 aa, Influenza virus
RRDQMAHC

SEQ ID NO: 280713 - protein, 8 aa, Influenza virus
HRLKITEN

SEQ ID NO: 280714 - protein, 8 aa, Influenza virus
RLKITENS

SEQ ID NO: 280715 - protein, 8 aa, Influenza virus
LKITENSF

SEQ ID NO: 280716 - protein, 8 aa, Influenza virus
KITENSFE

SEQ ID NO: 280717 - protein, 8 aa, Influenza virus
ITENSFEQ

SEQ ID NO: 280718 - protein, 8 aa, Influenza virus
TENSFEQI

SEQ ID NO: 280719 - protein, 8 aa, Influenza virus
ENSFEQIT

SEQ ID NO: 280720 - protein, 8 aa, Influenza virus
NSFEQITF

SEQ ID NO: 280721 - protein, 8 aa, Influenza virus
SFEQITFM

SEQ ID NO: 280722 - protein, 8 aa, Influenza virus
FEQITFMQ

SEQ ID NO: 280723 - protein, 8 aa, Influenza virus
EQITFMQA

SEQ ID NO: 280724 - protein, 8 aa, Influenza virus
QITFMQAL

SEQ ID NO: 280725 - protein, 8 aa, Influenza virus
ITFMQALQ

SEQ ID NO: 280726 - protein, 8 aa, Influenza virus
TFMQALQL

SEQ ID NO: 280727 - protein, 8 aa, Influenza virus
TAFSGMSA

SEQ ID NO: 280728 - protein, 8 aa, Influenza virus
AFSGMSAN

SEQ ID NO: 280729 - protein, 8 aa, Influenza virus
FSGMSANG

SEQ ID NO: 280730 - protein, 8 aa, Influenza virus
SGMSANGD

SEQ ID NO: 280731 - protein, 8 aa, Influenza virus
GMSANGDI

SEQ ID NO: 280732 - protein, 8 aa, Influenza virus
FQYLLFQD

SEQ ID NO: 280733 - protein, 8 aa, Influenza virus
QYLLFQDI

SEQ ID NO: 280734 - protein, 8 aa, Influenza virus
YLLFQDIL

SEQ ID NO: 280735 - protein, 8 aa, Influenza virus
LLFQDILM

SEQ ID NO: 280736 - protein, 8 aa, Influenza virus
LFQDILMR

SEQ ID NO: 280737 - protein, 8 aa, Influenza virus
LWHVRKRF

SEQ ID NO: 280738 - protein, 8 aa, Influenza virus
WHVRKRFA

SEQ ID NO: 280739 - protein, 8 aa, Influenza virus
HVRKRFAD

SEQ ID NO: 280740 - protein, 8 aa, Influenza virus
VRKRFADQ

SEQ ID NO: 280741 - protein, 8 aa, Influenza virus
RKRFADQE

SEQ ID NO: 280742 - protein, 8 aa, Influenza virus
KRFADQEL

SEQ ID NO: 280743 - protein, 8 aa, Influenza virus
RFADQELG

SEQ ID NO: 280744 - protein, 8 aa, Influenza virus
FADQELGD

SEQ ID NO: 280745 - protein, 8 aa, Influenza virus
ADQELGDA

SEQ ID NO: 280746 - protein, 8 aa, Influenza virus
DQELGDAP

SEQ ID NO: 280747 - protein, 8 aa, Influenza virus
QELGDAPF

SEQ ID NO: 280748 - protein, 8 aa, Influenza virus
ELGDAPFL

SEQ ID NO: 280749 - protein, 8 aa, Influenza virus
LGDAPFLD

SEQ ID NO: 280750 - protein, 8 aa, Influenza virus
GDAPFLDR

SEQ ID NO: 280751 - protein, 8 aa, Influenza virus
DAPFLDRL

SEQ ID NO: 280752 - protein, 8 aa, Influenza virus
APFLDRLR

SEQ ID NO: 280753 - protein, 8 aa, Influenza virus
PFLDRLRR

SEQ ID NO: 280754 - protein, 8 aa, Influenza virus
FLDRLRRD

SEQ ID NO: 280755 - protein, 8 aa, Influenza virus
LDRLRRDQ

SEQ ID NO: 280756 - protein, 8 aa, Influenza virus
DRLRRDQK

SEQ ID NO: 280757 - protein, 8 aa, Influenza virus
RLRRDQKS

SEQ ID NO: 280758 - protein, 8 aa, Influenza virus
LRRDQKSL

SEQ ID NO: 280759 - protein, 8 aa, Influenza virus
RRDQKSLR

SEQ ID NO: 280760 - protein, 8 aa, Influenza virus
RDQKSLRG

SEQ ID NO: 280761 - protein, 8 aa, Influenza virus
DQKSLRGR

SEQ ID NO: 280762 - protein, 8 aa, Influenza virus
QKSLRGRG

SEQ ID NO: 280763 - protein, 8 aa, Influenza virus
KSLRGRGS

SEQ ID NO: 280764 - protein, 8 aa, Influenza virus
SLRGRGST

SEQ ID NO: 280765 - protein, 8 aa, Influenza virus
LRGRGSTL

SEQ ID NO: 280766 - protein, 8 aa, Influenza virus
RGRGSTLG

SEQ ID NO: 280767 - protein, 8 aa, Influenza virus
GRGSTLGL

SEQ ID NO: 280768 - protein, 8 aa, Influenza virus
RGSTLGLD

SEQ ID NO: 280769 - protein, 8 aa, Influenza virus
GSTLGLDI

SEQ ID NO: 280770 - protein, 8 aa, Influenza virus
STLGLDIR

SEQ ID NO: 280771 - protein, 8 aa, Influenza virus
TLGLDIRT

SEQ ID NO: 280772 - protein, 8 aa, Influenza virus
LGLDIRTA

SEQ ID NO: 280773 - protein, 8 aa, Influenza virus
GLDIRTAT

SEQ ID NO: 280774 - protein, 8 aa, Influenza virus
LDIRTATR

SEQ ID NO: 280775 - protein, 8 aa, Influenza virus
DIRTATRE

SEQ ID NO: 280776 - protein, 8 aa, Influenza virus
IRTATREG

SEQ ID NO: 280777 - protein, 8 aa, Influenza virus
RTATREGK

SEQ ID NO: 280778 - protein, 8 aa, Influenza virus
TATREGKH

SEQ ID NO: 280779 - protein, 8 aa, Influenza virus
ATREGKHI

SEQ ID NO: 280780 - protein, 8 aa, Influenza virus
TREGKHIV

SEQ ID NO: 280781 - protein, 8 aa, Influenza virus
REGKHIVE

SEQ ID NO: 280782 - protein, 8 aa, Influenza virus
EGKHIVER

SEQ ID NO: 280783 - protein, 8 aa, Influenza virus
GKHIVERI

SEQ ID NO: 280784 - protein, 8 aa, Influenza virus
KHIVERIL

SEQ ID NO: 280785 - protein, 8 aa, Influenza virus
HIVERILE

SEQ ID NO: 280786 - protein, 8 aa, Influenza virus
IVERILEE

SEQ ID NO: 280787 - protein, 8 aa, Influenza virus
VERILEEE

SEQ ID NO: 280788 - protein, 8 aa, Influenza virus
ERILEEES

SEQ ID NO: 280789 - protein, 8 aa, Influenza virus
RILEEESD

SEQ ID NO: 280790 - protein, 8 aa, Influenza virus
ILEEESDE

SEQ ID NO: 280791 - protein, 8 aa, Influenza virus
LEEESDEA

SEQ ID NO: 280792 - protein, 8 aa, Influenza virus
EEESDEAL

SEQ ID NO: 280793 - protein, 8 aa, Influenza virus
EESDEALK

SEQ ID NO: 280794 - protein, 8 aa, Influenza virus
ESDEALKM

SEQ ID NO: 280795 - protein, 8 aa, Influenza virus
SDEALKMT

SEQ ID NO: 280796 - protein, 8 aa, Influenza virus
DEALKMTI

SEQ ID NO: 280797 - protein, 8 aa, Influenza virus
EALKMTIA

SEQ ID NO: 280798 - protein, 8 aa, Influenza virus
ALKMTIAS

SEQ ID NO: 280799 - protein, 8 aa, Influenza virus
LKMTIASD

SEQ ID NO: 280800 - protein, 8 aa, Influenza virus
KMTIASDI

SEQ ID NO: 280801 - protein, 8 aa, Influenza virus
MTIASDIL

SEQ ID NO: 280802 - protein, 8 aa, Influenza virus
TIASDILK

SEQ ID NO: 280803 - protein, 8 aa, Influenza virus
IASDILTR

SEQ ID NO: 280804 - protein, 8 aa, Influenza virus
ASDILTRM

SEQ ID NO: 280805 - protein, 8 aa, Influenza virus
RPHPEDLN

SEQ ID NO: 280806 - protein, 8 aa, Influenza virus
QLGQKFEE

SEQ ID NO: 280807 - protein, 8 aa, Influenza virus
LGQKFEEI

SEQ ID NO: 280808 - protein, 8 aa, Influenza virus
QKFEEIRW

SEQ ID NO: 280809 - protein, 8 aa, Influenza virus
KFEEIRWL

SEQ ID NO: 280810 - protein, 8 aa, Influenza virus
FEEIRWLI

SEQ ID NO: 280811 - protein, 8 aa, Influenza virus
TENSFEQI

SEQ ID NO: 280812 - protein, 8 aa, Influenza virus
ENSFEQIT

SEQ ID NO: 280813 - protein, 8 aa, Influenza virus
NSFEQITF

SEQ ID NO: 280814 - protein, 8 aa, Influenza virus
SFEQITFM

SEQ ID NO: 280815 - protein, 8 aa, Influenza virus
FEQITFMQ

SEQ ID NO: 280816 - protein, 8 aa, Influenza virus
EQITFMQA

SEQ ID NO: 280817 - protein, 8 aa, Influenza virus
QITFMQAL

SEQ ID NO: 280818 - protein, 8 aa, Influenza virus
ITFMQALQ

SEQ ID NO: 280819 - protein, 8 aa, Influenza virus
TFMQALQL

SEQ ID NO: 280820 - protein, 8 aa, Influenza virus
FMQALQLL

SEQ ID NO: 280821 - protein, 8 aa, Influenza virus
MQALQLLL

SEQ ID NO: 280822 - protein, 8 aa, Influenza virus
QALQLLLE

SEQ ID NO: 280823 - protein, 8 aa, Influenza virus
ALQLLLEV

SEQ ID NO: 280824 - protein, 8 aa, Influenza virus
LQLLLEVE

SEQ ID NO: 280825 - protein, 8 aa, Influenza virus
QLLLEVEQ

SEQ ID NO: 280826 - protein, 8 aa, Influenza virus
LLLEVEQE

SEQ ID NO: 280827 - protein, 8 aa, Influenza virus
EVEQEIRT

SEQ ID NO: 280828 - protein, 8 aa, Influenza virus
VEQEIRTF

SEQ ID NO: 280829 - protein, 8 aa, Influenza virus
EQEIRTFS

SEQ ID NO: 280830 - protein, 8 aa, Influenza virus
QEIRTFSF

SEQ ID NO: 280831 - protein, 8 aa, Influenza virus
EIRTFSFQ

SEQ ID NO: 280832 - protein, 8 aa, Influenza virus
IRTFSFQL

SEQ ID NO: 280833 - protein, 8 aa, Influenza virus
RTFSFQLI

SEQ ID NO: 280834 - protein, 8 aa, Influenza virus
TFSFQLIN

SEQ ID NO: 280835 - protein, 8 aa, Influenza virus
FSFQLINN

SEQ ID NO: 280836 - protein, 8 aa, Influenza virus
SFQLINNK

SEQ ID NO: 280837 - protein, 8 aa, Influenza virus
FQLINNKK

SEQ ID NO: 280838 - protein, 8 aa, Influenza virus
QLINNKKP

SEQ ID NO: 280839 - protein, 8 aa, Influenza virus
MEDFVRQC

SEQ ID NO: 280840 - protein, 8 aa, Influenza virus
EDFVRQCF

SEQ ID NO: 280841 - protein, 8 aa, Influenza virus
DFVRQCFN

SEQ ID NO: 280842 - protein, 8 aa, Influenza virus
FVRQCFNP

SEQ ID NO: 280843 - protein, 8 aa, Influenza virus
VRQCFNPM

SEQ ID NO: 280844 - protein, 8 aa, Influenza virus
RQCFNPMI

SEQ ID NO: 280845 - protein, 8 aa, Influenza virus
QCFNPMIV

SEQ ID NO: 280846 - protein, 8 aa, Influenza virus
CFNPMIVE

SEQ ID NO: 280847 - protein, 8 aa, Influenza virus
FNPMIVEL

SEQ ID NO: 280848 - protein, 8 aa, Influenza virus
NPMIVELA

SEQ ID NO: 280849 - protein, 8 aa, Influenza virus
PMIVELAE

SEQ ID NO: 280850 - protein, 8 aa, Influenza virus
MIVELAEK

SEQ ID NO: 280851 - protein, 8 aa, Influenza virus
VELAEKAM

SEQ ID NO: 280852 - protein, 8 aa, Influenza virus
ELAEKAMK

SEQ ID NO: 280853 - protein, 8 aa, Influenza virus
LAEKAMKE

SEQ ID NO: 280854 - protein, 8 aa, Influenza virus
AEKAMKEY

SEQ ID NO: 280855 - protein, 8 aa, Influenza virus
EKAMKEYG

SEQ ID NO: 280856 - protein, 8 aa, Influenza virus
KAMKEYGE

SEQ ID NO: 280857 - protein, 8 aa, Influenza virus
IETNKFAA

SEQ ID NO: 280858 - protein, 8 aa, Influenza virus
ETNKFAAI

SEQ ID NO: 280859 - protein, 8 aa, Influenza virus
TNKFAAIC

SEQ ID NO: 280860 - protein, 8 aa, Influenza virus
NKFAAICT

SEQ ID NO: 280861 - protein, 8 aa, Influenza virus
KFAAICTH

SEQ ID NO: 280862 - protein, 8 aa, Influenza virus
FAAICTHL

SEQ ID NO: 280863 - protein, 8 aa, Influenza virus
AAICTHLE

SEQ ID NO: 280864 - protein, 8 aa, Influenza virus
AICTHLEV

SEQ ID NO: 280865 - protein, 8 aa, Influenza virus
ICTHLEVC

SEQ ID NO: 280866 - protein, 8 aa, Influenza virus
CTHLEVCF

SEQ ID NO: 280867 - protein, 8 aa, Influenza virus
THLEVCFM

SEQ ID NO: 280868 - protein, 8 aa, Influenza virus
HLEVCFMY

SEQ ID NO: 280869 - protein, 8 aa, Influenza virus
LEVCFMYS

SEQ ID NO: 280870 - protein, 8 aa, Influenza virus
EVCFMYSD

SEQ ID NO: 280871 - protein, 8 aa, Influenza virus
VCFMYSDF

SEQ ID NO: 280872 - protein, 8 aa, Influenza virus
CFMYSDFH

SEQ ID NO: 280873 - protein, 8 aa, Influenza virus
FMYSDFHF

SEQ ID NO: 280874 - protein, 8 aa, Influenza virus
MYSDFHFI

SEQ ID NO: 280875 - protein, 8 aa, Influenza virus
YSDFHFID

SEQ ID NO: 280876 - protein, 8 aa, Influenza virus
SDFHFIDE

SEQ ID NO: 280877 - protein, 8 aa, Influenza virus
DFHFIDER

SEQ ID NO: 280878 - protein, 8 aa, Influenza virus
DPNALLKH

SEQ ID NO: 280879 - protein, 8 aa, Influenza virus
PNALLKHR

SEQ ID NO: 280880 - protein, 8 aa, Influenza virus
NALLKHRF

SEQ ID NO: 280881 - protein, 8 aa, Influenza virus
ALLKHRFE

SEQ ID NO: 280882 - protein, 8 aa, Influenza virus
LLKHRFEI

SEQ ID NO: 280883 - protein, 8 aa, Influenza virus
LKHRFEII

SEQ ID NO: 280884 - protein, 8 aa, Influenza virus
KHRFEIIE

SEQ ID NO: 280885 - protein, 8 aa, Influenza virus
HRFEIIEG

SEQ ID NO: 280886 - protein, 8 aa, Influenza virus
RFEIIEGR

SEQ ID NO: 280887 - protein, 8 aa, Influenza virus
FEIIEGRD

SEQ ID NO: 280888 - protein, 8 aa, Influenza virus
EIIEGRDR

SEQ ID NO: 280889 - protein, 8 aa, Influenza virus
IIEGRDRT

SEQ ID NO: 280890 - protein, 8 aa, Influenza virus
EGRDRTMA

SEQ ID NO: 280891 - protein, 8 aa, Influenza virus
GRDRTMAW

SEQ ID NO: 280892 - protein, 8 aa, Influenza virus
AWTVVNSI

SEQ ID NO: 280893 - protein, 8 aa, Influenza virus
WTVVNSIC

SEQ ID NO: 280894 - protein, 8 aa, Influenza virus
KPKFLPDL

SEQ ID NO: 280895 - protein, 8 aa, Influenza virus
PKFLPDLY

SEQ ID NO: 280896 - protein, 8 aa, Influenza virus
KFLPDLYD

SEQ ID NO: 280897 - protein, 8 aa, Influenza virus
FLPDLYDY

SEQ ID NO: 280898 - protein, 8 aa, Influenza virus
LPDLYDYK

SEQ ID NO: 280899 - protein, 8 aa, Influenza virus
PDLYDYKE

SEQ ID NO: 280900 - protein, 8 aa, Influenza virus
DLYDYKEN

SEQ ID NO: 280901 - protein, 8 aa, Influenza virus
LYDYKENR

SEQ ID NO: 280902 - protein, 8 aa, Influenza virus
YDYKENRF

SEQ ID NO: 280903 - protein, 8 aa, Influenza virus
RFIEIGVT

SEQ ID NO: 280904 - protein, 8 aa, Influenza virus
FIEIGVTR

SEQ ID NO: 280905 - protein, 8 aa, Influenza virus
IEIGVTRR

SEQ ID NO: 280906 - protein, 8 aa, Influenza virus
EIGVTRRE

SEQ ID NO: 280907 - protein, 8 aa, Influenza virus
IGVTRREV

SEQ ID NO: 280908 - protein, 8 aa, Influenza virus
GVTRREVH

SEQ ID NO: 280909 - protein, 8 aa, Influenza virus
VTRREVHI

SEQ ID NO: 280910 - protein, 8 aa, Influenza virus
TRREVHIY

SEQ ID NO: 280911 - protein, 8 aa, Influenza virus
RREVHIYY

SEQ ID NO: 280912 - protein, 8 aa, Influenza virus
REVHIYYL

SEQ ID NO: 280913 - protein, 8 aa, Influenza virus
EVHIYYLE

SEQ ID NO: 280914 - protein, 8 aa, Influenza virus
VHIYYLEK

SEQ ID NO: 280915 - protein, 8 aa, Influenza virus
HIYYLEKA

SEQ ID NO: 280916 - protein, 8 aa, Influenza virus
IYYLEKAN

SEQ ID NO: 280917 - protein, 8 aa, Influenza virus
YYLEKANK

SEQ ID NO: 280918 - protein, 8 aa, Influenza virus
YLEKANKI

SEQ ID NO: 280919 - protein, 8 aa, Influenza virus
LEKANKIK

SEQ ID NO: 280920 - protein, 8 aa, Influenza virus
EKANKIKS

SEQ ID NO: 280921 - protein, 8 aa, Influenza virus
KANKIKSE

SEQ ID NO: 280922 - protein, 8 aa, Influenza virus
EKTHIHIF

SEQ ID NO: 280923 - protein, 8 aa, Influenza virus
KTHIHIFS

SEQ ID NO: 280924 - protein, 8 aa, Influenza virus
THIHIFSF

SEQ ID NO: 280925 - protein, 8 aa, Influenza virus
HIHIFSFT

SEQ ID NO: 280926 - protein, 8 aa, Influenza virus
IHIFSFTG

SEQ ID NO: 280927 - protein, 8 aa, Influenza virus
HIFSFTGE

SEQ ID NO: 280928 - protein, 8 aa, Influenza virus
IFSFTGEE

SEQ ID NO: 280929 - protein, 8 aa, Influenza virus
FSFTGEEM

SEQ ID NO: 280930 - protein, 8 aa, Influenza virus
SFTGEEMA

SEQ ID NO: 280931 - protein, 8 aa, Influenza virus
FTGEEMAT

SEQ ID NO: 280932 - protein, 8 aa, Influenza virus
TGEEMATK

SEQ ID NO: 280933 - protein, 8 aa, Influenza virus
GEEMATKA

SEQ ID NO: 280934 - protein, 8 aa, Influenza virus
DYTLDEES

SEQ ID NO: 280935 - protein, 8 aa, Influenza virus
YTLDEESR

SEQ ID NO: 280936 - protein, 8 aa, Influenza virus
TLDEESRA

SEQ ID NO: 280937 - protein, 8 aa, Influenza virus
LDEESRAR

SEQ ID NO: 280938 - protein, 8 aa, Influenza virus
ASSKSRAR

SEQ ID NO: 280939 - protein, 8 aa, Influenza virus
DEESRARI

SEQ ID NO: 280940 - protein, 8 aa, Influenza virus
EESRARIK

SEQ ID NO: 280941 - protein, 8 aa, Influenza virus
ESRARIKT

SEQ ID NO: 280942 - protein, 8 aa, Influenza virus
SRARIKTR

SEQ ID NO: 280943 - protein, 8 aa, Influenza virus
RARIKTRL

SEQ ID NO: 280944 - protein, 8 aa, Influenza virus
ARIKTRLF

SEQ ID NO: 280945 - protein, 8 aa, Influenza virus
RIKTRLFT

SEQ ID NO: 280946 - protein, 8 aa, Influenza virus
IKTRLFTI

SEQ ID NO: 280947 - protein, 8 aa, Influenza virus
KTRLFTIR

SEQ ID NO: 280948 - protein, 8 aa, Influenza virus
TRLFTIRQ

SEQ ID NO: 280949 - protein, 8 aa, Influenza virus
RLFTIRQE

SEQ ID NO: 280950 - protein, 8 aa, Influenza virus
LFTIRQEM

SEQ ID NO: 280951 - protein, 8 aa, Influenza virus
FTIRQEMA

SEQ ID NO: 280952 - protein, 8 aa, Influenza virus
TIRQEMAS

SEQ ID NO: 280953 - protein, 8 aa, Influenza virus
IRQEMASR

SEQ ID NO: 280954 - protein, 8 aa, Influenza virus
RGLWDSFR

SEQ ID NO: 280955 - protein, 8 aa, Influenza virus
GLWDSFRQ

SEQ ID NO: 280956 - protein, 8 aa, Influenza virus
LWDSFRQS

SEQ ID NO: 280957 - protein, 8 aa, Influenza virus
WDSFRQSE

SEQ ID NO: 280958 - protein, 8 aa, Influenza virus
DSFRQSER

SEQ ID NO: 280959 - protein, 8 aa, Influenza virus
SFRQSERG

SEQ ID NO: 280960 - protein, 8 aa, Influenza virus
FRQSERGE

SEQ ID NO: 280961 - protein, 8 aa, Influenza virus
RQSERGEE

SEQ ID NO: 280962 - protein, 8 aa, Influenza virus
QSERGEET

SEQ ID NO: 280963 - protein, 8 aa, Influenza virus
SERGEETI

SEQ ID NO: 280964 - protein, 8 aa, Influenza virus
ERGEETIE

SEQ ID NO: 280965 - protein, 8 aa, Influenza virus
RGEETIEE

SEQ ID NO: 280966 - protein, 8 aa, Influenza virus
GEETIEER

SEQ ID NO: 280967 - protein, 8 aa, Influenza virus
EETIEERF

SEQ ID NO: 280968 - protein, 8 aa, Influenza virus
ETIEERFE

SEQ ID NO: 280969 - protein, 8 aa, Influenza virus
RSIEEKFE

SEQ ID NO: 280970 - protein, 8 aa, Influenza virus
TIEERFEI

SEQ ID NO: 280971 - protein, 8 aa, Influenza virus
RLADQSLP

SEQ ID NO: 280972 - protein, 8 aa, Influenza virus
LADQSLPP

SEQ ID NO: 280973 - protein, 8 aa, Influenza virus
ADQSLPPN

SEQ ID NO: 280974 - protein, 8 aa, Influenza virus
DQSLPPNF

SEQ ID NO: 280975 - protein, 8 aa, Influenza virus
QSLPPNFS

SEQ ID NO: 280976 - protein, 8 aa, Influenza virus
SLPPNFSS

SEQ ID NO: 280977 - protein, 8 aa, Influenza virus
NFRAYVDG

SEQ ID NO: 280978 - protein, 8 aa, Influenza virus
FRAYVDGF

SEQ ID NO: 280979 - protein, 8 aa, Influenza virus
RAYVDGFE

SEQ ID NO: 280980 - protein, 8 aa, Influenza virus
AYVDGFEP

SEQ ID NO: 280981 - protein, 8 aa, Influenza virus
YVDGFEPN

SEQ ID NO: 280982 - protein, 8 aa, Influenza virus
VDGFEPNG

SEQ ID NO: 280983 - protein, 8 aa, Influenza virus
DGFEPNGC

SEQ ID NO: 280984 - protein, 8 aa, Influenza virus
GFEPNGCI

SEQ ID NO: 280985 - protein, 8 aa, Influenza virus
FEPNGCIE

SEQ ID NO: 280986 - protein, 8 aa, Influenza virus
EPNGCIEG

SEQ ID NO: 280987 - protein, 8 aa, Influenza virus
PNGCIEGK

SEQ ID NO: 280988 - protein, 8 aa, Influenza virus
NGCIEGKL

SEQ ID NO: 280989 - protein, 8 aa, Influenza virus
GCIEGKLS

SEQ ID NO: 280990 - protein, 8 aa, Influenza virus
CIEGKLSQ

SEQ ID NO: 280991 - protein, 8 aa, Influenza virus
IEGKLSQM

SEQ ID NO: 280992 - protein, 8 aa, Influenza virus
EGKLSQMS

SEQ ID NO: 280993 - protein, 8 aa, Influenza virus
GKLSQMSK

SEQ ID NO: 280994 - protein, 8 aa, Influenza virus
KLSQMSKE

SEQ ID NO: 280995 - protein, 8 aa, Influenza virus
LSQMSKEV

SEQ ID NO: 280996 - protein, 8 aa, Influenza virus
CSQRSKFL

SEQ ID NO: 280997 - protein, 8 aa, Influenza virus
SQRSKFLL

SEQ ID NO: 280998 - protein, 8 aa, Influenza virus
QRSKFLLM

SEQ ID NO: 280999 - protein, 8 aa, Influenza virus
RSKFLLMD

SEQ ID NO: 281000 - protein, 8 aa, Influenza virus
SKFLLMDA

SEQ ID NO: 281001 - protein, 8 aa, Influenza virus
KFLLMDAL

SEQ ID NO: 281002 - protein, 8 aa, Influenza virus
FLLMDALK

SEQ ID NO: 281003 - protein, 8 aa, Influenza virus
LLMDALKL

SEQ ID NO: 281004 - protein, 8 aa, Influenza virus
LMDALKLS

SEQ ID NO: 281005 - protein, 8 aa, Influenza virus
MDALKLSI

SEQ ID NO: 281006 - protein, 8 aa, Influenza virus
DALKLSIE

SEQ ID NO: 281007 - protein, 8 aa, Influenza virus
ALKLSIED

SEQ ID NO: 281008 - protein, 8 aa, Influenza virus
LKLSIEDP

SEQ ID NO: 281009 - protein, 8 aa, Influenza virus
KLSIEDPS

SEQ ID NO: 281010 - protein, 8 aa, Influenza virus
LSIEDPSH

SEQ ID NO: 281011 - protein, 8 aa, Influenza virus
KASKEPEV

SEQ ID NO: 281012 - protein, 8 aa, Influenza virus
ASKEPEVH

SEQ ID NO: 281013 - protein, 8 aa, Influenza virus
SIEDPSHE

SEQ ID NO: 281014 - protein, 8 aa, Influenza virus
IEDPSHEG

SEQ ID NO: 281015 - protein, 8 aa, Influenza virus
EDPSHEGE

SEQ ID NO: 281016 - protein, 8 aa, Influenza virus
DPSHEGEG

SEQ ID NO: 281017 - protein, 8 aa, Influenza virus
PSHEGEGI

SEQ ID NO: 281018 - protein, 8 aa, Influenza virus
SHEGEGIP

SEQ ID NO: 281019 - protein, 8 aa, Influenza virus
HEGEGIPL

SEQ ID NO: 281020 - protein, 8 aa, Influenza virus
EGEGIPLY

SEQ ID NO: 281021 - protein, 8 aa, Influenza virus
GEGIPLYD

SEQ ID NO: 281022 - protein, 8 aa, Influenza virus
EGIPLYDA

SEQ ID NO: 281023 - protein, 8 aa, Influenza virus
GIPLYDAI

SEQ ID NO: 281024 - protein, 8 aa, Influenza virus
IPLYDAIK

SEQ ID NO: 281025 - protein, 8 aa, Influenza virus
PLYDAIKC

SEQ ID NO: 281026 - protein, 8 aa, Influenza virus
KCMKTFFG

SEQ ID NO: 281027 - protein, 8 aa, Influenza virus
CMKTFFGW

SEQ ID NO: 281028 - protein, 8 aa, Influenza virus
MKTFFGWK

SEQ ID NO: 281029 - protein, 8 aa, Influenza virus
KTFFGWKE

SEQ ID NO: 281030 - protein, 8 aa, Influenza virus
TFFGWKEP

SEQ ID NO: 281031 - protein, 8 aa, Influenza virus
LKDEEKIP

SEQ ID NO: 281032 - protein, 8 aa, Influenza virus
LKWALGEN

SEQ ID NO: 281033 - protein, 8 aa, Influenza virus
KWALGENM

SEQ ID NO: 281034 - protein, 8 aa, Influenza virus
WALGENMA

SEQ ID NO: 281035 - protein, 8 aa, Influenza virus
ALGENMAP

SEQ ID NO: 281036 - protein, 8 aa, Influenza virus
LGENMAPE

SEQ ID NO: 281037 - protein, 8 aa, Influenza virus
GENMAPEK

SEQ ID NO: 281038 - protein, 8 aa, Influenza virus
ENMAPEKV

SEQ ID NO: 281039 - protein, 8 aa, Influenza virus
NMAPEKVD

SEQ ID NO: 281040 - protein, 8 aa, Influenza virus
MAPEKVDF

SEQ ID NO: 281041 - protein, 8 aa, Influenza virus
APEKVDFD

SEQ ID NO: 281042 - protein, 8 aa, Influenza virus
WIQSEFNK

SEQ ID NO: 281043 - protein, 8 aa, Influenza virus
IQSEFNKA

SEQ ID NO: 281044 - protein, 8 aa, Influenza virus
QNEFNKAC

SEQ ID NO: 281045 - protein, 8 aa, Influenza virus
NEFNKACE

SEQ ID NO: 281046 - protein, 8 aa, Influenza virus
EFNKACEL

SEQ ID NO: 281047 - protein, 8 aa, Influenza virus
FNKACELT

SEQ ID NO: 281048 - protein, 8 aa, Influenza virus
NKACELTD

SEQ ID NO: 281049 - protein, 8 aa, Influenza virus
KACELTDS

SEQ ID NO: 281050 - protein, 8 aa, Influenza virus
KTAYELTD

SEQ ID NO: 281051 - protein, 8 aa, Influenza virus
TAYELTDS

SEQ ID NO: 281052 - protein, 8 aa, Influenza virus
ACELTDSS

SEQ ID NO: 281053 - protein, 8 aa, Influenza virus
CELTDSSW

SEQ ID NO: 281054 - protein, 8 aa, Influenza virus
WIELDEIG

SEQ ID NO: 281055 - protein, 8 aa, Influenza virus
IELDEIGE

SEQ ID NO: 281056 - protein, 8 aa, Influenza virus
ELDEIGED

SEQ ID NO: 281057 - protein, 8 aa, Influenza virus
LDEIGEDV

SEQ ID NO: 281058 - protein, 8 aa, Influenza virus
DEIGEDVA

SEQ ID NO: 281059 - protein, 8 aa, Influenza virus
EIGEDVAP

SEQ ID NO: 281060 - protein, 8 aa, Influenza virus
IGEDVAPI

SEQ ID NO: 281061 - protein, 8 aa, Influenza virus
GEDVAPIE

SEQ ID NO: 281062 - protein, 8 aa, Influenza virus
EDVAPIEH

SEQ ID NO: 281063 - protein, 8 aa, Influenza virus
APIEHIAS

SEQ ID NO: 281064 - protein, 8 aa, Influenza virus
PIEHIASM

SEQ ID NO: 281065 - protein, 8 aa, Influenza virus
IEHIASMR

SEQ ID NO: 281066 - protein, 8 aa, Influenza virus
EHIASMRR

SEQ ID NO: 281067 - protein, 8 aa, Influenza virus
IASMRRNY

SEQ ID NO: 281068 - protein, 8 aa, Influenza virus
ASMRRNYF

SEQ ID NO: 281069 - protein, 8 aa, Influenza virus
SMRRNYFT

SEQ ID NO: 281070 - protein, 8 aa, Influenza virus
RRNYFTAE

SEQ ID NO: 281071 - protein, 8 aa, Influenza virus
RNYFTAEV

SEQ ID NO: 281072 - protein, 8 aa, Influenza virus
NYFTAEVS

SEQ ID NO: 281073 - protein, 8 aa, Influenza virus
YFTAEVSH

SEQ ID NO: 281074 - protein, 8 aa, Influenza virus
FTAEVSHC

SEQ ID NO: 281075 - protein, 8 aa, Influenza virus
TAEVSHCR

SEQ ID NO: 281076 - protein, 8 aa, Influenza virus
AEVSHCRA

SEQ ID NO: 281077 - protein, 8 aa, Influenza virus
EVSHCRAT

SEQ ID NO: 281078 - protein, 8 aa, Influenza virus
VSHCRATE

SEQ ID NO: 281079 - protein, 8 aa, Influenza virus
ISKSRATE

SEQ ID NO: 281080 - protein, 8 aa, Influenza virus
SHCRATEY

SEQ ID NO: 281081 - protein, 8 aa, Influenza virus
HCRATEYI

SEQ ID NO: 281082 - protein, 8 aa, Influenza virus
CRATEYIM

SEQ ID NO: 281083 - protein, 8 aa, Influenza virus
RATEYIMK

SEQ ID NO: 281084 - protein, 8 aa, Influenza virus
ATEYIMKG

SEQ ID NO: 281085 - protein, 8 aa, Influenza virus
TEYIMKGV

SEQ ID NO: 281086 - protein, 8 aa, Influenza virus
EYIMKGVY

SEQ ID NO: 281087 - protein, 8 aa, Influenza virus
MKGVYINT

SEQ ID NO: 281088 - protein, 8 aa, Influenza virus
KGVYINTA

SEQ ID NO: 281089 - protein, 8 aa, Influenza virus
GVYINTAL

SEQ ID NO: 281090 - protein, 8 aa, Influenza virus
VYINTALL

SEQ ID NO: 281091 - protein, 8 aa, Influenza virus
YINTALLN

SEQ ID NO: 281092 - protein, 8 aa, Influenza virus
INTALLNA

SEQ ID NO: 281093 - protein, 8 aa, Influenza virus
NTALLNAS

SEQ ID NO: 281094 - protein, 8 aa, Influenza virus
TALLNASC

SEQ ID NO: 281095 - protein, 8 aa, Influenza virus
ALLNASCA

SEQ ID NO: 281096 - protein, 8 aa, Influenza virus
LLNASCAA

SEQ ID NO: 281097 - protein, 8 aa, Influenza virus
LNASCAAM

SEQ ID NO: 281098 - protein, 8 aa, Influenza virus
NASCAAMD

SEQ ID NO: 281099 - protein, 8 aa, Influenza virus
ASCAAMDD

SEQ ID NO: 281100 - protein, 8 aa, Influenza virus
SCAAMDDF

SEQ ID NO: 281101 - protein, 8 aa, Influenza virus
CAAMDDFQ

SEQ ID NO: 281102 - protein, 8 aa, Influenza virus
AAMDDFQL

SEQ ID NO: 281103 - protein, 8 aa, Influenza virus
AMDDFQLI

SEQ ID NO: 281104 - protein, 8 aa, Influenza virus
MDDFQLIP

SEQ ID NO: 281105 - protein, 8 aa, Influenza virus
DDFQLIPM

SEQ ID NO: 281106 - protein, 8 aa, Influenza virus
DFQLIPMI

SEQ ID NO: 281107 - protein, 8 aa, Influenza virus
FQLIPMIS

SEQ ID NO: 281108 - protein, 8 aa, Influenza virus
QLIPMISK

SEQ ID NO: 281109 - protein, 8 aa, Influenza virus
LIPMISKC

SEQ ID NO: 281110 - protein, 8 aa, Influenza virus
IPMISKCR

SEQ ID NO: 281111 - protein, 8 aa, Influenza virus
PMISKCRT

SEQ ID NO: 281112 - protein, 8 aa, Influenza virus
MISKCRTK

SEQ ID NO: 281113 - protein, 8 aa, Influenza virus
ISKCRTKE

SEQ ID NO: 281114 - protein, 8 aa, Influenza virus
SKCRTKEG

SEQ ID NO: 281115 - protein, 8 aa, Influenza virus
KCRTKEGR

SEQ ID NO: 281116 - protein, 8 aa, Influenza virus
CRTKEGRR

SEQ ID NO: 281117 - protein, 8 aa, Influenza virus
RTKEGRRK

SEQ ID NO: 281118 - protein, 8 aa, Influenza virus
TKEGRRKT

SEQ ID NO: 281119 - protein, 8 aa, Influenza virus
KEGRRKTN

SEQ ID NO: 281120 - protein, 8 aa, Influenza virus
EGRRKTNL

SEQ ID NO: 281121 - protein, 8 aa, Influenza virus
GRRKTNLY

SEQ ID NO: 281122 - protein, 8 aa, Influenza virus
RRKTNLYG

SEQ ID NO: 281123 - protein, 8 aa, Influenza virus
RKTNLYGF

SEQ ID NO: 281124 - protein, 8 aa, Influenza virus
KTNLYGFI

SEQ ID NO: 281125 - protein, 8 aa, Influenza virus
TNLYGFII

SEQ ID NO: 281126 - protein, 8 aa, Influenza virus
NLYGFIIK

SEQ ID NO: 281127 - protein, 8 aa, Influenza virus
LYGFIIKG

SEQ ID NO: 281128 - protein, 8 aa, Influenza virus
YGFIIKGR

SEQ ID NO: 281129 - protein, 8 aa, Influenza virus
GFIIKGRS

SEQ ID NO: 281130 - protein, 8 aa, Influenza virus
FIIKGRSH

SEQ ID NO: 281131 - protein, 8 aa, Influenza virus
IIKGRSHL

SEQ ID NO: 281132 - protein, 8 aa, Influenza virus
IKGRSHLR

SEQ ID NO: 281133 - protein, 8 aa, Influenza virus
KGRSHLRN

SEQ ID NO: 281134 - protein, 8 aa, Influenza virus
GRSHLRND

SEQ ID NO: 281135 - protein, 8 aa, Influenza virus
RSHLRNDT

SEQ ID NO: 281136 - protein, 8 aa, Influenza virus
SHLRNDTD

SEQ ID NO: 281137 - protein, 8 aa, Influenza virus
HLRNDTDV

SEQ ID NO: 281138 - protein, 8 aa, Influenza virus
LRNDTDVV

SEQ ID NO: 281139 - protein, 8 aa, Influenza virus
RNDTDVVN

SEQ ID NO: 281140 - protein, 8 aa, Influenza virus
NDTDVVNF

SEQ ID NO: 281141 - protein, 8 aa, Influenza virus
DTDVVNFV

SEQ ID NO: 281142 - protein, 8 aa, Influenza virus
TDVVNFVS

SEQ ID NO: 281143 - protein, 8 aa, Influenza virus
DVVNFVSM

SEQ ID NO: 281144 - protein, 8 aa, Influenza virus
GSLNFVSM

SEQ ID NO: 281145 - protein, 8 aa, Influenza virus
VVNFVSME

SEQ ID NO: 281146 - protein, 8 aa, Influenza virus
VNFVSMEF

SEQ ID NO: 281147 - protein, 8 aa, Influenza virus
NFVSMEFS

SEQ ID NO: 281148 - protein, 8 aa, Influenza virus
FVSMEFSL

SEQ ID NO: 281149 - protein, 8 aa, Influenza virus
VSMEFSLT

SEQ ID NO: 281150 - protein, 8 aa, Influenza virus
SMEFSLTD

SEQ ID NO: 281151 - protein, 8 aa, Influenza virus
MEFSLTDP

SEQ ID NO: 281152 - protein, 8 aa, Influenza virus
EFSLTDPR

SEQ ID NO: 281153 - protein, 8 aa, Influenza virus
FSLTDPRL

SEQ ID NO: 281154 - protein, 8 aa, Influenza virus
SLTDPRLE

SEQ ID NO: 281155 - protein, 8 aa, Influenza virus
PHKWEKYC

SEQ ID NO: 281156 - protein, 8 aa, Influenza virus
HKWEKYCV

SEQ ID NO: 281157 - protein, 8 aa, Influenza virus
KWEKYCVL

SEQ ID NO: 281158 - protein, 8 aa, Influenza virus
WEKYCVLE

SEQ ID NO: 281159 - protein, 8 aa, Influenza virus
PMFLYVRT

SEQ ID NO: 281160 - protein, 8 aa, Influenza virus
MFLYVRTN

SEQ ID NO: 281161 - protein, 8 aa, Influenza virus
FLYVRTNG

SEQ ID NO: 281162 - protein, 8 aa, Influenza virus
LYVRTNGT

SEQ ID NO: 281163 - protein, 8 aa, Influenza virus
YVRTNGTS

SEQ ID NO: 281164 - protein, 8 aa, Influenza virus
VRTNGTSK

SEQ ID NO: 281165 - protein, 8 aa, Influenza virus
RTNGTSKI

SEQ ID NO: 281166 - protein, 8 aa, Influenza virus
TNGTSKIK

SEQ ID NO: 281167 - protein, 8 aa, Influenza virus
NGTSKIKM

SEQ ID NO: 281168 - protein, 8 aa, Influenza virus
GTSKIKMK

SEQ ID NO: 281169 - protein, 8 aa, Influenza virus
TSKIKMKW

SEQ ID NO: 281170 - protein, 8 aa, Influenza virus
SKIKMKWG

SEQ ID NO: 281171 - protein, 8 aa, Influenza virus
KIKMKWGM

SEQ ID NO: 281172 - protein, 8 aa, Influenza virus
IKMKWGME

SEQ ID NO: 281173 - protein, 8 aa, Influenza virus
KMKWGMEM

SEQ ID NO: 281174 - protein, 8 aa, Influenza virus
MKWGMEMR

SEQ ID NO: 281175 - protein, 8 aa, Influenza virus
KWGMEMRR

SEQ ID NO: 281176 - protein, 8 aa, Influenza virus
WGMEMRRC

SEQ ID NO: 281177 - protein, 8 aa, Influenza virus
GMEMRRCL

SEQ ID NO: 281178 - protein, 8 aa, Influenza virus
MEMRRCLL

SEQ ID NO: 281179 - protein, 8 aa, Influenza virus
EMRRCLLQ

SEQ ID NO: 281180 - protein, 8 aa, Influenza virus
MRRCLLQS

SEQ ID NO: 281181 - protein, 8 aa, Influenza virus
RRCLLQSL

SEQ ID NO: 281182 - protein, 8 aa, Influenza virus
RCLLQSLQ

SEQ ID NO: 281183 - protein, 8 aa, Influenza virus
CLLQSLQQ

SEQ ID NO: 281184 - protein, 8 aa, Influenza virus
LLQSLQQI

SEQ ID NO: 281185 - protein, 8 aa, Influenza virus
LQSLQQIE

SEQ ID NO: 281186 - protein, 8 aa, Influenza virus
QSLQQIES

SEQ ID NO: 281187 - protein, 8 aa, Influenza virus
SLQQIESM

SEQ ID NO: 281188 - protein, 8 aa, Influenza virus
LQQIESMI

SEQ ID NO: 281189 - protein, 8 aa, Influenza virus
QQIESMIE

SEQ ID NO: 281190 - protein, 8 aa, Influenza virus
QIESMIEA

SEQ ID NO: 281191 - protein, 8 aa, Influenza virus
IESMIEAE

SEQ ID NO: 281192 - protein, 8 aa, Influenza virus
ESMIEAES

SEQ ID NO: 281193 - protein, 8 aa, Influenza virus
SMIEAESS

SEQ ID NO: 281194 - protein, 8 aa, Influenza virus
MIEAESSV

SEQ ID NO: 281195 - protein, 8 aa, Influenza virus
IEAESSVK

SEQ ID NO: 281196 - protein, 8 aa, Influenza virus
EAESSVKE

SEQ ID NO: 281197 - protein, 8 aa, Influenza virus
AESSVKEK

SEQ ID NO: 281198 - protein, 8 aa, Influenza virus
ESSVKEKD

SEQ ID NO: 281199 - protein, 8 aa, Influenza virus
SSVKEKDM

SEQ ID NO: 281200 - protein, 8 aa, Influenza virus
SVKEKDMT

SEQ ID NO: 281201 - protein, 8 aa, Influenza virus
VKEKDMTK

SEQ ID NO: 281202 - protein, 8 aa, Influenza virus
KEKDMTKE

SEQ ID NO: 281203 - protein, 8 aa, Influenza virus
EKDMTKEF

SEQ ID NO: 281204 - protein, 8 aa, Influenza virus
KDMTKEFF

SEQ ID NO: 281205 - protein, 8 aa, Influenza virus
DMTKEFFE

SEQ ID NO: 281206 - protein, 8 aa, Influenza virus
ETWPIGES

SEQ ID NO: 281207 - protein, 8 aa, Influenza virus
TWPIGESP

SEQ ID NO: 281208 - protein, 8 aa, Influenza virus
WPIGESPK

SEQ ID NO: 281209 - protein, 8 aa, Influenza virus
PIGESPKG

SEQ ID NO: 281210 - protein, 8 aa, Influenza virus
GESPKGVE

SEQ ID NO: 281211 - protein, 8 aa, Influenza virus
GVEEGSIG

SEQ ID NO: 281212 - protein, 8 aa, Influenza virus
VEEGSIGK

SEQ ID NO: 281213 - protein, 8 aa, Influenza virus
EEGSIGKV

SEQ ID NO: 281214 - protein, 8 aa, Influenza virus
EGSIGKVC

SEQ ID NO: 281215 - protein, 8 aa, Influenza virus
GSIGKVCR

SEQ ID NO: 281216 - protein, 8 aa, Influenza virus
SIGKVCRT

SEQ ID NO: 281217 - protein, 8 aa, Influenza virus
IGKVCRTL

SEQ ID NO: 281218 - protein, 8 aa, Influenza virus
GKVCRTLL

SEQ ID NO: 281219 - protein, 8 aa, Influenza virus
KVCRTLLA

SEQ ID NO: 281220 - protein, 8 aa, Influenza virus
VCRTLLAK

SEQ ID NO: 281221 - protein, 8 aa, Influenza virus
CRTLLAKS

SEQ ID NO: 281222 - protein, 8 aa, Influenza virus
RTLLAKSV

SEQ ID NO: 281223 - protein, 8 aa, Influenza virus
TLLAKSVF

SEQ ID NO: 281224 - protein, 8 aa, Influenza virus
LLAKSVFN

SEQ ID NO: 281225 - protein, 8 aa, Influenza virus
LAKSVFNS

SEQ ID NO: 281226 - protein, 8 aa, Influenza virus
AKSVFNSL

SEQ ID NO: 281227 - protein, 8 aa, Influenza virus
KSVFNSLY

SEQ ID NO: 281228 - protein, 8 aa, Influenza virus
SVFNSLYA

SEQ ID NO: 281229 - protein, 8 aa, Influenza virus
VFNSLYAS

SEQ ID NO: 281230 - protein, 8 aa, Influenza virus
FNSLYASP

SEQ ID NO: 281231 - protein, 8 aa, Influenza virus
NSLYASPQ

SEQ ID NO: 281232 - protein, 8 aa, Influenza virus
SLYASPQL

SEQ ID NO: 281233 - protein, 8 aa, Influenza virus
LYASPQLE

SEQ ID NO: 281234 - protein, 8 aa, Influenza virus
YASPQLEG

SEQ ID NO: 281235 - protein, 8 aa, Influenza virus
ASPQLEGF

SEQ ID NO: 281236 - protein, 8 aa, Influenza virus
SPQLEGFS

SEQ ID NO: 281237 - protein, 8 aa, Influenza virus
PQLEGFSA

SEQ ID NO: 281238 - protein, 8 aa, Influenza virus
QLEGFSAE

SEQ ID NO: 281239 - protein, 8 aa, Influenza virus
LEGFSAES

SEQ ID NO: 281240 - protein, 8 aa, Influenza virus
EGFSAESR

SEQ ID NO: 281241 - protein, 8 aa, Influenza virus
GFSAESRK

SEQ ID NO: 281242 - protein, 8 aa, Influenza virus
FSAESRKL

SEQ ID NO: 281243 - protein, 8 aa, Influenza virus
SAESRKLL

SEQ ID NO: 281244 - protein, 8 aa, Influenza virus
AESRKLLL

SEQ ID NO: 281245 - protein, 8 aa, Influenza virus
ESRKLLLI

SEQ ID NO: 281246 - protein, 8 aa, Influenza virus
SRKLLLIV

SEQ ID NO: 281247 - protein, 8 aa, Influenza virus
RKLLLIVQ

SEQ ID NO: 281248 - protein, 8 aa, Influenza virus
KLLLIVQA

SEQ ID NO: 281249 - protein, 8 aa, Influenza virus
LLLIVQAL

SEQ ID NO: 281250 - protein, 8 aa, Influenza virus
LLIVQALR

SEQ ID NO: 281251 - protein, 8 aa, Influenza virus
LIVQALRD

SEQ ID NO: 281252 - protein, 8 aa, Influenza virus
QALRDNLE

SEQ ID NO: 281253 - protein, 8 aa, Influenza virus
ALRDNLEP

SEQ ID NO: 281254 - protein, 8 aa, Influenza virus
LRDNLEPG

SEQ ID NO: 281255 - protein, 8 aa, Influenza virus
RDNLEPGT

SEQ ID NO: 281256 - protein, 8 aa, Influenza virus
DNLEPGTF

SEQ ID NO: 281257 - protein, 8 aa, Influenza virus
NLEPGTFD

SEQ ID NO: 281258 - protein, 8 aa, Influenza virus
LEPGTFDL

SEQ ID NO: 281259 - protein, 8 aa, Influenza virus
EPGTFDLG

SEQ ID NO: 281260 - protein, 8 aa, Influenza virus
PGTFDLGG

SEQ ID NO: 281261 - protein, 8 aa, Influenza virus
GTFDLGGL

SEQ ID NO: 281262 - protein, 8 aa, Influenza virus
TFDLGGLY

SEQ ID NO: 281263 - protein, 8 aa, Influenza virus
GLYEAIEE

SEQ ID NO: 281264 - protein, 8 aa, Influenza virus
LYEAIEEC

SEQ ID NO: 281265 - protein, 8 aa, Influenza virus
YEAIEECL

SEQ ID NO: 281266 - protein, 8 aa, Influenza virus
EAIEECLI

SEQ ID NO: 281267 - protein, 8 aa, Influenza virus
AIEECLIN

SEQ ID NO: 281268 - protein, 8 aa, Influenza virus
IEECLIND

SEQ ID NO: 281269 - protein, 8 aa, Influenza virus
EECLINDP

SEQ ID NO: 281270 - protein, 8 aa, Influenza virus
ECLINDPW

SEQ ID NO: 281271 - protein, 8 aa, Influenza virus
CLINDPWV

SEQ ID NO: 281272 - protein, 8 aa, Influenza virus
LINDPWVL

SEQ ID NO: 281273 - protein, 8 aa, Influenza virus
INDPWVLL

SEQ ID NO: 281274 - protein, 8 aa, Influenza virus
NDPWVLLN

SEQ ID NO: 281275 - protein, 8 aa, Influenza virus
DPWVLLNA

SEQ ID NO: 281276 - protein, 8 aa, Influenza virus
PWVLLNAS

SEQ ID NO: 281277 - protein, 8 aa, Influenza virus
WVLLNASW

SEQ ID NO: 281278 - protein, 8 aa, Influenza virus
VLLNASWF

SEQ ID NO: 281279 - protein, 8 aa, Influenza virus
LLNASWFN

SEQ ID NO: 281280 - protein, 8 aa, Influenza virus
LNASWFNS

SEQ ID NO: 281281 - protein, 8 aa, Influenza virus
NASWFNSF

SEQ ID NO: 281282 - protein, 8 aa, Influenza virus
ASWFNSFL

SEQ ID NO: 281283 - protein, 8 aa, Influenza virus
SWFNSFLT

SEQ ID NO: 281284 - protein, 8 aa, Influenza virus
WFNSFLTH

SEQ ID NO: 281285 - protein, 8 aa, Influenza virus
SLTHALRE

SEQ ID NO: 281286 - protein, 8 aa, Influenza virus
LTHALREL

SEQ ID NO: 281287 - protein, 8 aa, Influenza virus
THALRELW

SEQ ID NO: 281288 - protein, 8 aa, Influenza virus
HALRELWQ

SEQ ID NO: 281289 - protein, 8 aa, Influenza virus
ALRELWQC

SEQ ID NO: 281290 - protein, 8 aa, Influenza virus
LRELWQCY

SEQ ID NO: 281291 - protein, 8 aa, Influenza virus
RELWQCYY

SEQ ID NO: 281292 - protein, 8 aa, Influenza virus
ELWQCYYL

SEQ ID NO: 281293 - protein, 8 aa, Influenza virus
LWQCYYLL

SEQ ID NO: 281294 - protein, 8 aa, Influenza virus
MDVNPTLL

SEQ ID NO: 281295 - protein, 8 aa, Influenza virus
DVNPTLLF

SEQ ID NO: 281296 - protein, 8 aa, Influenza virus
VNPTLLFL

SEQ ID NO: 281297 - protein, 8 aa, Influenza virus
INPTLLFL

SEQ ID NO: 281298 - protein, 8 aa, Influenza virus
NPTLLFLK

SEQ ID NO: 281299 - protein, 8 aa, Influenza virus
PTLLFLKV

SEQ ID NO: 281300 - protein, 8 aa, Influenza virus
TLLFLKVP

SEQ ID NO: 281301 - protein, 8 aa, Influenza virus
LLFLKVPA

SEQ ID NO: 281302 - protein, 8 aa, Influenza virus
YFFLKVPV

SEQ ID NO: 281303 - protein, 8 aa, Influenza virus
LFLKVPAQ

SEQ ID NO: 281304 - protein, 8 aa, Influenza virus
FLKVPAQN

SEQ ID NO: 281305 - protein, 8 aa, Influenza virus
LKVPAQNA

SEQ ID NO: 281306 - protein, 8 aa, Influenza virus
KVPAQNAI

SEQ ID NO: 281307 - protein, 8 aa, Influenza virus
VPAQNAIS

SEQ ID NO: 281308 - protein, 8 aa, Influenza virus
PAQNAIST

SEQ ID NO: 281309 - protein, 8 aa, Influenza virus
AQNAISTT

SEQ ID NO: 281310 - protein, 8 aa, Influenza virus
QNAISTTF

SEQ ID NO: 281311 - protein, 8 aa, Influenza virus
NAISTTFP

SEQ ID NO: 281312 - protein, 8 aa, Influenza virus
AISTTFPY

SEQ ID NO: 281313 - protein, 8 aa, Influenza virus
ISTTFPYT

SEQ ID NO: 281314 - protein, 8 aa, Influenza virus
STTFPYTG

SEQ ID NO: 281315 - protein, 8 aa, Influenza virus
TTFPYTGD

SEQ ID NO: 281316 - protein, 8 aa, Influenza virus
TFPYTGDP

SEQ ID NO: 281317 - protein, 8 aa, Influenza virus
FPYTGDPP

SEQ ID NO: 281318 - protein, 8 aa, Influenza virus
PYTGDPPY

SEQ ID NO: 281319 - protein, 8 aa, Influenza virus
YTGDPPYS

SEQ ID NO: 281320 - protein, 8 aa, Influenza virus
TGDPPYSH

SEQ ID NO: 281321 - protein, 8 aa, Influenza virus
GDPPYSHG

SEQ ID NO: 281322 - protein, 8 aa, Influenza virus
DPPYSHGT

SEQ ID NO: 281323 - protein, 8 aa, Influenza virus
PPYSHGTG

SEQ ID NO: 281324 - protein, 8 aa, Influenza virus
PYSHGTGT

SEQ ID NO: 281325 - protein, 8 aa, Influenza virus
YSHGTGTG

SEQ ID NO: 281326 - protein, 8 aa, Influenza virus
SHGTGTGY

SEQ ID NO: 281327 - protein, 8 aa, Influenza virus
HGTGTGYT

SEQ ID NO: 281328 - protein, 8 aa, Influenza virus
GTGTGYTM

SEQ ID NO: 281329 - protein, 8 aa, Influenza virus
TGTGYTMD

SEQ ID NO: 281330 - protein, 8 aa, Influenza virus
GTGYTMDT

SEQ ID NO: 281331 - protein, 8 aa, Influenza virus
TGYTMDTV

SEQ ID NO: 281332 - protein, 8 aa, Influenza virus
GYTMDTVN

SEQ ID NO: 281333 - protein, 8 aa, Influenza virus
YTMDTVNR

SEQ ID NO: 281334 - protein, 8 aa, Influenza virus
TMDTVNRT

SEQ ID NO: 281335 - protein, 8 aa, Influenza virus
MDTVNRTH

SEQ ID NO: 281336 - protein, 8 aa, Influenza virus
DTVNRTHQ

SEQ ID NO: 281337 - protein, 8 aa, Influenza virus
TVNRTHQY

SEQ ID NO: 281338 - protein, 8 aa, Influenza virus
VNRTHQYS

SEQ ID NO: 281339 - protein, 8 aa, Influenza virus
NRTHQYSE

SEQ ID NO: 281340 - protein, 8 aa, Influenza virus
RTHQYSEK

SEQ ID NO: 281341 - protein, 8 aa, Influenza virus
THQYSEKG

SEQ ID NO: 281342 - protein, 8 aa, Influenza virus
HQYSEKGK

SEQ ID NO: 281343 - protein, 8 aa, Influenza virus
QYSEKGKW

SEQ ID NO: 281344 - protein, 8 aa, Influenza virus
NTETGAPQ

SEQ ID NO: 281345 - protein, 8 aa, Influenza virus
TETGAPQL

SEQ ID NO: 281346 - protein, 8 aa, Influenza virus
ETGAPQLN

SEQ ID NO: 281347 - protein, 8 aa, Influenza virus
TGAPQLNP

SEQ ID NO: 281348 - protein, 8 aa, Influenza virus
GAPQLNPI

SEQ ID NO: 281349 - protein, 8 aa, Influenza virus
APQLNPID

SEQ ID NO: 281350 - protein, 8 aa, Influenza virus
PQLNPIDG

SEQ ID NO: 281351 - protein, 8 aa, Influenza virus
QLNPIDGP

SEQ ID NO: 281352 - protein, 8 aa, Influenza virus
LNPIDGPL

SEQ ID NO: 281353 - protein, 8 aa, Influenza virus
NPIDGPLP

SEQ ID NO: 281354 - protein, 8 aa, Influenza virus
PIDGPLPE

SEQ ID NO: 281355 - protein, 8 aa, Influenza virus
DNEPSGYA

SEQ ID NO: 281356 - protein, 8 aa, Influenza virus
NEPSGYAQ

SEQ ID NO: 281357 - protein, 8 aa, Influenza virus
EPSGYAQT

SEQ ID NO: 281358 - protein, 8 aa, Influenza virus
PSGYAQTD

SEQ ID NO: 281359 - protein, 8 aa, Influenza virus
SGYAQTDC

SEQ ID NO: 281360 - protein, 8 aa, Influenza virus
GYAQTDCV

SEQ ID NO: 281361 - protein, 8 aa, Influenza virus
YAQTDCVL

SEQ ID NO: 281362 - protein, 8 aa, Influenza virus
AQTDCVLE

SEQ ID NO: 281363 - protein, 8 aa, Influenza virus
QTDCVLEA

SEQ ID NO: 281364 - protein, 8 aa, Influenza virus
TDCVLEAM

SEQ ID NO: 281365 - protein, 8 aa, Influenza virus
DCVLEAMA

SEQ ID NO: 281366 - protein, 8 aa, Influenza virus
CVLEAMAF

SEQ ID NO: 281367 - protein, 8 aa, Influenza virus
VLEAMAFL

SEQ ID NO: 281368 - protein, 8 aa, Influenza virus
LEAMAFLE

SEQ ID NO: 281369 - protein, 8 aa, Influenza virus
EAMAFLEE

SEQ ID NO: 281370 - protein, 8 aa, Influenza virus
AMAFLEES

SEQ ID NO: 281371 - protein, 8 aa, Influenza virus
MAFLEESH

SEQ ID NO: 281372 - protein, 8 aa, Influenza virus
AFLEESHP

SEQ ID NO: 281373 - protein, 8 aa, Influenza virus
FLEESHPG

SEQ ID NO: 281374 - protein, 8 aa, Influenza virus
LEESHPGI

SEQ ID NO: 281375 - protein, 8 aa, Influenza virus
EESHPGIF

SEQ ID NO: 281376 - protein, 8 aa, Influenza virus
ESHPGIFE

SEQ ID NO: 281377 - protein, 8 aa, Influenza virus
SHPGIFEN

SEQ ID NO: 281378 - protein, 8 aa, Influenza virus
HPGIFENS

SEQ ID NO: 281379 - protein, 8 aa, Influenza virus
PGIFENSC

SEQ ID NO: 281380 - protein, 8 aa, Influenza virus
GIFENSCL

SEQ ID NO: 281381 - protein, 8 aa, Influenza virus
IFENSCLE

SEQ ID NO: 281382 - protein, 8 aa, Influenza virus
FENSCLET

SEQ ID NO: 281383 - protein, 8 aa, Influenza virus
NSCLETME

SEQ ID NO: 281384 - protein, 8 aa, Influenza virus
VQQTRVDK

SEQ ID NO: 281385 - protein, 8 aa, Influenza virus
QQTRVDKL

SEQ ID NO: 281386 - protein, 8 aa, Influenza virus
QTRVDKLT

SEQ ID NO: 281387 - protein, 8 aa, Influenza virus
TRVDKLTQ

SEQ ID NO: 281388 - protein, 8 aa, Influenza virus
RVDKLTQG

SEQ ID NO: 281389 - protein, 8 aa, Influenza virus
VDKLTQGR

SEQ ID NO: 281390 - protein, 8 aa, Influenza virus
DKLTQGRQ

SEQ ID NO: 281391 - protein, 8 aa, Influenza virus
KLTQGRQT

SEQ ID NO: 281392 - protein, 8 aa, Influenza virus
LTQGRQTY

SEQ ID NO: 281393 - protein, 8 aa, Influenza virus
TQGRQTYD

SEQ ID NO: 281394 - protein, 8 aa, Influenza virus
QGRQTYDW

SEQ ID NO: 281395 - protein, 8 aa, Influenza virus
GRQTYDWT

SEQ ID NO: 281396 - protein, 8 aa, Influenza virus
RQTYDWTL

SEQ ID NO: 281397 - protein, 8 aa, Influenza virus
QTYDWTLN

SEQ ID NO: 281398 - protein, 8 aa, Influenza virus
TYDWTLNR

SEQ ID NO: 281399 - protein, 8 aa, Influenza virus
YDWTLNRN

SEQ ID NO: 281400 - protein, 8 aa, Influenza virus
DWTLNRNQ

SEQ ID NO: 281401 - protein, 8 aa, Influenza virus
WTLNRNQP

SEQ ID NO: 281402 - protein, 8 aa, Influenza virus
TLNRNQPA

SEQ ID NO: 281403 - protein, 8 aa, Influenza virus
LNRNQPAA

SEQ ID NO: 281404 - protein, 8 aa, Influenza virus
NRNQPAAT

SEQ ID NO: 281405 - protein, 8 aa, Influenza virus
RNQPAATA

SEQ ID NO: 281406 - protein, 8 aa, Influenza virus
NQPAATAL

SEQ ID NO: 281407 - protein, 8 aa, Influenza virus
QPAATALA

SEQ ID NO: 281408 - protein, 8 aa, Influenza virus
PAATALAN

SEQ ID NO: 281409 - protein, 8 aa, Influenza virus
AATALANT

SEQ ID NO: 281410 - protein, 8 aa, Influenza virus
ATALANTI

SEQ ID NO: 281411 - protein, 8 aa, Influenza virus
TALANTIE

SEQ ID NO: 281412 - protein, 8 aa, Influenza virus
ALANTIEV

SEQ ID NO: 281413 - protein, 8 aa, Influenza virus
LANTIEVF

SEQ ID NO: 281414 - protein, 8 aa, Influenza virus
ANTIEVFR

SEQ ID NO: 281415 - protein, 8 aa, Influenza virus
NTIEVFRS

SEQ ID NO: 281416 - protein, 8 aa, Influenza virus
TIEVFRSN

SEQ ID NO: 281417 - protein, 8 aa, Influenza virus
NESGRLID

SEQ ID NO: 281418 - protein, 8 aa, Influenza virus
ESGRLIDF

SEQ ID NO: 281419 - protein, 8 aa, Influenza virus
SGRLIDFL

SEQ ID NO: 281420 - protein, 8 aa, Influenza virus
GRLIDFLK

SEQ ID NO: 281421 - protein, 8 aa, Influenza virus
RLIDFLKD

SEQ ID NO: 281422 - protein, 8 aa, Influenza virus
LIDFLKDV

SEQ ID NO: 281423 - protein, 8 aa, Influenza virus
IDFLKDVM

SEQ ID NO: 281424 - protein, 8 aa, Influenza virus
EITTHFQR

SEQ ID NO: 281425 - protein, 8 aa, Influenza virus
ITTHFQRK

SEQ ID NO: 281426 - protein, 8 aa, Influenza virus
TTHFQRKR

SEQ ID NO: 281427 - protein, 8 aa, Influenza virus
THFQRKRR

SEQ ID NO: 281428 - protein, 8 aa, Influenza virus
HFQRKRRV

SEQ ID NO: 281429 - protein, 8 aa, Influenza virus
FQRKRRVR

SEQ ID NO: 281430 - protein, 8 aa, Influenza virus
QRKRRVRD

SEQ ID NO: 281431 - protein, 8 aa, Influenza virus
RKRRVRDN

SEQ ID NO: 281432 - protein, 8 aa, Influenza virus
KRRVRDNM

SEQ ID NO: 281433 - protein, 8 aa, Influenza virus
RRVRDNMT

SEQ ID NO: 281434 - protein, 8 aa, Influenza virus
RVRDNMTK

SEQ ID NO: 281435 - protein, 8 aa, Influenza virus
RDNMTKKM

SEQ ID NO: 281436 - protein, 8 aa, Influenza virus
TKKMVTQR

SEQ ID NO: 281437 - protein, 8 aa, Influenza virus
KKMVTQRT

SEQ ID NO: 281438 - protein, 8 aa, Influenza virus
KMVTQRTI

SEQ ID NO: 281439 - protein, 8 aa, Influenza virus
MVTQRTIG

SEQ ID NO: 281440 - protein, 8 aa, Influenza virus
VTQRTIGK

SEQ ID NO: 281441 - protein, 8 aa, Influenza virus
TQRTIGKK

SEQ ID NO: 281442 - protein, 8 aa, Influenza virus
QRTIGKKK

SEQ ID NO: 281443 - protein, 8 aa, Influenza virus
RTIGKKKQ

SEQ ID NO: 281444 - protein, 8 aa, Influenza virus
SYLIRALT

SEQ ID NO: 281445 - protein, 8 aa, Influenza virus
YLIRALTL

SEQ ID NO: 281446 - protein, 8 aa, Influenza virus
LIRALTLN

SEQ ID NO: 281447 - protein, 8 aa, Influenza virus
IRALTLNT

SEQ ID NO: 281448 - protein, 8 aa, Influenza virus
RALTLNTM

SEQ ID NO: 281449 - protein, 8 aa, Influenza virus
ALTLNTMT

SEQ ID NO: 281450 - protein, 8 aa, Influenza virus
LTLNTMTK

SEQ ID NO: 281451 - protein, 8 aa, Influenza virus
TLNTMTKD

SEQ ID NO: 281452 - protein, 8 aa, Influenza virus
LNTMTKDA

SEQ ID NO: 281453 - protein, 8 aa, Influenza virus
NTMTKDAE

SEQ ID NO: 281454 - protein, 8 aa, Influenza virus
TMTKDAER

SEQ ID NO: 281455 - protein, 8 aa, Influenza virus
MTKDAERG

SEQ ID NO: 281456 - protein, 8 aa, Influenza virus
TKDAERGK

SEQ ID NO: 281457 - protein, 8 aa, Influenza virus
KDAERGKL

SEQ ID NO: 281458 - protein, 8 aa, Influenza virus
DAERGKLK

SEQ ID NO: 281459 - protein, 8 aa, Influenza virus
AERGKLKR

SEQ ID NO: 281460 - protein, 8 aa, Influenza virus
ERGKLKRR

SEQ ID NO: 281461 - protein, 8 aa, Influenza virus
RGKLKRRA

SEQ ID NO: 281462 - protein, 8 aa, Influenza virus
GKLKRRAI

SEQ ID NO: 281463 - protein, 8 aa, Influenza virus
KLKRRAIA

SEQ ID NO: 281464 - protein, 8 aa, Influenza virus
LKRRAIAT

SEQ ID NO: 281465 - protein, 8 aa, Influenza virus
KRRAIATP

SEQ ID NO: 281466 - protein, 8 aa, Influenza virus
RRAIATPG

SEQ ID NO: 281467 - protein, 8 aa, Influenza virus
RAIATPGM

SEQ ID NO: 281468 - protein, 8 aa, Influenza virus
AIATPGMQ

SEQ ID NO: 281469 - protein, 8 aa, Influenza virus
IATPGMQI

SEQ ID NO: 281470 - protein, 8 aa, Influenza virus
ATPGMQIR

SEQ ID NO: 281471 - protein, 8 aa, Influenza virus
TPGMQIRG

SEQ ID NO: 281472 - protein, 8 aa, Influenza virus
PGMQIRGF

SEQ ID NO: 281473 - protein, 8 aa, Influenza virus
GMQIRGFV

SEQ ID NO: 281474 - protein, 8 aa, Influenza virus
MQIRGFVY

SEQ ID NO: 281475 - protein, 8 aa, Influenza virus
QIRGFVYF

SEQ ID NO: 281476 - protein, 8 aa, Influenza virus
IRGFVYFV

SEQ ID NO: 281477 - protein, 8 aa, Influenza virus
RGFVYFVE

SEQ ID NO: 281478 - protein, 8 aa, Influenza virus
GFVYFVET

SEQ ID NO: 281479 - protein, 8 aa, Influenza virus
FVYFVETL

SEQ ID NO: 281480 - protein, 8 aa, Influenza virus
VYFVETLA

SEQ ID NO: 281481 - protein, 8 aa, Influenza virus
YFVETLAR

SEQ ID NO: 281482 - protein, 8 aa, Influenza virus
VETLARSI

SEQ ID NO: 281483 - protein, 8 aa, Influenza virus
ETLARSIC

SEQ ID NO: 281484 - protein, 8 aa, Influenza virus
LARSICEK

SEQ ID NO: 281485 - protein, 8 aa, Influenza virus
ARSICEKL

SEQ ID NO: 281486 - protein, 8 aa, Influenza virus
RSICEKLE

SEQ ID NO: 281487 - protein, 8 aa, Influenza virus
SICEKLEQ

SEQ ID NO: 281488 - protein, 8 aa, Influenza virus
ICEKLEQS

SEQ ID NO: 281489 - protein, 8 aa, Influenza virus
CEKLEQSG

SEQ ID NO: 281490 - protein, 8 aa, Influenza virus
EKLEQSGL

SEQ ID NO: 281491 - protein, 8 aa, Influenza virus
KLEQSGLP

SEQ ID NO: 281492 - protein, 8 aa, Influenza virus
LEQSGLPV

SEQ ID NO: 281493 - protein, 8 aa, Influenza virus
EQSGLPVG

SEQ ID NO: 281494 - protein, 8 aa, Influenza virus
QSGLPVGG

SEQ ID NO: 281495 - protein, 8 aa, Influenza virus
SGLPVGGN

SEQ ID NO: 281496 - protein, 8 aa, Influenza virus
GLPVGGNE

SEQ ID NO: 281497 - protein, 8 aa, Influenza virus
LPVGGNEK

SEQ ID NO: 281498 - protein, 8 aa, Influenza virus
PVGGNEKK

SEQ ID NO: 281499 - protein, 8 aa, Influenza virus
VGGNEKKA

SEQ ID NO: 281500 - protein, 8 aa, Influenza virus
GGNEKKAK

SEQ ID NO: 281501 - protein, 8 aa, Influenza virus
GNEKKAKL

SEQ ID NO: 281502 - protein, 8 aa, Influenza virus
NEKKAKLA

SEQ ID NO: 281503 - protein, 8 aa, Influenza virus
EKKAKLAN

SEQ ID NO: 281504 - protein, 8 aa, Influenza virus
KKAKLANV

SEQ ID NO: 281505 - protein, 8 aa, Influenza virus
KAKLANVV

SEQ ID NO: 281506 - protein, 8 aa, Influenza virus
AKLANVVR

SEQ ID NO: 281507 - protein, 8 aa, Influenza virus
KLANVVRK

SEQ ID NO: 281508 - protein, 8 aa, Influenza virus
LANVVRKM

SEQ ID NO: 281509 - protein, 8 aa, Influenza virus
ANVVRKMM

SEQ ID NO: 281510 - protein, 8 aa, Influenza virus
NVVRKMMT

SEQ ID NO: 281511 - protein, 8 aa, Influenza virus
VVRKMMTN

SEQ ID NO: 281512 - protein, 8 aa, Influenza virus
VRKMMTNS

SEQ ID NO: 281513 - protein, 8 aa, Influenza virus
RKMMTNSQ

SEQ ID NO: 281514 - protein, 8 aa, Influenza virus
KMMTNSQD

SEQ ID NO: 281515 - protein, 8 aa, Influenza virus
MMTNSQDT

SEQ ID NO: 281516 - protein, 8 aa, Influenza virus
MTNSQDTE

SEQ ID NO: 281517 - protein, 8 aa, Influenza virus
TNSQDTEL

SEQ ID NO: 281518 - protein, 8 aa, Influenza virus
NSQDTELS

SEQ ID NO: 281519 - protein, 8 aa, Influenza virus
SQDTELSF

SEQ ID NO: 281520 - protein, 8 aa, Influenza virus
QDTELSFT

SEQ ID NO: 281521 - protein, 8 aa, Influenza virus
DTELSFTI

SEQ ID NO: 281522 - protein, 8 aa, Influenza virus
TELSFTIT

SEQ ID NO: 281523 - protein, 8 aa, Influenza virus
ELSFTITG

SEQ ID NO: 281524 - protein, 8 aa, Influenza virus
LSFTITGD

SEQ ID NO: 281525 - protein, 8 aa, Influenza virus
SFTITGDN

SEQ ID NO: 281526 - protein, 8 aa, Influenza virus
FTITGDNT

SEQ ID NO: 281527 - protein, 8 aa, Influenza virus
TITGDNTK

SEQ ID NO: 281528 - protein, 8 aa, Influenza virus
ITGDNTKW

SEQ ID NO: 281529 - protein, 8 aa, Influenza virus
TGDNTKWN

SEQ ID NO: 281530 - protein, 8 aa, Influenza virus
GDNTKWNE

SEQ ID NO: 281531 - protein, 8 aa, Influenza virus
DNTKWNEN

SEQ ID NO: 281532 - protein, 8 aa, Influenza virus
NTKWNENQ

SEQ ID NO: 281533 - protein, 8 aa, Influenza virus
TKWNENQN

SEQ ID NO: 281534 - protein, 8 aa, Influenza virus
KWNENQNP

SEQ ID NO: 281535 - protein, 8 aa, Influenza virus
WNENQNPR

SEQ ID NO: 281536 - protein, 8 aa, Influenza virus
NENQNPRM

SEQ ID NO: 281537 - protein, 8 aa, Influenza virus
ENQNPRMF

SEQ ID NO: 281538 - protein, 8 aa, Influenza virus
NQNQNPRM

SEQ ID NO: 281539 - protein, 8 aa, Influenza virus
QNQNPRMF

SEQ ID NO: 281540 - protein, 8 aa, Influenza virus
NQNPRMFL

SEQ ID NO: 281541 - protein, 8 aa, Influenza virus
QNPRMFLA

SEQ ID NO: 281542 - protein, 8 aa, Influenza virus
NPRMFLAM

SEQ ID NO: 281543 - protein, 8 aa, Influenza virus
PRMFLAMI

SEQ ID NO: 281544 - protein, 8 aa, Influenza virus
RMFLAMIT

SEQ ID NO: 281545 - protein, 8 aa, Influenza virus
MFLAMITY

SEQ ID NO: 281546 - protein, 8 aa, Influenza virus
FLAMITYI

SEQ ID NO: 281547 - protein, 8 aa, Influenza virus
LAMITYIT

SEQ ID NO: 281548 - protein, 8 aa, Influenza virus
AMITYITR

SEQ ID NO: 281549 - protein, 8 aa, Influenza virus
TYITRNQP

SEQ ID NO: 281550 - protein, 8 aa, Influenza virus
QPEWFRNI

SEQ ID NO: 281551 - protein, 8 aa, Influenza virus
PEWFRNIL

SEQ ID NO: 281552 - protein, 8 aa, Influenza virus
EWFRNILS

SEQ ID NO: 281553 - protein, 8 aa, Influenza virus
WFRNVLSI

SEQ ID NO: 281554 - protein, 8 aa, Influenza virus
FRNVLSIA

SEQ ID NO: 281555 - protein, 8 aa, Influenza virus
RNVLSIAP

SEQ ID NO: 281556 - protein, 8 aa, Influenza virus
NVLSIAPI

SEQ ID NO: 281557 - protein, 8 aa, Influenza virus
VLSIAPIM

SEQ ID NO: 281558 - protein, 8 aa, Influenza virus
LSIAPIMF

SEQ ID NO: 281559 - protein, 8 aa, Influenza virus
SIAPIMFS

SEQ ID NO: 281560 - protein, 8 aa, Influenza virus
IAPIMFSN

SEQ ID NO: 281561 - protein, 8 aa, Influenza virus
APIMFSNK

SEQ ID NO: 281562 - protein, 8 aa, Influenza virus
PIMFSNKM

SEQ ID NO: 281563 - protein, 8 aa, Influenza virus
IMFSNKMA

SEQ ID NO: 281564 - protein, 8 aa, Influenza virus
MFSNKMAR

SEQ ID NO: 281565 - protein, 8 aa, Influenza virus
FSNKMARL

SEQ ID NO: 281566 - protein, 8 aa, Influenza virus
SNKMARLG

SEQ ID NO: 281567 - protein, 8 aa, Influenza virus
NKMARLGK

SEQ ID NO: 281568 - protein, 8 aa, Influenza virus
KMARLGKG

SEQ ID NO: 281569 - protein, 8 aa, Influenza virus
MARLGKGY

SEQ ID NO: 281570 - protein, 8 aa, Influenza virus
ARLGKGYM

SEQ ID NO: 281571 - protein, 8 aa, Influenza virus
RLGKGYMF

SEQ ID NO: 281572 - protein, 8 aa, Influenza virus
LGKGYMFE

SEQ ID NO: 281573 - protein, 8 aa, Influenza virus
GKGYMFES

SEQ ID NO: 281574 - protein, 8 aa, Influenza virus
KGYMFESK

SEQ ID NO: 281575 - protein, 8 aa, Influenza virus
GYMFESKS

SEQ ID NO: 281576 - protein, 8 aa, Influenza virus
YMFESKSM

SEQ ID NO: 281577 - protein, 8 aa, Influenza virus
MKLRTQIP

SEQ ID NO: 281578 - protein, 8 aa, Influenza virus
KLRTQIPA

SEQ ID NO: 281579 - protein, 8 aa, Influenza virus
LRTQIPAE

SEQ ID NO: 281580 - protein, 8 aa, Influenza virus
IDLKYFNE

SEQ ID NO: 281581 - protein, 8 aa, Influenza virus
KIEKIEKI

SEQ ID NO: 281582 - protein, 8 aa, Influenza virus
IEKIEKIR

SEQ ID NO: 281583 - protein, 8 aa, Influenza virus
EKIEKIRP

SEQ ID NO: 281584 - protein, 8 aa, Influenza virus
KIEKIRPL

SEQ ID NO: 281585 - protein, 8 aa, Influenza virus
IEKIRPLL

SEQ ID NO: 281586 - protein, 8 aa, Influenza virus
GTASLSPG

SEQ ID NO: 281587 - protein, 8 aa, Influenza virus
TASLSPGM

SEQ ID NO: 281588 - protein, 8 aa, Influenza virus
ASLSPGMM

SEQ ID NO: 281589 - protein, 8 aa, Influenza virus
SLSPGMMM

SEQ ID NO: 281590 - protein, 8 aa, Influenza virus
LSPGMMMG

SEQ ID NO: 281591 - protein, 8 aa, Influenza virus
SPGMMMGM

SEQ ID NO: 281592 - protein, 8 aa, Influenza virus
PGMMMGMF

SEQ ID NO: 281593 - protein, 8 aa, Influenza virus
GMMMGMFN

SEQ ID NO: 281594 - protein, 8 aa, Influenza virus
MMMGMFNM

SEQ ID NO: 281595 - protein, 8 aa, Influenza virus
MMGMFNML

SEQ ID NO: 281596 - protein, 8 aa, Influenza virus
MGMFNMLS

SEQ ID NO: 281597 - protein, 8 aa, Influenza virus
GMFNMLST

SEQ ID NO: 281598 - protein, 8 aa, Influenza virus
MFNMLSTV

SEQ ID NO: 281599 - protein, 8 aa, Influenza virus
FNMLSTVL

SEQ ID NO: 281600 - protein, 8 aa, Influenza virus
NMLSTVLG

SEQ ID NO: 281601 - protein, 8 aa, Influenza virus
MLSTVLGV

SEQ ID NO: 281602 - protein, 8 aa, Influenza virus
LSTVLGVS

SEQ ID NO: 281603 - protein, 8 aa, Influenza virus
STVLGVSI

SEQ ID NO: 281604 - protein, 8 aa, Influenza virus
TVLGVSIL

SEQ ID NO: 281605 - protein, 8 aa, Influenza virus
VLGVSILN

SEQ ID NO: 281606 - protein, 8 aa, Influenza virus
LGVSILNL

SEQ ID NO: 281607 - protein, 8 aa, Influenza virus
GVSILNLG

SEQ ID NO: 281608 - protein, 8 aa, Influenza virus
VSILNLGQ

SEQ ID NO: 281609 - protein, 8 aa, Influenza virus
SILNLGQK

SEQ ID NO: 281610 - protein, 8 aa, Influenza virus
ILNLGQKR

SEQ ID NO: 281611 - protein, 8 aa, Influenza virus
LNLGQKRY

SEQ ID NO: 281612 - protein, 8 aa, Influenza virus
NLGQKRYT

SEQ ID NO: 281613 - protein, 8 aa, Influenza virus
TTYWWDGL

SEQ ID NO: 281614 - protein, 8 aa, Influenza virus
TYWWDGLQ

SEQ ID NO: 281615 - protein, 8 aa, Influenza virus
YWWDGLQS

SEQ ID NO: 281616 - protein, 8 aa, Influenza virus
WWDGLQSS

SEQ ID NO: 281617 - protein, 8 aa, Influenza virus
WDGLQSSD

SEQ ID NO: 281618 - protein, 8 aa, Influenza virus
DGLQSSDD

SEQ ID NO: 281619 - protein, 8 aa, Influenza virus
GLQSSDDF

SEQ ID NO: 281620 - protein, 8 aa, Influenza virus
LQSSDDFA

SEQ ID NO: 281621 - protein, 8 aa, Influenza virus
QSSDDFAL

SEQ ID NO: 281622 - protein, 8 aa, Influenza virus
SSDDFALI

SEQ ID NO: 281623 - protein, 8 aa, Influenza virus
SDDFALIV

SEQ ID NO: 281624 - protein, 8 aa, Influenza virus
DDFALIVN

SEQ ID NO: 281625 - protein, 8 aa, Influenza virus
DFALIVNA

SEQ ID NO: 281626 - protein, 8 aa, Influenza virus
FALIVNAP

SEQ ID NO: 281627 - protein, 8 aa, Influenza virus
EGIQAGVD

SEQ ID NO: 281628 - protein, 8 aa, Influenza virus
GIQAGVDR

SEQ ID NO: 281629 - protein, 8 aa, Influenza virus
IQAGVDRF

SEQ ID NO: 281630 - protein, 8 aa, Influenza virus
QAGVDRFY

SEQ ID NO: 281631 - protein, 8 aa, Influenza virus
AGVDRFYR

SEQ ID NO: 281632 - protein, 8 aa, Influenza virus
GVDRFYRT

SEQ ID NO: 281633 - protein, 8 aa, Influenza virus
VDRFYRTC

SEQ ID NO: 281634 - protein, 8 aa, Influenza virus
DRFYRTCK

SEQ ID NO: 281635 - protein, 8 aa, Influenza virus
RFYRTCKL

SEQ ID NO: 281636 - protein, 8 aa, Influenza virus
FYRTCKLV

SEQ ID NO: 281637 - protein, 8 aa, Influenza virus
YRTCKLVG

SEQ ID NO: 281638 - protein, 8 aa, Influenza virus
RTCKLVGI

SEQ ID NO: 281639 - protein, 8 aa, Influenza virus
TCKLVGIN

SEQ ID NO: 281640 - protein, 8 aa, Influenza virus
CKLVGINM

SEQ ID NO: 281641 - protein, 8 aa, Influenza virus
KLVGINMS

SEQ ID NO: 281642 - protein, 8 aa, Influenza virus
LVGINMSK

SEQ ID NO: 281643 - protein, 8 aa, Influenza virus
VGINMSKK

SEQ ID NO: 281644 - protein, 8 aa, Influenza virus
GINMSKKK

SEQ ID NO: 281645 - protein, 8 aa, Influenza virus
INMSKKKS

SEQ ID NO: 281646 - protein, 8 aa, Influenza virus
NMSKKKSY

SEQ ID NO: 281647 - protein, 8 aa, Influenza virus
MSKKKSYI

SEQ ID NO: 281648 - protein, 8 aa, Influenza virus
SKKKSYIN

SEQ ID NO: 281649 - protein, 8 aa, Influenza virus
KKKSYINR

SEQ ID NO: 281650 - protein, 8 aa, Influenza virus
KKSYINRT

SEQ ID NO: 281651 - protein, 8 aa, Influenza virus
KSYINRTG

SEQ ID NO: 281652 - protein, 8 aa, Influenza virus
SYINRTGT

SEQ ID NO: 281653 - protein, 8 aa, Influenza virus
YINRTGTF

SEQ ID NO: 281654 - protein, 8 aa, Influenza virus
INRTGTFE

SEQ ID NO: 281655 - protein, 8 aa, Influenza virus
NRTGTFEF

SEQ ID NO: 281656 - protein, 8 aa, Influenza virus
RTGTFEFT

SEQ ID NO: 281657 - protein, 8 aa, Influenza virus
TGTFEFTS

SEQ ID NO: 281658 - protein, 8 aa, Influenza virus
GTFEFTSF

SEQ ID NO: 281659 - protein, 8 aa, Influenza virus
TFEFTSFF

SEQ ID NO: 281660 - protein, 8 aa, Influenza virus
FEFTSFFY

SEQ ID NO: 281661 - protein, 8 aa, Influenza virus
EFTSFFYR

SEQ ID NO: 281662 - protein, 8 aa, Influenza virus
FTSFFYRY

SEQ ID NO: 281663 - protein, 8 aa, Influenza virus
TSFFYRYG

SEQ ID NO: 281664 - protein, 8 aa, Influenza virus
SFFYRYGF

SEQ ID NO: 281665 - protein, 8 aa, Influenza virus
FFYRYGFV

SEQ ID NO: 281666 - protein, 8 aa, Influenza virus
FYRYGFVA

SEQ ID NO: 281667 - protein, 8 aa, Influenza virus
YRYGFVAN

SEQ ID NO: 281668 - protein, 8 aa, Influenza virus
RYGFVANF

SEQ ID NO: 281669 - protein, 8 aa, Influenza virus
YGFVANFS

SEQ ID NO: 281670 - protein, 8 aa, Influenza virus
GFVANFSM

SEQ ID NO: 281671 - protein, 8 aa, Influenza virus
FVANFSME

SEQ ID NO: 281672 - protein, 8 aa, Influenza virus
VANFSMEL

SEQ ID NO: 281673 - protein, 8 aa, Influenza virus
ANFSMELP

SEQ ID NO: 281674 - protein, 8 aa, Influenza virus
NFSMELPS

SEQ ID NO: 281675 - protein, 8 aa, Influenza virus
FSMELPSF

SEQ ID NO: 281676 - protein, 8 aa, Influenza virus
SMELPSFG

SEQ ID NO: 281677 - protein, 8 aa, Influenza virus
MELPSFGV

SEQ ID NO: 281678 - protein, 8 aa, Influenza virus
ELPSFGVS

SEQ ID NO: 281679 - protein, 8 aa, Influenza virus
LPSFGVSG

SEQ ID NO: 281680 - protein, 8 aa, Influenza virus
PSFGVSGI

SEQ ID NO: 281681 - protein, 8 aa, Influenza virus
SFGVSGIN

SEQ ID NO: 281682 - protein, 8 aa, Influenza virus
FGVSGINE

SEQ ID NO: 281683 - protein, 8 aa, Influenza virus
GVSGINES

SEQ ID NO: 281684 - protein, 8 aa, Influenza virus
VSGINESA

SEQ ID NO: 281685 - protein, 8 aa, Influenza virus
SGINESAD

SEQ ID NO: 281686 - protein, 8 aa, Influenza virus
GINESADM

SEQ ID NO: 281687 - protein, 8 aa, Influenza virus
INESADMS

SEQ ID NO: 281688 - protein, 8 aa, Influenza virus
NESADMSI

SEQ ID NO: 281689 - protein, 8 aa, Influenza virus
ESADMSIG

SEQ ID NO: 281690 - protein, 8 aa, Influenza virus
SADMSIGV

SEQ ID NO: 281691 - protein, 8 aa, Influenza virus
ADMSIGVT

SEQ ID NO: 281692 - protein, 8 aa, Influenza virus
DMSIGVTV

SEQ ID NO: 281693 - protein, 8 aa, Influenza virus
MSIGVTVI

SEQ ID NO: 281694 - protein, 8 aa, Influenza virus
SIGVTVIK

SEQ ID NO: 281695 - protein, 8 aa, Influenza virus
IGVTVIKN

SEQ ID NO: 281696 - protein, 8 aa, Influenza virus
GVTVIKNN

SEQ ID NO: 281697 - protein, 8 aa, Influenza virus
VTVIKNNM

SEQ ID NO: 281698 - protein, 8 aa, Influenza virus
TVIKNNMI

SEQ ID NO: 281699 - protein, 8 aa, Influenza virus
VIKNNMIN

SEQ ID NO: 281700 - protein, 8 aa, Influenza virus
IKNNMINN

SEQ ID NO: 281701 - protein, 8 aa, Influenza virus
KNNMINND

SEQ ID NO: 281702 - protein, 8 aa, Influenza virus
NNMINNDL

SEQ ID NO: 281703 - protein, 8 aa, Influenza virus
NMINNDLG

SEQ ID NO: 281704 - protein, 8 aa, Influenza virus
MINNDLGP

SEQ ID NO: 281705 - protein, 8 aa, Influenza virus
INNDLGPA

SEQ ID NO: 281706 - protein, 8 aa, Influenza virus
NNDLGPAT

SEQ ID NO: 281707 - protein, 8 aa, Influenza virus
NDLGPATA

SEQ ID NO: 281708 - protein, 8 aa, Influenza virus
DLGPATAQ

SEQ ID NO: 281709 - protein, 8 aa, Influenza virus
LGPATAQM

SEQ ID NO: 281710 - protein, 8 aa, Influenza virus
GPATAQMA

SEQ ID NO: 281711 - protein, 8 aa, Influenza virus
PATAQMAL

SEQ ID NO: 281712 - protein, 8 aa, Influenza virus
ATAQMALQ

SEQ ID NO: 281713 - protein, 8 aa, Influenza virus
TAQMALQL

SEQ ID NO: 281714 - protein, 8 aa, Influenza virus
AQMALQLF

SEQ ID NO: 281715 - protein, 8 aa, Influenza virus
QMALQLFI

SEQ ID NO: 281716 - protein, 8 aa, Influenza virus
MALQLFIK

SEQ ID NO: 281717 - protein, 8 aa, Influenza virus
ALQLFIKD

SEQ ID NO: 281718 - protein, 8 aa, Influenza virus
LQLFIKDY

SEQ ID NO: 281719 - protein, 8 aa, Influenza virus
QLFIKDYR

SEQ ID NO: 281720 - protein, 8 aa, Influenza virus
LFIKDYRY

SEQ ID NO: 281721 - protein, 8 aa, Influenza virus
FIKDYRYT

SEQ ID NO: 281722 - protein, 8 aa, Influenza virus
IKDYRYTY

SEQ ID NO: 281723 - protein, 8 aa, Influenza virus
KDYRYTYR

SEQ ID NO: 281724 - protein, 8 aa, Influenza virus
DYRYTYRC

SEQ ID NO: 281725 - protein, 8 aa, Influenza virus
YRYTYRCH

SEQ ID NO: 281726 - protein, 8 aa, Influenza virus
RYTYRCHR

SEQ ID NO: 281727 - protein, 8 aa, Influenza virus
YTYRCHRG

SEQ ID NO: 281728 - protein, 8 aa, Influenza virus
TYRCHRGD

SEQ ID NO: 281729 - protein, 8 aa, Influenza virus
YRCHRGDT

SEQ ID NO: 281730 - protein, 8 aa, Influenza virus
RCHRGDTQ

SEQ ID NO: 281731 - protein, 8 aa, Influenza virus
CHRGDTQI

SEQ ID NO: 281732 - protein, 8 aa, Influenza virus
QIQTRRSF

SEQ ID NO: 281733 - protein, 8 aa, Influenza virus
IQTRRSFE

SEQ ID NO: 281734 - protein, 8 aa, Influenza virus
QTRRSFEL

SEQ ID NO: 281735 - protein, 8 aa, Influenza virus
TRRSFELK

SEQ ID NO: 281736 - protein, 8 aa, Influenza virus
GLLVSDGG

SEQ ID NO: 281737 - protein, 8 aa, Influenza virus
LLVSDGGP

SEQ ID NO: 281738 - protein, 8 aa, Influenza virus
LVSDGGPN

SEQ ID NO: 281739 - protein, 8 aa, Influenza virus
VSDGGPNL

SEQ ID NO: 281740 - protein, 8 aa, Influenza virus
SDGGPNLY

SEQ ID NO: 281741 - protein, 8 aa, Influenza virus
DGGPNLYN

SEQ ID NO: 281742 - protein, 8 aa, Influenza virus
GGPNLYNI

SEQ ID NO: 281743 - protein, 8 aa, Influenza virus
GPNLYNIR

SEQ ID NO: 281744 - protein, 8 aa, Influenza virus
PNLYNIRN

SEQ ID NO: 281745 - protein, 8 aa, Influenza virus
NLYNIRNL

SEQ ID NO: 281746 - protein, 8 aa, Influenza virus
LYNIRNLH

SEQ ID NO: 281747 - protein, 8 aa, Influenza virus
YNIRNLHI

SEQ ID NO: 281748 - protein, 8 aa, Influenza virus
NIRNLHIP

SEQ ID NO: 281749 - protein, 8 aa, Influenza virus
IRNLHIPE

SEQ ID NO: 281750 - protein, 8 aa, Influenza virus
RNLHIPEV

SEQ ID NO: 281751 - protein, 8 aa, Influenza virus
NLHIPEVC

SEQ ID NO: 281752 - protein, 8 aa, Influenza virus
LHIPEVCL

SEQ ID NO: 281753 - protein, 8 aa, Influenza virus
HIPEVCLK

SEQ ID NO: 281754 - protein, 8 aa, Influenza virus
IPEVCLKW

SEQ ID NO: 281755 - protein, 8 aa, Influenza virus
PEVCLKWE

SEQ ID NO: 281756 - protein, 8 aa, Influenza virus
EVCLKWEL

SEQ ID NO: 281757 - protein, 8 aa, Influenza virus
VCLKWELM

SEQ ID NO: 281758 - protein, 8 aa, Influenza virus
CLKWELMD

SEQ ID NO: 281759 - protein, 8 aa, Influenza virus
YQGRLCNP

SEQ ID NO: 281760 - protein, 8 aa, Influenza virus
QGRLCNPL

SEQ ID NO: 281761 - protein, 8 aa, Influenza virus
GRLCNPLN

SEQ ID NO: 281762 - protein, 8 aa, Influenza virus
RLCNPLNP

SEQ ID NO: 281763 - protein, 8 aa, Influenza virus
LCNPLNPF

SEQ ID NO: 281764 - protein, 8 aa, Influenza virus
CNPLNPFV

SEQ ID NO: 281765 - protein, 8 aa, Influenza virus
NPLNPFVS

SEQ ID NO: 281766 - protein, 8 aa, Influenza virus
PLNPFVSH

SEQ ID NO: 281767 - protein, 8 aa, Influenza virus
HPRGLLEV

SEQ ID NO: 281768 - protein, 8 aa, Influenza virus
PRGLLEVG

SEQ ID NO: 281769 - protein, 8 aa, Influenza virus
RGLLEVGT

SEQ ID NO: 281770 - protein, 8 aa, Influenza virus
GLLEVGTR

SEQ ID NO: 281771 - protein, 8 aa, Influenza virus
LLEVGTRW

SEQ ID NO: 281772 - protein, 8 aa, Influenza virus
LEVGTRWM

SEQ ID NO: 281773 - protein, 8 aa, Influenza virus
EVGTRWMK

SEQ ID NO: 281774 - protein, 8 aa, Influenza virus
VGTRWMKI

SEQ ID NO: 281775 - protein, 8 aa, Influenza virus
GTRWMKII

SEQ ID NO: 281776 - protein, 8 aa, Influenza virus
TRWMKIIR

SEQ ID NO: 281777 - protein, 8 aa, Influenza virus
RWMKIIRV

SEQ ID NO: 281778 - protein, 8 aa, Influenza virus
WMKIIRVG

SEQ ID NO: 281779 - protein, 8 aa, Influenza virus
MKIIRVGC

SEQ ID NO: 281780 - protein, 8 aa, Influenza virus
KIIRVGCV

SEQ ID NO: 281781 - protein, 8 aa, Influenza virus
IIRVGCVI

SEQ ID NO: 281782 - protein, 8 aa, Influenza virus
IRVGCVIL

SEQ ID NO: 281783 - protein, 8 aa, Influenza virus
RVGCVILL

SEQ ID NO: 281784 - protein, 8 aa, Influenza virus
VGCVILLN

SEQ ID NO: 281785 - protein, 8 aa, Influenza virus
GCVILLNP

SEQ ID NO: 281786 - protein, 8 aa, Influenza virus
CVILLNPF

SEQ ID NO: 281787 - protein, 8 aa, Influenza virus
VILLNPFV

SEQ ID NO: 281788 - protein, 8 aa, Influenza virus
ILLNPFVS

SEQ ID NO: 281789 - protein, 8 aa, Influenza virus
LLNPFVSH

SEQ ID NO: 281790 - protein, 8 aa, Influenza virus
NPFVSHKE

SEQ ID NO: 281791 - protein, 8 aa, Influenza virus
MEYDAVAT

SEQ ID NO: 281792 - protein, 8 aa, Influenza virus
EYDAVATT

SEQ ID NO: 281793 - protein, 8 aa, Influenza virus
YDAVATTH

SEQ ID NO: 281794 - protein, 8 aa, Influenza virus
DAVATTHS

SEQ ID NO: 281795 - protein, 8 aa, Influenza virus
AVATTHSW

SEQ ID NO: 281796 - protein, 8 aa, Influenza virus
VATTHSWI

SEQ ID NO: 281797 - protein, 8 aa, Influenza virus
ATTHSWIP

SEQ ID NO: 281798 - protein, 8 aa, Influenza virus
TTHSWIPK

SEQ ID NO: 281799 - protein, 8 aa, Influenza virus
THSWIPKR

SEQ ID NO: 281800 - protein, 8 aa, Influenza virus
HSWIPKRN

SEQ ID NO: 281801 - protein, 8 aa, Influenza virus
SWIPKRNR

SEQ ID NO: 281802 - protein, 8 aa, Influenza virus
WIPKRNRS

SEQ ID NO: 281803 - protein, 8 aa, Influenza virus
IPKRNRSI

SEQ ID NO: 281804 - protein, 8 aa, Influenza virus
PKRNRSIL

SEQ ID NO: 281805 - protein, 8 aa, Influenza virus
KRNRSILN

SEQ ID NO: 281806 - protein, 8 aa, Influenza virus
RNRSILNT

SEQ ID NO: 281807 - protein, 8 aa, Influenza virus
NRSILNTS

SEQ ID NO: 281808 - protein, 8 aa, Influenza virus
RSILNTSQ

SEQ ID NO: 281809 - protein, 8 aa, Influenza virus
SILNTSQR

SEQ ID NO: 281810 - protein, 8 aa, Influenza virus
ICNSNAIT

SEQ ID NO: 281811 - protein, 8 aa, Influenza virus
CNSNAITR

SEQ ID NO: 281812 - protein, 8 aa, Influenza virus
NSNAITRS

SEQ ID NO: 281813 - protein, 8 aa, Influenza virus
SNAITRSG

SEQ ID NO: 281814 - protein, 8 aa, Influenza virus
NAITRSGQ

SEQ ID NO: 281815 - protein, 8 aa, Influenza virus
AITRSGQN

SEQ ID NO: 281816 - protein, 8 aa, Influenza virus
ITRSGQNH

SEQ ID NO: 281817 - protein, 8 aa, Influenza virus
TRSGQNHG

SEQ ID NO: 281818 - protein, 8 aa, Influenza virus
RSGQNHGI

SEQ ID NO: 281819 - protein, 8 aa, Influenza virus
SGQNHGIC

SEQ ID NO: 281820 - protein, 8 aa, Influenza virus
GQNHGICA

SEQ ID NO: 281821 - protein, 8 aa, Influenza virus
QNHGICAV

SEQ ID NO: 281822 - protein, 8 aa, Influenza virus
NHGICAVA

SEQ ID NO: 281823 - protein, 8 aa, Influenza virus
HGICAVAT

SEQ ID NO: 281824 - protein, 8 aa, Influenza virus
GICAVATT

SEQ ID NO: 281825 - protein, 8 aa, Influenza virus
ICAVATTH

SEQ ID NO: 281826 - protein, 8 aa, Influenza virus
CAVATTHS

SEQ ID NO: 281827 - protein, 8 aa, Influenza virus
AVATTHSW

SEQ ID NO: 281828 - protein, 8 aa, Influenza virus
VATTHSWV

SEQ ID NO: 281829 - protein, 8 aa, Influenza virus
ATTHSWVP

SEQ ID NO: 281830 - protein, 8 aa, Influenza virus
TTHSWVPI

SEQ ID NO: 281831 - protein, 8 aa, Influenza virus
THSWVPIL

SEQ ID NO: 281832 - protein, 8 aa, Influenza virus
HSWVPILN

SEQ ID NO: 281833 - protein, 8 aa, Influenza virus
SWVPILNT

SEQ ID NO: 281834 - protein, 8 aa, Influenza virus
WVPILNTS

SEQ ID NO: 281835 - protein, 8 aa, Influenza virus
VPILNTSQ

SEQ ID NO: 281836 - protein, 8 aa, Influenza virus
PILNTSQR

SEQ ID NO: 281837 - protein, 8 aa, Influenza virus
ILNTSQRG

SEQ ID NO: 281838 - protein, 8 aa, Influenza virus
LNTSQRGI

SEQ ID NO: 281839 - protein, 8 aa, Influenza virus
NTSQRGIL

SEQ ID NO: 281840 - protein, 8 aa, Influenza virus
TSQRGILE

SEQ ID NO: 281841 - protein, 8 aa, Influenza virus
SQRGILED

SEQ ID NO: 281842 - protein, 8 aa, Influenza virus
QRGILEDE

SEQ ID NO: 281843 - protein, 8 aa, Influenza virus
RGILEDEQ

SEQ ID NO: 281844 - protein, 8 aa, Influenza virus
GILEDEQM

SEQ ID NO: 281845 - protein, 8 aa, Influenza virus
ILEDEQMY

SEQ ID NO: 281846 - protein, 8 aa, Influenza virus
LEDEQMYQ

SEQ ID NO: 281847 - protein, 8 aa, Influenza virus
EDEQMYQK

SEQ ID NO: 281848 - protein, 8 aa, Influenza virus
DEQMYQKC

SEQ ID NO: 281849 - protein, 8 aa, Influenza virus
EQMYQKCC

SEQ ID NO: 281850 - protein, 8 aa, Influenza virus
QMYQKCCN

SEQ ID NO: 281851 - protein, 8 aa, Influenza virus
MYQKCCNL

SEQ ID NO: 281852 - protein, 8 aa, Influenza virus
YQKCCNLF

SEQ ID NO: 281853 - protein, 8 aa, Influenza virus
QKCCNLFE

SEQ ID NO: 281854 - protein, 8 aa, Influenza virus
KCCNLFEK

SEQ ID NO: 281855 - protein, 8 aa, Influenza virus
CCNLFEKF

SEQ ID NO: 281856 - protein, 8 aa, Influenza virus
CNLFEKFF

SEQ ID NO: 281857 - protein, 8 aa, Influenza virus
NLFEKFFP

SEQ ID NO: 281858 - protein, 8 aa, Influenza virus
LFEKFFPS

SEQ ID NO: 281859 - protein, 8 aa, Influenza virus
FEKFFPSS

SEQ ID NO: 281860 - protein, 8 aa, Influenza virus
EKFFPSSS

SEQ ID NO: 281861 - protein, 8 aa, Influenza virus
KFFPSSSY

SEQ ID NO: 281862 - protein, 8 aa, Influenza virus
FFPSSSYR

SEQ ID NO: 281863 - protein, 8 aa, Influenza virus
FPSSSYRR

SEQ ID NO: 281864 - protein, 8 aa, Influenza virus
PSSSYRRP

SEQ ID NO: 281865 - protein, 8 aa, Influenza virus
SSSYRRPV

SEQ ID NO: 281866 - protein, 8 aa, Influenza virus
SSYRRPVG

SEQ ID NO: 281867 - protein, 8 aa, Influenza virus
SYRRPVGI

SEQ ID NO: 281868 - protein, 8 aa, Influenza virus
YRRPVGIS

SEQ ID NO: 281869 - protein, 8 aa, Influenza virus
RRPVGISS

SEQ ID NO: 281870 - protein, 8 aa, Influenza virus
RPVGISSM

SEQ ID NO: 281871 - protein, 8 aa, Influenza virus
PVGISSMV

SEQ ID NO: 281872 - protein, 8 aa, Influenza virus
VGISSMVE

SEQ ID NO: 281873 - protein, 8 aa, Influenza virus
GISSMVEA

SEQ ID NO: 281874 - protein, 8 aa, Influenza virus
ISSMVEAM

SEQ ID NO: 281875 - protein, 8 aa, Influenza virus
SSMVEAMV

SEQ ID NO: 281876 - protein, 8 aa, Influenza virus
SMVEAMVS

SEQ ID NO: 281877 - protein, 8 aa, Influenza virus
MVEAMVSR

SEQ ID NO: 281878 - protein, 8 aa, Influenza virus
VEAMVSRA

SEQ ID NO: 281879 - protein, 8 aa, Influenza virus
EAMVSRAR

SEQ ID NO: 281880 - protein, 8 aa, Influenza virus
AMVSRARI

SEQ ID NO: 281881 - protein, 8 aa, Influenza virus
MVSRARID

SEQ ID NO: 281882 - protein, 8 aa, Influenza virus
VSRARIDA

SEQ ID NO: 281883 - protein, 8 aa, Influenza virus
SRARIDAR

SEQ ID NO: 281884 - protein, 8 aa, Influenza virus
RARIDARI

SEQ ID NO: 281885 - protein, 8 aa, Influenza virus
ARIDARID

SEQ ID NO: 281886 - protein, 8 aa, Influenza virus
RIDARIDF

SEQ ID NO: 281887 - protein, 8 aa, Influenza virus
IDARIDFE

SEQ ID NO: 281888 - protein, 8 aa, Influenza virus
DARIDFES

SEQ ID NO: 281889 - protein, 8 aa, Influenza virus
ARIDFESG

SEQ ID NO: 281890 - protein, 8 aa, Influenza virus
RIDFESGR

SEQ ID NO: 281891 - protein, 8 aa, Influenza virus
IDFESGRI

SEQ ID NO: 281892 - protein, 8 aa, Influenza virus
GKKEEFSE

SEQ ID NO: 281893 - protein, 8 aa, Influenza virus
ELRRQKSL

SEQ ID NO: 281894 - protein, 8 aa, Influenza virus
LRRQKSLI

SEQ ID NO: 281895 - protein, 8 aa, Influenza virus
RRQKWWVW

SEQ ID NO: 281896 - protein, 8 aa, Influenza virus
RQKWWVWL

SEQ ID NO: 281897 - protein, 8 aa, Influenza virus
QKSLIWLW

SEQ ID NO: 281898 - protein, 8 aa, Influenza virus
KWWVWLWL

SEQ ID NO: 281899 - protein, 8 aa, Influenza virus
SLIWLWLV

SEQ ID NO: 281900 - protein, 8 aa, Influenza virus
WVWLWLVL

SEQ ID NO: 281901 - protein, 8 aa, Influenza virus
VWLWLVLR

SEQ ID NO: 281902 - protein, 8 aa, Influenza virus
WLWLVLRE

SEQ ID NO: 281903 - protein, 8 aa, Influenza virus
LWLVLREK

SEQ ID NO: 281904 - protein, 8 aa, Influenza virus
WLVLREKM

SEQ ID NO: 281905 - protein, 8 aa, Influenza virus
LVLREKMP

SEQ ID NO: 281906 - protein, 8 aa, Influenza virus
SKSRSNIF

SEQ ID NO: 281907 - protein, 8 aa, Influenza virus
KSRSNIFN

SEQ ID NO: 281908 - protein, 8 aa, Influenza virus
SRSNIFNM

SEQ ID NO: 281909 - protein, 8 aa, Influenza virus
RSNIFNME

SEQ ID NO: 281910 - protein, 8 aa, Influenza virus
SNIFNMER

SEQ ID NO: 281911 - protein, 8 aa, Influenza virus
NIFNMERI

SEQ ID NO: 281912 - protein, 8 aa, Influenza virus
IFNMERIK

SEQ ID NO: 281913 - protein, 8 aa, Influenza virus
FNMERIKE

SEQ ID NO: 281914 - protein, 8 aa, Influenza virus
NMERIKEL

SEQ ID NO: 281915 - protein, 8 aa, Influenza virus
MERIKELR

SEQ ID NO: 281916 - protein, 8 aa, Influenza virus
DLMSQSRT

SEQ ID NO: 281917 - protein, 8 aa, Influenza virus
LMSQSRTR

SEQ ID NO: 281918 - protein, 8 aa, Influenza virus
MSQSRTRE

SEQ ID NO: 281919 - protein, 8 aa, Influenza virus
SQSRTREI

SEQ ID NO: 281920 - protein, 8 aa, Influenza virus
QSRTREIL

SEQ ID NO: 281921 - protein, 8 aa, Influenza virus
SRTREILT

SEQ ID NO: 281922 - protein, 8 aa, Influenza virus
RTREILTK

SEQ ID NO: 281923 - protein, 8 aa, Influenza virus
TREILTKT

SEQ ID NO: 281924 - protein, 8 aa, Influenza virus
REILTKTT

SEQ ID NO: 281925 - protein, 8 aa, Influenza virus
EILTKTTV

SEQ ID NO: 281926 - protein, 8 aa, Influenza virus
ILTKTTVD

SEQ ID NO: 281927 - protein, 8 aa, Influenza virus
LTKTTVDH

SEQ ID NO: 281928 - protein, 8 aa, Influenza virus
TKTTVDHM

SEQ ID NO: 281929 - protein, 8 aa, Influenza virus
KTTVDHMA

SEQ ID NO: 281930 - protein, 8 aa, Influenza virus
TTVDHMAI

SEQ ID NO: 281931 - protein, 8 aa, Influenza virus
TVDHMAII

SEQ ID NO: 281932 - protein, 8 aa, Influenza virus
VDHMAIIK

SEQ ID NO: 281933 - protein, 8 aa, Influenza virus
DHMAIIKK

SEQ ID NO: 281934 - protein, 8 aa, Influenza virus
HMAIIKKY

SEQ ID NO: 281935 - protein, 8 aa, Influenza virus
MAIIKKYT

SEQ ID NO: 281936 - protein, 8 aa, Influenza virus
AIIKKYTS

SEQ ID NO: 281937 - protein, 8 aa, Influenza virus
IIKKYTSG

SEQ ID NO: 281938 - protein, 8 aa, Influenza virus
IKKYTSGR

SEQ ID NO: 281939 - protein, 8 aa, Influenza virus
GHNQEYTS

SEQ ID NO: 281940 - protein, 8 aa, Influenza virus
HNQEYTSG

SEQ ID NO: 281941 - protein, 8 aa, Influenza virus
NQEYTSGR

SEQ ID NO: 281942 - protein, 8 aa, Influenza virus
KKYTSGRQ

SEQ ID NO: 281943 - protein, 8 aa, Influenza virus
KYTSGRQE

SEQ ID NO: 281944 - protein, 8 aa, Influenza virus
YTSGRQEK

SEQ ID NO: 281945 - protein, 8 aa, Influenza virus
TSGRQEKN

SEQ ID NO: 281946 - protein, 8 aa, Influenza virus
SGRQEKNP

SEQ ID NO: 281947 - protein, 8 aa, Influenza virus
GRQEKNPA

SEQ ID NO: 281948 - protein, 8 aa, Influenza virus
RQEKNPAL

SEQ ID NO: 281949 - protein, 8 aa, Influenza virus
QEKNPALR

SEQ ID NO: 281950 - protein, 8 aa, Influenza virus
EKNPALRM

SEQ ID NO: 281951 - protein, 8 aa, Influenza virus
KNPALRMK

SEQ ID NO: 281952 - protein, 8 aa, Influenza virus
NPALRMKW

SEQ ID NO: 281953 - protein, 8 aa, Influenza virus
PALRMKWM

SEQ ID NO: 281954 - protein, 8 aa, Influenza virus
ALRMKWMM

SEQ ID NO: 281955 - protein, 8 aa, Influenza virus
LRMKWMMA

SEQ ID NO: 281956 - protein, 8 aa, Influenza virus
RMKWMMAM

SEQ ID NO: 281957 - protein, 8 aa, Influenza virus
MKWMMAMK

SEQ ID NO: 281958 - protein, 8 aa, Influenza virus
KWMMAMKY

SEQ ID NO: 281959 - protein, 8 aa, Influenza virus
WMMAMKYP

SEQ ID NO: 281960 - protein, 8 aa, Influenza virus
MMAMKYPI

SEQ ID NO: 281961 - protein, 8 aa, Influenza virus
MAMKYPIT

SEQ ID NO: 281962 - protein, 8 aa, Influenza virus
AMKYPITA

SEQ ID NO: 281963 - protein, 8 aa, Influenza virus
MKYPITAD

SEQ ID NO: 281964 - protein, 8 aa, Influenza virus
KYPITADK

SEQ ID NO: 281965 - protein, 8 aa, Influenza virus
IPERNEQG

SEQ ID NO: 281966 - protein, 8 aa, Influenza virus
PERNEQGQ

SEQ ID NO: 281967 - protein, 8 aa, Influenza virus
RNEQGQTL

SEQ ID NO: 281968 - protein, 8 aa, Influenza virus
NEQGQTLW

SEQ ID NO: 281969 - protein, 8 aa, Influenza virus
DAGSDRVM

SEQ ID NO: 281970 - protein, 8 aa, Influenza virus
GSDRVMVS

SEQ ID NO: 281971 - protein, 8 aa, Influenza virus
MVSPLAVT

SEQ ID NO: 281972 - protein, 8 aa, Influenza virus
VSPLAVTW

SEQ ID NO: 281973 - protein, 8 aa, Influenza virus
SPLAVTWW

SEQ ID NO: 281974 - protein, 8 aa, Influenza virus
PLAVTWWN

SEQ ID NO: 281975 - protein, 8 aa, Influenza virus
LAVTWWNR

SEQ ID NO: 281976 - protein, 8 aa, Influenza virus
AVTWWNRN

SEQ ID NO: 281977 - protein, 8 aa, Influenza virus
VTWWNRNG

SEQ ID NO: 281978 - protein, 8 aa, Influenza virus
TWWNRNGP

SEQ ID NO: 281979 - protein, 8 aa, Influenza virus
HYPKVYKT

SEQ ID NO: 281980 - protein, 8 aa, Influenza virus
YPKVYKTY

SEQ ID NO: 281981 - protein, 8 aa, Influenza virus
PKVYKTYF

SEQ ID NO: 281982 - protein, 8 aa, Influenza virus
KVYKTYFE

SEQ ID NO: 281983 - protein, 8 aa, Influenza virus
VYKTYFEK

SEQ ID NO: 281984 - protein, 8 aa, Influenza virus
GTFGPVHF

SEQ ID NO: 281985 - protein, 8 aa, Influenza virus
TFGPVHFR

SEQ ID NO: 281986 - protein, 8 aa, Influenza virus
FGPVHFRN

SEQ ID NO: 281987 - protein, 8 aa, Influenza virus
GPVHFRNQ

SEQ ID NO: 281988 - protein, 8 aa, Influenza virus
PVHFRNQV

SEQ ID NO: 281989 - protein, 8 aa, Influenza virus
VHFRNQVK

SEQ ID NO: 281990 - protein, 8 aa, Influenza virus
HFRNQVKI

SEQ ID NO: 281991 - protein, 8 aa, Influenza virus
FRNQVKIR

SEQ ID NO: 281992 - protein, 8 aa, Influenza virus
RNQVKIRR

SEQ ID NO: 281993 - protein, 8 aa, Influenza virus
NQVKIRRR

SEQ ID NO: 281994 - protein, 8 aa, Influenza virus
QVKIRRRV

SEQ ID NO: 281995 - protein, 8 aa, Influenza virus
VKIRRRVD

SEQ ID NO: 281996 - protein, 8 aa, Influenza virus
KIRRRVDI

SEQ ID NO: 281997 - protein, 8 aa, Influenza virus
IRRRVDIN

SEQ ID NO: 281998 - protein, 8 aa, Influenza virus
RRRVDINP

SEQ ID NO: 281999 - protein, 8 aa, Influenza virus
RRVDINPG

SEQ ID NO: 282000 - protein, 8 aa, Influenza virus
RVDINPGH

SEQ ID NO: 282001 - protein, 8 aa, Influenza virus
VDINPGHA

SEQ ID NO: 282002 - protein, 8 aa, Influenza virus
DINPGHAD

SEQ ID NO: 282003 - protein, 8 aa, Influenza virus
INPGHADL

SEQ ID NO: 282004 - protein, 8 aa, Influenza virus
NPGHADLS

SEQ ID NO: 282005 - protein, 8 aa, Influenza virus
DLSAKEAQ

SEQ ID NO: 282006 - protein, 8 aa, Influenza virus
LSAKEAQD

SEQ ID NO: 282007 - protein, 8 aa, Influenza virus
SAKEAQDV

SEQ ID NO: 282008 - protein, 8 aa, Influenza virus
AKEAQDVI

SEQ ID NO: 282009 - protein, 8 aa, Influenza virus
KEAQDVIM

SEQ ID NO: 282010 - protein, 8 aa, Influenza virus
EAQDVIME

SEQ ID NO: 282011 - protein, 8 aa, Influenza virus
AQDVIMEV

SEQ ID NO: 282012 - protein, 8 aa, Influenza virus
QDVIMEVV

SEQ ID NO: 282013 - protein, 8 aa, Influenza virus
DVIMEVVF

SEQ ID NO: 282014 - protein, 8 aa, Influenza virus
VIMEVVFP

SEQ ID NO: 282015 - protein, 8 aa, Influenza virus
IMEVVFPN

SEQ ID NO: 282016 - protein, 8 aa, Influenza virus
MEVVFPNE

SEQ ID NO: 282017 - protein, 8 aa, Influenza virus
EVVFPNEV

SEQ ID NO: 282018 - protein, 8 aa, Influenza virus
VVFPNEVG

SEQ ID NO: 282019 - protein, 8 aa, Influenza virus
VFPNEVGA

SEQ ID NO: 282020 - protein, 8 aa, Influenza virus
FPNEVGAR

SEQ ID NO: 282021 - protein, 8 aa, Influenza virus
PNEVGARI

SEQ ID NO: 282022 - protein, 8 aa, Influenza virus
NEVGARIL

SEQ ID NO: 282023 - protein, 8 aa, Influenza virus
EVGARILT

SEQ ID NO: 282024 - protein, 8 aa, Influenza virus
VGARILTS

SEQ ID NO: 282025 - protein, 8 aa, Influenza virus
GARILTSE

SEQ ID NO: 282026 - protein, 8 aa, Influenza virus
ARILTSES

SEQ ID NO: 282027 - protein, 8 aa, Influenza virus
RILTSESQ

SEQ ID NO: 282028 - protein, 8 aa, Influenza virus
ILTSESQL

SEQ ID NO: 282029 - protein, 8 aa, Influenza virus
TKEKKEEL

SEQ ID NO: 282030 - protein, 8 aa, Influenza virus
IAPLMVAY

SEQ ID NO: 282031 - protein, 8 aa, Influenza virus
APLMVAYM

SEQ ID NO: 282032 - protein, 8 aa, Influenza virus
PLMVAYML

SEQ ID NO: 282033 - protein, 8 aa, Influenza virus
LMVAYMLE

SEQ ID NO: 282034 - protein, 8 aa, Influenza virus
MVAYMLER

SEQ ID NO: 282035 - protein, 8 aa, Influenza virus
VAYMLERE

SEQ ID NO: 282036 - protein, 8 aa, Influenza virus
AYMLEREL

SEQ ID NO: 282037 - protein, 8 aa, Influenza virus
YMLERELV

SEQ ID NO: 282038 - protein, 8 aa, Influenza virus
MLERELVR

SEQ ID NO: 282039 - protein, 8 aa, Influenza virus
LERELVRK

SEQ ID NO: 282040 - protein, 8 aa, Influenza virus
ERELVRKT

SEQ ID NO: 282041 - protein, 8 aa, Influenza virus
RELVRKTR

SEQ ID NO: 282042 - protein, 8 aa, Influenza virus
ELVRKTRF

SEQ ID NO: 282043 - protein, 8 aa, Influenza virus
LVRKTRFL

SEQ ID NO: 282044 - protein, 8 aa, Influenza virus
VRKTRFLP

SEQ ID NO: 282045 - protein, 8 aa, Influenza virus
RKTRFLPV

SEQ ID NO: 282046 - protein, 8 aa, Influenza virus
KTRFLPVA

SEQ ID NO: 282047 - protein, 8 aa, Influenza virus
TRFLPVAG

SEQ ID NO: 282048 - protein, 8 aa, Influenza virus
RFLPVAGG

SEQ ID NO: 282049 - protein, 8 aa, Influenza virus
FLPVAGGT

SEQ ID NO: 282050 - protein, 8 aa, Influenza virus
LPVAGGTS

SEQ ID NO: 282051 - protein, 8 aa, Influenza virus
PVAGGTSS

SEQ ID NO: 282052 - protein, 8 aa, Influenza virus
GGTSSVYI

SEQ ID NO: 282053 - protein, 8 aa, Influenza virus
GTSSVYIE

SEQ ID NO: 282054 - protein, 8 aa, Influenza virus
TSSVYIEV

SEQ ID NO: 282055 - protein, 8 aa, Influenza virus
SSVYIEVL

SEQ ID NO: 282056 - protein, 8 aa, Influenza virus
SVYIEVLH

SEQ ID NO: 282057 - protein, 8 aa, Influenza virus
VYIEVLHL

SEQ ID NO: 282058 - protein, 8 aa, Influenza virus
YIEVLHLT

SEQ ID NO: 282059 - protein, 8 aa, Influenza virus
IEVLHLTQ

SEQ ID NO: 282060 - protein, 8 aa, Influenza virus
EVLHLTQG

SEQ ID NO: 282061 - protein, 8 aa, Influenza virus
VLHLTQGT

SEQ ID NO: 282062 - protein, 8 aa, Influenza virus
LHLTQGTC

SEQ ID NO: 282063 - protein, 8 aa, Influenza virus
HLTQGTCW

SEQ ID NO: 282064 - protein, 8 aa, Influenza virus
LTQGTCWE

SEQ ID NO: 282065 - protein, 8 aa, Influenza virus
TQGTCWEQ

SEQ ID NO: 282066 - protein, 8 aa, Influenza virus
QGTCWEQM

SEQ ID NO: 282067 - protein, 8 aa, Influenza virus
GTCWEQMY

SEQ ID NO: 282068 - protein, 8 aa, Influenza virus
TCWEQMYT

SEQ ID NO: 282069 - protein, 8 aa, Influenza virus
CWEQMYTP

SEQ ID NO: 282070 - protein, 8 aa, Influenza virus
WEQMYTPG

SEQ ID NO: 282071 - protein, 8 aa, Influenza virus
EQMYTPGG

SEQ ID NO: 282072 - protein, 8 aa, Influenza virus
QMYTPGGE

SEQ ID NO: 282073 - protein, 8 aa, Influenza virus
MYTPGGEV

SEQ ID NO: 282074 - protein, 8 aa, Influenza virus
YTPGGEVR

SEQ ID NO: 282075 - protein, 8 aa, Influenza virus
TPGGEVRN

SEQ ID NO: 282076 - protein, 8 aa, Influenza virus
PGGEVRND

SEQ ID NO: 282077 - protein, 8 aa, Influenza virus
GGEVRNDD

SEQ ID NO: 282078 - protein, 8 aa, Influenza virus
VRNDDVDQ

SEQ ID NO: 282079 - protein, 8 aa, Influenza virus
RNDDVDQS

SEQ ID NO: 282080 - protein, 8 aa, Influenza virus
NDDVDQSL

SEQ ID NO: 282081 - protein, 8 aa, Influenza virus
DDVDQSLI

SEQ ID NO: 282082 - protein, 8 aa, Influenza virus
DVDQSLII

SEQ ID NO: 282083 - protein, 8 aa, Influenza virus
VDQSLIIA

SEQ ID NO: 282084 - protein, 8 aa, Influenza virus
DQSLIIAA

SEQ ID NO: 282085 - protein, 8 aa, Influenza virus
QSLIIAAR

SEQ ID NO: 282086 - protein, 8 aa, Influenza virus
SLIIAARN

SEQ ID NO: 282087 - protein, 8 aa, Influenza virus
LIIAARNI

SEQ ID NO: 282088 - protein, 8 aa, Influenza virus
IIAARNIV

SEQ ID NO: 282089 - protein, 8 aa, Influenza virus
IAARNIVR

SEQ ID NO: 282090 - protein, 8 aa, Influenza virus
AARNIVRR

SEQ ID NO: 282091 - protein, 8 aa, Influenza virus
ARNIVRRA

SEQ ID NO: 282092 - protein, 8 aa, Influenza virus
RNIVRRAA

SEQ ID NO: 282093 - protein, 8 aa, Influenza virus
NIVRRAAV

SEQ ID NO: 282094 - protein, 8 aa, Influenza virus
IVRRAAVS

SEQ ID NO: 282095 - protein, 8 aa, Influenza virus
VRRAAVSA

SEQ ID NO: 282096 - protein, 8 aa, Influenza virus
RRAAVSAD

SEQ ID NO: 282097 - protein, 8 aa, Influenza virus
RAAVSADP

SEQ ID NO: 282098 - protein, 8 aa, Influenza virus
AAVSADPL

SEQ ID NO: 282099 - protein, 8 aa, Influenza virus
AVSADPLA

SEQ ID NO: 282100 - protein, 8 aa, Influenza virus
VSADPLAS

SEQ ID NO: 282101 - protein, 8 aa, Influenza virus
SADPLASL

SEQ ID NO: 282102 - protein, 8 aa, Influenza virus
ADPLASLL

SEQ ID NO: 282103 - protein, 8 aa, Influenza virus
DPLASLLE

SEQ ID NO: 282104 - protein, 8 aa, Influenza virus
PLASLLEM

SEQ ID NO: 282105 - protein, 8 aa, Influenza virus
LASLLEMC

SEQ ID NO: 282106 - protein, 8 aa, Influenza virus
ASLLEMCH

SEQ ID NO: 282107 - protein, 8 aa, Influenza virus
SLLEMCHS

SEQ ID NO: 282108 - protein, 8 aa, Influenza virus
LLEMCHST

SEQ ID NO: 282109 - protein, 8 aa, Influenza virus
LEMCHSTQ

SEQ ID NO: 282110 - protein, 8 aa, Influenza virus
EMCHSTQI

SEQ ID NO: 282111 - protein, 8 aa, Influenza virus
MCHSTQIG

SEQ ID NO: 282112 - protein, 8 aa, Influenza virus
CHSTQIGG

SEQ ID NO: 282113 - protein, 8 aa, Influenza virus
DILRQNPT

SEQ ID NO: 282114 - protein, 8 aa, Influenza virus
ILRQNPTE

SEQ ID NO: 282115 - protein, 8 aa, Influenza virus
LRQNPTEE

SEQ ID NO: 282116 - protein, 8 aa, Influenza virus
RQNPTEEQ

SEQ ID NO: 282117 - protein, 8 aa, Influenza virus
QNPTEEQA

SEQ ID NO: 282118 - protein, 8 aa, Influenza virus
NPTEEQAV

SEQ ID NO: 282119 - protein, 8 aa, Influenza virus
PTEEQAVD

SEQ ID NO: 282120 - protein, 8 aa, Influenza virus
TEEQAVDI

SEQ ID NO: 282121 - protein, 8 aa, Influenza virus
EEQAVDIC

SEQ ID NO: 282122 - protein, 8 aa, Influenza virus
EQAVDICK

SEQ ID NO: 282123 - protein, 8 aa, Influenza virus
QAVDICKA

SEQ ID NO: 282124 - protein, 8 aa, Influenza virus
AVDICKAA

SEQ ID NO: 282125 - protein, 8 aa, Influenza virus
VDICKAAM

SEQ ID NO: 282126 - protein, 8 aa, Influenza virus
DICKAAMG

SEQ ID NO: 282127 - protein, 8 aa, Influenza virus
ICKAAMGL

SEQ ID NO: 282128 - protein, 8 aa, Influenza virus
CKAAMGLR

SEQ ID NO: 282129 - protein, 8 aa, Influenza virus
KAAMGLRI

SEQ ID NO: 282130 - protein, 8 aa, Influenza virus
AAMGLRIS

SEQ ID NO: 282131 - protein, 8 aa, Influenza virus
AMGLRISS

SEQ ID NO: 282132 - protein, 8 aa, Influenza virus
MGLRISSS

SEQ ID NO: 282133 - protein, 8 aa, Influenza virus
GLRISSSF

SEQ ID NO: 282134 - protein, 8 aa, Influenza virus
LRISSSFS

SEQ ID NO: 282135 - protein, 8 aa, Influenza virus
RISSSFSF

SEQ ID NO: 282136 - protein, 8 aa, Influenza virus
ISSSFSFG

SEQ ID NO: 282137 - protein, 8 aa, Influenza virus
SSSFSFGG

SEQ ID NO: 282138 - protein, 8 aa, Influenza virus
SSFSFGGF

SEQ ID NO: 282139 - protein, 8 aa, Influenza virus
SFSFGGFT

SEQ ID NO: 282140 - protein, 8 aa, Influenza virus
FSFGGFTF

SEQ ID NO: 282141 - protein, 8 aa, Influenza virus
SFGGFTFK

SEQ ID NO: 282142 - protein, 8 aa, Influenza virus
FGGFTFKR

SEQ ID NO: 282143 - protein, 8 aa, Influenza virus
GGFTFKRT

SEQ ID NO: 282144 - protein, 8 aa, Influenza virus
GFTFKRTS

SEQ ID NO: 282145 - protein, 8 aa, Influenza virus
FTFKRTSG

SEQ ID NO: 282146 - protein, 8 aa, Influenza virus
TFKRTSGS

SEQ ID NO: 282147 - protein, 8 aa, Influenza virus
FKRTSGSS

SEQ ID NO: 282148 - protein, 8 aa, Influenza virus
EEEVLTGN

SEQ ID NO: 282149 - protein, 8 aa, Influenza virus
EEVLTGNL

SEQ ID NO: 282150 - protein, 8 aa, Influenza virus
EVLTGNLQ

SEQ ID NO: 282151 - protein, 8 aa, Influenza virus
VLTGNLQT

SEQ ID NO: 282152 - protein, 8 aa, Influenza virus
LTGNLQTL

SEQ ID NO: 282153 - protein, 8 aa, Influenza virus
TGNLQTLK

SEQ ID NO: 282154 - protein, 8 aa, Influenza virus
GNLQTLKI

SEQ ID NO: 282155 - protein, 8 aa, Influenza virus
VHEGYEEF

SEQ ID NO: 282156 - protein, 8 aa, Influenza virus
HEGYEEFT

SEQ ID NO: 282157 - protein, 8 aa, Influenza virus
EGYEEFTM

SEQ ID NO: 282158 - protein, 8 aa, Influenza virus
GYEEFTMV

SEQ ID NO: 282159 - protein, 8 aa, Influenza virus
YEEFTMVG

SEQ ID NO: 282160 - protein, 8 aa, Influenza virus
VGRRATAI

SEQ ID NO: 282161 - protein, 8 aa, Influenza virus
RATAILRK

SEQ ID NO: 282162 - protein, 8 aa, Influenza virus
ATAILRKA

SEQ ID NO: 282163 - protein, 8 aa, Influenza virus
TAILRKAT

SEQ ID NO: 282164 - protein, 8 aa, Influenza virus
AILRKATR

SEQ ID NO: 282165 - protein, 8 aa, Influenza virus
RKATRRLI

SEQ ID NO: 282166 - protein, 8 aa, Influenza virus
KATRRLIQ

SEQ ID NO: 282167 - protein, 8 aa, Influenza virus
ATRRLIQL

SEQ ID NO: 282168 - protein, 8 aa, Influenza virus
TRRLIQLI

SEQ ID NO: 282169 - protein, 8 aa, Influenza virus
RRLIQLIV

SEQ ID NO: 282170 - protein, 8 aa, Influenza virus
RLIQLIVS

SEQ ID NO: 282171 - protein, 8 aa, Influenza virus
LIQLIVSG

SEQ ID NO: 282172 - protein, 8 aa, Influenza virus
IQLIVSGR

SEQ ID NO: 282173 - protein, 8 aa, Influenza virus
QLIVSGRD

SEQ ID NO: 282174 - protein, 8 aa, Influenza virus
IVSGRDEQ

SEQ ID NO: 282175 - protein, 8 aa, Influenza virus
VSGRDEQS

SEQ ID NO: 282176 - protein, 8 aa, Influenza virus
SGRDEQSI

SEQ ID NO: 282177 - protein, 8 aa, Influenza virus
IVAMVFSQ

SEQ ID NO: 282178 - protein, 8 aa, Influenza virus
VAMVFSQE

SEQ ID NO: 282179 - protein, 8 aa, Influenza virus
AMVFSQED

SEQ ID NO: 282180 - protein, 8 aa, Influenza virus
MVFSQEDC

SEQ ID NO: 282181 - protein, 8 aa, Influenza virus
VFSQEDCM

SEQ ID NO: 282182 - protein, 8 aa, Influenza virus
FSQEDCMI

SEQ ID NO: 282183 - protein, 8 aa, Influenza virus
SQEDCMIK

SEQ ID NO: 282184 - protein, 8 aa, Influenza virus
QEDCMIKA

SEQ ID NO: 282185 - protein, 8 aa, Influenza virus
EDCMIKAV

SEQ ID NO: 282186 - protein, 8 aa, Influenza virus
DCMIKAVR

SEQ ID NO: 282187 - protein, 8 aa, Influenza virus
CMIKAVRG

SEQ ID NO: 282188 - protein, 8 aa, Influenza virus
MIKAVRGD

SEQ ID NO: 282189 - protein, 8 aa, Influenza virus
IKAVRGDL

SEQ ID NO: 282190 - protein, 8 aa, Influenza virus
KAVRGDLN

SEQ ID NO: 282191 - protein, 8 aa, Influenza virus
AVRGDLNF

SEQ ID NO: 282192 - protein, 8 aa, Influenza virus
VRGDLNFV

SEQ ID NO: 282193 - protein, 8 aa, Influenza virus
RGDLNFVN

SEQ ID NO: 282194 - protein, 8 aa, Influenza virus
GDLNFVNR

SEQ ID NO: 282195 - protein, 8 aa, Influenza virus
DLNFVNRA

SEQ ID NO: 282196 - protein, 8 aa, Influenza virus
LNFVNRAN

SEQ ID NO: 282197 - protein, 8 aa, Influenza virus
NFVNRANQ

SEQ ID NO: 282198 - protein, 8 aa, Influenza virus
FVNRANQR

SEQ ID NO: 282199 - protein, 8 aa, Influenza virus
VNRANQRL

SEQ ID NO: 282200 - protein, 8 aa, Influenza virus
NRANQRLN

SEQ ID NO: 282201 - protein, 8 aa, Influenza virus
RANQRLNP

SEQ ID NO: 282202 - protein, 8 aa, Influenza virus
ANQRLNPM

SEQ ID NO: 282203 - protein, 8 aa, Influenza virus
NQRLNPMH

SEQ ID NO: 282204 - protein, 8 aa, Influenza virus
QRLNPMHQ

SEQ ID NO: 282205 - protein, 8 aa, Influenza virus
RLNPMHQL

SEQ ID NO: 282206 - protein, 8 aa, Influenza virus
LNPMHQLL

SEQ ID NO: 282207 - protein, 8 aa, Influenza virus
NPMHQLLR

SEQ ID NO: 282208 - protein, 8 aa, Influenza virus
PMHQLLRH

SEQ ID NO: 282209 - protein, 8 aa, Influenza virus
MHQLLRHF

SEQ ID NO: 282210 - protein, 8 aa, Influenza virus
HQLLRHFQ

SEQ ID NO: 282211 - protein, 8 aa, Influenza virus
QLLRHFQK

SEQ ID NO: 282212 - protein, 8 aa, Influenza virus
LLRHFQKD

SEQ ID NO: 282213 - protein, 8 aa, Influenza virus
LRHFQKDA

SEQ ID NO: 282214 - protein, 8 aa, Influenza virus
RHFQKDAK

SEQ ID NO: 282215 - protein, 8 aa, Influenza virus
HFQKDAKV

SEQ ID NO: 282216 - protein, 8 aa, Influenza virus
FQKDAKVL

SEQ ID NO: 282217 - protein, 8 aa, Influenza virus
VMGMIGIL

SEQ ID NO: 282218 - protein, 8 aa, Influenza virus
MGMIGILP

SEQ ID NO: 282219 - protein, 8 aa, Influenza virus
GMIGILPD

SEQ ID NO: 282220 - protein, 8 aa, Influenza virus
GILPDMTP

SEQ ID NO: 282221 - protein, 8 aa, Influenza virus
RVSKMGVD

SEQ ID NO: 282222 - protein, 8 aa, Influenza virus
VSKMGVDE

SEQ ID NO: 282223 - protein, 8 aa, Influenza virus
SKMGVDEY

SEQ ID NO: 282224 - protein, 8 aa, Influenza virus
KMGVDEYS

SEQ ID NO: 282225 - protein, 8 aa, Influenza virus
MGVDEYSS

SEQ ID NO: 282226 - protein, 8 aa, Influenza virus
GVDEYSST

SEQ ID NO: 282227 - protein, 8 aa, Influenza virus
VDEYSSTE

SEQ ID NO: 282228 - protein, 8 aa, Influenza virus
DEYSSTER

SEQ ID NO: 282229 - protein, 8 aa, Influenza virus
VVSIDRFL

SEQ ID NO: 282230 - protein, 8 aa, Influenza virus
VSIDRFLR

SEQ ID NO: 282231 - protein, 8 aa, Influenza virus
SIDRFLRV

SEQ ID NO: 282232 - protein, 8 aa, Influenza virus
IDRFLRVR

SEQ ID NO: 282233 - protein, 8 aa, Influenza virus
DRFLRVRD

SEQ ID NO: 282234 - protein, 8 aa, Influenza virus
RFLRVRDQ

SEQ ID NO: 282235 - protein, 8 aa, Influenza virus
FLRVRDQR

SEQ ID NO: 282236 - protein, 8 aa, Influenza virus
LRVRDQRG

SEQ ID NO: 282237 - protein, 8 aa, Influenza virus
RVRDQRGN

SEQ ID NO: 282238 - protein, 8 aa, Influenza virus
DQRGNVLL

SEQ ID NO: 282239 - protein, 8 aa, Influenza virus
RGNVLLSP

SEQ ID NO: 282240 - protein, 8 aa, Influenza virus
GNVLLSPE

SEQ ID NO: 282241 - protein, 8 aa, Influenza virus
NVLLSPEE

SEQ ID NO: 282242 - protein, 8 aa, Influenza virus
VLLSPEEV

SEQ ID NO: 282243 - protein, 8 aa, Influenza virus
LLSPEEVS

SEQ ID NO: 282244 - protein, 8 aa, Influenza virus
LSPEEVSE

SEQ ID NO: 282245 - protein, 8 aa, Influenza virus
SPEEVSET

SEQ ID NO: 282246 - protein, 8 aa, Influenza virus
PEEVSETQ

SEQ ID NO: 282247 - protein, 8 aa, Influenza virus
EEVSETQG

SEQ ID NO: 282248 - protein, 8 aa, Influenza virus
EVSETQGT

SEQ ID NO: 282249 - protein, 8 aa, Influenza virus
VSETQGTE

SEQ ID NO: 282250 - protein, 8 aa, Influenza virus
QGTEKLTI

SEQ ID NO: 282251 - protein, 8 aa, Influenza virus
EKLTITYS

SEQ ID NO: 282252 - protein, 8 aa, Influenza virus
KLTITYSS

SEQ ID NO: 282253 - protein, 8 aa, Influenza virus
LTITYSSS

SEQ ID NO: 282254 - protein, 8 aa, Influenza virus
TITYSSSM

SEQ ID NO: 282255 - protein, 8 aa, Influenza virus
ITYSSSMM

SEQ ID NO: 282256 - protein, 8 aa, Influenza virus
TYSSSMMW

SEQ ID NO: 282257 - protein, 8 aa, Influenza virus
YSSSMMWE

SEQ ID NO: 282258 - protein, 8 aa, Influenza virus
SSSMMWEI

SEQ ID NO: 282259 - protein, 8 aa, Influenza virus
SSMMWEIN

SEQ ID NO: 282260 - protein, 8 aa, Influenza virus
SMMWEING

SEQ ID NO: 282261 - protein, 8 aa, Influenza virus
MMWEINGP

SEQ ID NO: 282262 - protein, 8 aa, Influenza virus
MWEINGPE

SEQ ID NO: 282263 - protein, 8 aa, Influenza virus
WEINGPES

SEQ ID NO: 282264 - protein, 8 aa, Influenza virus
EINGPESV

SEQ ID NO: 282265 - protein, 8 aa, Influenza virus
INGPESVL

SEQ ID NO: 282266 - protein, 8 aa, Influenza virus
NGPESVLV

SEQ ID NO: 282267 - protein, 8 aa, Influenza virus
GPESVLVN

SEQ ID NO: 282268 - protein, 8 aa, Influenza virus
PESVLVNT

SEQ ID NO: 282269 - protein, 8 aa, Influenza virus
ESVLVNTY

SEQ ID NO: 282270 - protein, 8 aa, Influenza virus
SVLVNTYQ

SEQ ID NO: 282271 - protein, 8 aa, Influenza virus
VLVNTYQW

SEQ ID NO: 282272 - protein, 8 aa, Influenza virus
LVNTYQWI

SEQ ID NO: 282273 - protein, 8 aa, Influenza virus
VNTYQWII

SEQ ID NO: 282274 - protein, 8 aa, Influenza virus
NTYQWIIR

SEQ ID NO: 282275 - protein, 8 aa, Influenza virus
TYQWIIRN

SEQ ID NO: 282276 - protein, 8 aa, Influenza virus
YQWIIRNW

SEQ ID NO: 282277 - protein, 8 aa, Influenza virus
QWIIRNWE

SEQ ID NO: 282278 - protein, 8 aa, Influenza virus
KIQWSQDP

SEQ ID NO: 282279 - protein, 8 aa, Influenza virus
IQWSQDPT

SEQ ID NO: 282280 - protein, 8 aa, Influenza virus
LYNKMEFE

SEQ ID NO: 282281 - protein, 8 aa, Influenza virus
YNKMEFEP

SEQ ID NO: 282282 - protein, 8 aa, Influenza virus
NKMEFEPF

SEQ ID NO: 282283 - protein, 8 aa, Influenza virus
KMEFEPFQ

SEQ ID NO: 282284 - protein, 8 aa, Influenza virus
MEFEPFQS

SEQ ID NO: 282285 - protein, 8 aa, Influenza virus
EFEPFQSL

SEQ ID NO: 282286 - protein, 8 aa, Influenza virus
FEPFQSLV

SEQ ID NO: 282287 - protein, 8 aa, Influenza virus
EPFQSLVP

SEQ ID NO: 282288 - protein, 8 aa, Influenza virus
PFQSLVPK

SEQ ID NO: 282289 - protein, 8 aa, Influenza virus
FQSLVPKA

SEQ ID NO: 282290 - protein, 8 aa, Influenza virus
RGQYSGFV

SEQ ID NO: 282291 - protein, 8 aa, Influenza virus
GQYSGFVR

SEQ ID NO: 282292 - protein, 8 aa, Influenza virus
QYSGFVRT

SEQ ID NO: 282293 - protein, 8 aa, Influenza virus
YSGFVRTL

SEQ ID NO: 282294 - protein, 8 aa, Influenza virus
SGFVRTLF

SEQ ID NO: 282295 - protein, 8 aa, Influenza virus
GFVRTLFQ

SEQ ID NO: 282296 - protein, 8 aa, Influenza virus
FVRTLFQQ

SEQ ID NO: 282297 - protein, 8 aa, Influenza virus
VRTLFQQM

SEQ ID NO: 282298 - protein, 8 aa, Influenza virus
RTLFQQMR

SEQ ID NO: 282299 - protein, 8 aa, Influenza virus
TLFQQMRD

SEQ ID NO: 282300 - protein, 8 aa, Influenza virus
LFQQMRDV

SEQ ID NO: 282301 - protein, 8 aa, Influenza virus
FQQMRDVL

SEQ ID NO: 282302 - protein, 8 aa, Influenza virus
QQMRDVLG

SEQ ID NO: 282303 - protein, 8 aa, Influenza virus
QMRDVLGT

SEQ ID NO: 282304 - protein, 8 aa, Influenza virus
MRDVLGTF

SEQ ID NO: 282305 - protein, 8 aa, Influenza virus
RDVLGTFD

SEQ ID NO: 282306 - protein, 8 aa, Influenza virus
DVLGTFDT

SEQ ID NO: 282307 - protein, 8 aa, Influenza virus
LGTFDTVQ

SEQ ID NO: 282308 - protein, 8 aa, Influenza virus
GTFDTVQI

SEQ ID NO: 282309 - protein, 8 aa, Influenza virus
TFDTVQII

SEQ ID NO: 282310 - protein, 8 aa, Influenza virus
FDTVQIIK

SEQ ID NO: 282311 - protein, 8 aa, Influenza virus
TVQIIKLL

SEQ ID NO: 282312 - protein, 8 aa, Influenza virus
VQIIKLLP

SEQ ID NO: 282313 - protein, 8 aa, Influenza virus
QIIKLLPF

SEQ ID NO: 282314 - protein, 8 aa, Influenza virus
IIKLLPFA

SEQ ID NO: 282315 - protein, 8 aa, Influenza virus
IKLLPFAA

SEQ ID NO: 282316 - protein, 8 aa, Influenza virus
KLLPFAAA

SEQ ID NO: 282317 - protein, 8 aa, Influenza virus
LLPFAAAP

SEQ ID NO: 282318 - protein, 8 aa, Influenza virus
LPFAAAPP

SEQ ID NO: 282319 - protein, 8 aa, Influenza virus
PFAAAPPE

SEQ ID NO: 282320 - protein, 8 aa, Influenza virus
FAAAPPEQ

SEQ ID NO: 282321 - protein, 8 aa, Influenza virus
AAAPPEQS

SEQ ID NO: 282322 - protein, 8 aa, Influenza virus
AAPPEQSR

SEQ ID NO: 282323 - protein, 8 aa, Influenza virus
APPEQSRM

SEQ ID NO: 282324 - protein, 8 aa, Influenza virus
PPEQSRMQ

SEQ ID NO: 282325 - protein, 8 aa, Influenza virus
PEQSRMQF

SEQ ID NO: 282326 - protein, 8 aa, Influenza virus
EQSRMQFS

SEQ ID NO: 282327 - protein, 8 aa, Influenza virus
QSRMQFSS

SEQ ID NO: 282328 - protein, 8 aa, Influenza virus
SRMQFSSL

SEQ ID NO: 282329 - protein, 8 aa, Influenza virus
RMQFSSLT

SEQ ID NO: 282330 - protein, 8 aa, Influenza virus
MQFSSLTV

SEQ ID NO: 282331 - protein, 8 aa, Influenza virus
QFSSLTVN

SEQ ID NO: 282332 - protein, 8 aa, Influenza virus
FSSLTVNV

SEQ ID NO: 282333 - protein, 8 aa, Influenza virus
SSLTVNVR

SEQ ID NO: 282334 - protein, 8 aa, Influenza virus
SLTVNVRG

SEQ ID NO: 282335 - protein, 8 aa, Influenza virus
LTVNVRGS

SEQ ID NO: 282336 - protein, 8 aa, Influenza virus
TVNVRGSG

SEQ ID NO: 282337 - protein, 8 aa, Influenza virus
VNVRGSGM

SEQ ID NO: 282338 - protein, 8 aa, Influenza virus
NVRGSGMR

SEQ ID NO: 282339 - protein, 8 aa, Influenza virus
VRGSGMRI

SEQ ID NO: 282340 - protein, 8 aa, Influenza virus
RGSGMRIL

SEQ ID NO: 282341 - protein, 8 aa, Influenza virus
GSGMRILV

SEQ ID NO: 282342 - protein, 8 aa, Influenza virus
SGMRILVR

SEQ ID NO: 282343 - protein, 8 aa, Influenza virus
GMRILVRG

SEQ ID NO: 282344 - protein, 8 aa, Influenza virus
MRILVRGN

SEQ ID NO: 282345 - protein, 8 aa, Influenza virus
RILVRGNS

SEQ ID NO: 282346 - protein, 8 aa, Influenza virus
ILVRGNSP

SEQ ID NO: 282347 - protein, 8 aa, Influenza virus
LVRGNSPV

SEQ ID NO: 282348 - protein, 8 aa, Influenza virus
VRGNSPVF

SEQ ID NO: 282349 - protein, 8 aa, Influenza virus
RGNSPVFN

SEQ ID NO: 282350 - protein, 8 aa, Influenza virus
GNSPVFNY

SEQ ID NO: 282351 - protein, 8 aa, Influenza virus
NSPVFNYN

SEQ ID NO: 282352 - protein, 8 aa, Influenza virus
SPVFNYNK

SEQ ID NO: 282353 - protein, 8 aa, Influenza virus
TKRLTVLG

SEQ ID NO: 282354 - protein, 8 aa, Influenza virus
KRLTVLGK

SEQ ID NO: 282355 - protein, 8 aa, Influenza virus
RLTVLGKD

SEQ ID NO: 282356 - protein, 8 aa, Influenza virus
LTVLGKDA

SEQ ID NO: 282357 - protein, 8 aa, Influenza virus
TVLGKDAG

SEQ ID NO: 282358 - protein, 8 aa, Influenza virus
LGKDAGAL

SEQ ID NO: 282359 - protein, 8 aa, Influenza virus
AGAGALAE

SEQ ID NO: 282360 - protein, 8 aa, Influenza virus
GAGALAED

SEQ ID NO: 282361 - protein, 8 aa, Influenza virus
AGVESAVL

SEQ ID NO: 282362 - protein, 8 aa, Influenza virus
GVESAVLR

SEQ ID NO: 282363 - protein, 8 aa, Influenza virus
VESAVLRG

SEQ ID NO: 282364 - protein, 8 aa, Influenza virus
ESAVLRGF

SEQ ID NO: 282365 - protein, 8 aa, Influenza virus
SAVLRGFL

SEQ ID NO: 282366 - protein, 8 aa, Influenza virus
AVLRGFLI

SEQ ID NO: 282367 - protein, 8 aa, Influenza virus
VLRGFLIL

SEQ ID NO: 282368 - protein, 8 aa, Influenza virus
LRGFLILG

SEQ ID NO: 282369 - protein, 8 aa, Influenza virus
RGFLILGK

SEQ ID NO: 282370 - protein, 8 aa, Influenza virus
GFLILGKE

SEQ ID NO: 282371 - protein, 8 aa, Influenza virus
FLILGKED

SEQ ID NO: 282372 - protein, 8 aa, Influenza virus
LILGKEDK

SEQ ID NO: 282373 - protein, 8 aa, Influenza virus
GKEDKRYG

SEQ ID NO: 282374 - protein, 8 aa, Influenza virus
QKKDKRYG

SEQ ID NO: 282375 - protein, 8 aa, Influenza virus
KEDKRYGP

SEQ ID NO: 282376 - protein, 8 aa, Influenza virus
EDKRYGPA

SEQ ID NO: 282377 - protein, 8 aa, Influenza virus
DKRYGPAL

SEQ ID NO: 282378 - protein, 8 aa, Influenza virus
KRYGPALS

SEQ ID NO: 282379 - protein, 8 aa, Influenza virus
RYGPALSI

SEQ ID NO: 282380 - protein, 8 aa, Influenza virus
YGPALSIN

SEQ ID NO: 282381 - protein, 8 aa, Influenza virus
GPALSINE

SEQ ID NO: 282382 - protein, 8 aa, Influenza virus
PALSINEL

SEQ ID NO: 282383 - protein, 8 aa, Influenza virus
ALSINELS

SEQ ID NO: 282384 - protein, 8 aa, Influenza virus
LSINELSN

SEQ ID NO: 282385 - protein, 8 aa, Influenza virus
LAKGEKAN

SEQ ID NO: 282386 - protein, 8 aa, Influenza virus
AKGEKANV

SEQ ID NO: 282387 - protein, 8 aa, Influenza virus
KGEKANVL

SEQ ID NO: 282388 - protein, 8 aa, Influenza virus
GEKANVLI

SEQ ID NO: 282389 - protein, 8 aa, Influenza virus
EKANVLIG

SEQ ID NO: 282390 - protein, 8 aa, Influenza virus
KANVLIGQ

SEQ ID NO: 282391 - protein, 8 aa, Influenza virus
ANVLIGQG

SEQ ID NO: 282392 - protein, 8 aa, Influenza virus
NVLIGQGD

SEQ ID NO: 282393 - protein, 8 aa, Influenza virus
VLIGQGDV

SEQ ID NO: 282394 - protein, 8 aa, Influenza virus
LIGQGDVV

SEQ ID NO: 282395 - protein, 8 aa, Influenza virus
IGQGDVVL

SEQ ID NO: 282396 - protein, 8 aa, Influenza virus
GQGDVVLV

SEQ ID NO: 282397 - protein, 8 aa, Influenza virus
QGDVVLVM

SEQ ID NO: 282398 - protein, 8 aa, Influenza virus
GDVVLVMK

SEQ ID NO: 282399 - protein, 8 aa, Influenza virus
DVVLVMKR

SEQ ID NO: 282400 - protein, 8 aa, Influenza virus
VVLVMKRK

SEQ ID NO: 282401 - protein, 8 aa, Influenza virus
VLVMKRKR

SEQ ID NO: 282402 - protein, 8 aa, Influenza virus
LVMKRKRD

SEQ ID NO: 282403 - protein, 8 aa, Influenza virus
VMKRKRDS

SEQ ID NO: 282404 - protein, 8 aa, Influenza virus
MKRKRDSS

SEQ ID NO: 282405 - protein, 8 aa, Influenza virus
KRKRDSSI

SEQ ID NO: 282406 - protein, 8 aa, Influenza virus
RKRDSSIL

SEQ ID NO: 282407 - protein, 8 aa, Influenza virus
KRDSSILT

SEQ ID NO: 282408 - protein, 8 aa, Influenza virus
RDSSILTD

SEQ ID NO: 282409 - protein, 8 aa, Influenza virus
DSSILTDS

SEQ ID NO: 282410 - protein, 8 aa, Influenza virus
SSILTDSQ

SEQ ID NO: 282411 - protein, 8 aa, Influenza virus
SILTDSQT

SEQ ID NO: 282412 - protein, 8 aa, Influenza virus
ILTDSQTA

SEQ ID NO: 282413 - protein, 8 aa, Influenza virus
LTDSQTAT

SEQ ID NO: 282414 - protein, 8 aa, Influenza virus
TDSQTATK

SEQ ID NO: 282415 - protein, 8 aa, Influenza virus
DSQTATKR

SEQ ID NO: 282416 - protein, 8 aa, Influenza virus
SQTATKRI

SEQ ID NO: 282417 - protein, 8 aa, Influenza virus
QTATKRIR

SEQ ID NO: 282418 - protein, 8 aa, Influenza virus
TATKRIRM

SEQ ID NO: 282419 - protein, 8 aa, Influenza virus
ATKRIRMA

SEQ ID NO: 282420 - protein, 8 aa, Influenza virus
TKRIRMAI

SEQ ID NO: 282421 - protein, 8 aa, Influenza virus
IRMAINQC

SEQ ID NO: 282422 - protein, 8 aa, Influenza virus
RMATNECR

SEQ ID NO: 282423 - protein, 8 aa, Influenza virus
MATNECRI

SEQ ID NO: 282424 - protein, 8 aa, Influenza virus
AINWGRIV

SEQ ID NO: 282425 - protein, 8 aa, Influenza virus
GKTKATKM

SEQ ID NO: 282426 - protein, 8 aa, Influenza virus
IFIFLLLT

SEQ ID NO: 282427 - protein, 8 aa, Influenza virus
FNFILLTH

SEQ ID NO: 282428 - protein, 8 aa, Influenza virus
VLSCIFCL

SEQ ID NO: 282429 - protein, 8 aa, Influenza virus
SDNADKIC

SEQ ID NO: 282430 - protein, 8 aa, Influenza virus
EKENSYPK

SEQ ID NO: 282431 - protein, 8 aa, Influenza virus
APSGVEYN

SEQ ID NO: 282432 - protein, 8 aa, Influenza virus
SGVEYNGK

SEQ ID NO: 282433 - protein, 8 aa, Influenza virus
GVEYNGKS

SEQ ID NO: 282434 - protein, 8 aa, Influenza virus
VEYNGKSL

SEQ ID NO: 282435 - protein, 8 aa, Influenza virus
EDIPIGSC

SEQ ID NO: 282436 - protein, 8 aa, Influenza virus
YGGLNKSK

SEQ ID NO: 282437 - protein, 8 aa, Influenza virus
PAKLLKER

SEQ ID NO: 282438 - protein, 8 aa, Influenza virus
KLLKERGF

SEQ ID NO: 282439 - protein, 8 aa, Influenza virus
LLKERGFF

SEQ ID NO: 282440 - protein, 8 aa, Influenza virus
RRKRGLFG

SEQ ID NO: 282441 - protein, 8 aa, Influenza virus
ETRGLFGA

SEQ ID NO: 282442 - protein, 8 aa, Influenza virus
KRRKKRGL

SEQ ID NO: 282443 - protein, 8 aa, Influenza virus
RRQKRGLF

SEQ ID NO: 282444 - protein, 8 aa, Influenza virus
RKKRGLFG

SEQ ID NO: 282445 - protein, 8 aa, Influenza virus
QKRGLFGA

SEQ ID NO: 282446 - protein, 8 aa, Influenza virus
AHKQLTHH

SEQ ID NO: 282447 - protein, 8 aa, Influenza virus
RETRGLFG

SEQ ID NO: 282448 - protein, 8 aa, Influenza virus
ETRGLFGA

SEQ ID NO: 282449 - protein, 8 aa, Influenza virus
TRGLFGAI

SEQ ID NO: 282450 - protein, 8 aa, Influenza virus
RGIFGAIA

SEQ ID NO: 282451 - protein, 8 aa, Influenza virus
GIFGAIAG

SEQ ID NO: 282452 - protein, 8 aa, Influenza virus
IFGAIAGF

SEQ ID NO: 282453 - protein, 8 aa, Influenza virus
AIAGFIEN

SEQ ID NO: 282454 - protein, 8 aa, Influenza virus
IAGFIENG

SEQ ID NO: 282455 - protein, 8 aa, Influenza virus
AGFIENGW

SEQ ID NO: 282456 - protein, 8 aa, Influenza virus
KICESRLR

SEQ ID NO: 282457 - protein, 8 aa, Influenza virus
DQNFRNIR

SEQ ID NO: 282458 - protein, 8 aa, Influenza virus
QNFRNIRK

SEQ ID NO: 282459 - protein, 8 aa, Influenza virus
LVFREQKQ

SEQ ID NO: 282460 - protein, 8 aa, Influenza virus
VFREQKQE

SEQ ID NO: 282461 - protein, 8 aa, Influenza virus
FREQKQEF

SEQ ID NO: 282462 - protein, 8 aa, Influenza virus
GSQKQEFK

SEQ ID NO: 282463 - protein, 8 aa, Influenza virus
SQKQEFKM

SEQ ID NO: 282464 - protein, 8 aa, Influenza virus
QKQEIKMN

SEQ ID NO: 282465 - protein, 8 aa, Influenza virus
KQEIKMNP

SEQ ID NO: 282466 - protein, 8 aa, Influenza virus
QEIKMNPN

SEQ ID NO: 282467 - protein, 8 aa, Influenza virus
EFKMNPNQ

SEQ ID NO: 282468 - protein, 8 aa, Influenza virus
FKMNPNQK

SEQ ID NO: 282469 - protein, 8 aa, Influenza virus
KMNPNQKI

SEQ ID NO: 282470 - protein, 8 aa, Influenza virus
ILRTQESS

SEQ ID NO: 282471 - protein, 8 aa, Influenza virus
LRTQESSC

SEQ ID NO: 282472 - protein, 8 aa, Influenza virus
RTQESECA

SEQ ID NO: 282473 - protein, 8 aa, Influenza virus
TQESECAC

SEQ ID NO: 282474 - protein, 8 aa, Influenza virus
IREGLILE

SEQ ID NO: 282475 - protein, 8 aa, Influenza virus
RKGLILEY

SEQ ID NO: 282476 - protein, 8 aa, Influenza virus
EKGKVVKS

SEQ ID NO: 282477 - protein, 8 aa, Influenza virus
IKHLEECS

SEQ ID NO: 282478 - protein, 8 aa, Influenza virus
HVEECSCY

SEQ ID NO: 282479 - protein, 8 aa, Influenza virus
VEECSCYP

SEQ ID NO: 282480 - protein, 8 aa, Influenza virus
SYLNVRCV

SEQ ID NO: 282481 - protein, 8 aa, Influenza virus
DNYGVKGF

SEQ ID NO: 282482 - protein, 8 aa, Influenza virus
LVFREQKQ

SEQ ID NO: 282483 - protein, 8 aa, Influenza virus
VFREQKQE

SEQ ID NO: 282484 - protein, 8 aa, Influenza virus
SGSQKQEF

SEQ ID NO: 282485 - protein, 8 aa, Influenza virus
GSQKQEFK

SEQ ID NO: 282486 - protein, 8 aa, Influenza virus
SQKQEFKM

SEQ ID NO: 282487 - protein, 8 aa, Influenza virus
QKQEIKMN

SEQ ID NO: 282488 - protein, 8 aa, Influenza virus
KQEIKMNP

SEQ ID NO: 282489 - protein, 8 aa, Influenza virus
QEIKMNPN

SEQ ID NO: 282490 - protein, 8 aa, Influenza virus
EFKMNPNQ

SEQ ID NO: 282491 - protein, 8 aa, Influenza virus
FKMNPNQK

SEQ ID NO: 282492 - protein, 8 aa, Influenza virus
KMNPNQKI

SEQ ID NO: 282493 - protein, 8 aa, Influenza virus
DLNMGQPF

SEQ ID NO: 282494 - protein, 8 aa, Influenza virus
GWAIYTKD

SEQ ID NO: 282495 - protein, 8 aa, Influenza virus
WAIYTKDN

SEQ ID NO: 282496 - protein, 8 aa, Influenza virus
TKDNSIRI

SEQ ID NO: 282497 - protein, 8 aa, Influenza virus
KDNSVRIG

SEQ ID NO: 282498 - protein, 8 aa, Influenza virus
DNSVRIGS

SEQ ID NO: 282499 - protein, 8 aa, Influenza virus
NSVRIGSK

SEQ ID NO: 282500 - protein, 8 aa, Influenza virus
SVRIGSKG

SEQ ID NO: 282501 - protein, 8 aa, Influenza virus
VRIGSKGD

SEQ ID NO: 282502 - protein, 8 aa, Influenza virus
RIGSKGDI

SEQ ID NO: 282503 - protein, 8 aa, Influenza virus
IGSKGDIF

SEQ ID NO: 282504 - protein, 8 aa, Influenza virus
GSKGDIFV

SEQ ID NO: 282505 - protein, 8 aa, Influenza virus
GDIFVIRE

SEQ ID NO: 282506 - protein, 8 aa, Influenza virus
DIFVIREP

SEQ ID NO: 282507 - protein, 8 aa, Influenza virus
IFVIREPF

SEQ ID NO: 282508 - protein, 8 aa, Influenza virus
FVMREPFI

SEQ ID NO: 282509 - protein, 8 aa, Influenza virus
VMREPFIS

SEQ ID NO: 282510 - protein, 8 aa, Influenza virus
MREPFISC

SEQ ID NO: 282511 - protein, 8 aa, Influenza virus
EPFISCSP

SEQ ID NO: 282512 - protein, 8 aa, Influenza virus
LECKTFFL

SEQ ID NO: 282513 - protein, 8 aa, Influenza virus
ECKTFFLT

SEQ ID NO: 282514 - protein, 8 aa, Influenza virus
CKTFFLTQ

SEQ ID NO: 282515 - protein, 8 aa, Influenza virus
KTFFLTQG

SEQ ID NO: 282516 - protein, 8 aa, Influenza virus
QGALLNDR

SEQ ID NO: 282517 - protein, 8 aa, Influenza virus
GALLNDRH

SEQ ID NO: 282518 - protein, 8 aa, Influenza virus
ALLNDRHS

SEQ ID NO: 282519 - protein, 8 aa, Influenza virus
LLNDRHSN

SEQ ID NO: 282520 - protein, 8 aa, Influenza virus
LNDRHSNG

SEQ ID NO: 282521 - protein, 8 aa, Influenza virus
NDRHSNGT

SEQ ID NO: 282522 - protein, 8 aa, Influenza virus
DKHSNGTV

SEQ ID NO: 282523 - protein, 8 aa, Influenza virus
DRSPYRAL

SEQ ID NO: 282524 - protein, 8 aa, Influenza virus
RSPYRALM

SEQ ID NO: 282525 - protein, 8 aa, Influenza virus
SPYRALMS

SEQ ID NO: 282526 - protein, 8 aa, Influenza virus
PYRALMSC

SEQ ID NO: 282527 - protein, 8 aa, Influenza virus
YRALMSCP

SEQ ID NO: 282528 - protein, 8 aa, Influenza virus
RTLMSCPV

SEQ ID NO: 282529 - protein, 8 aa, Influenza virus
TLMSCPVG

SEQ ID NO: 282530 - protein, 8 aa, Influenza virus
LMSCPVGE

SEQ ID NO: 282531 - protein, 8 aa, Influenza virus
SCPVGEAP

SEQ ID NO: 282532 - protein, 8 aa, Influenza virus
PVGEAPSP

SEQ ID NO: 282533 - protein, 8 aa, Influenza virus
VGEAPSPY

SEQ ID NO: 282534 - protein, 8 aa, Influenza virus
GEVPSPYN

SEQ ID NO: 282535 - protein, 8 aa, Influenza virus
EVPSPYNS

SEQ ID NO: 282536 - protein, 8 aa, Influenza virus
APSPYNSR

SEQ ID NO: 282537 - protein, 8 aa, Influenza virus
PSPYNSKF

SEQ ID NO: 282538 - protein, 8 aa, Influenza virus
SPYNSKFE

SEQ ID NO: 282539 - protein, 8 aa, Influenza virus
PYNSKFES

SEQ ID NO: 282540 - protein, 8 aa, Influenza virus
YNSKFESV

SEQ ID NO: 282541 - protein, 8 aa, Influenza virus
NSKFESVA

SEQ ID NO: 282542 - protein, 8 aa, Influenza virus
SKFESVAW

SEQ ID NO: 282543 - protein, 8 aa, Influenza virus
KFESVAWS

SEQ ID NO: 282544 - protein, 8 aa, Influenza virus
ASACHDGM

SEQ ID NO: 282545 - protein, 8 aa, Influenza virus
SWLTIGIS

SEQ ID NO: 282546 - protein, 8 aa, Influenza virus
WITIGISG

SEQ ID NO: 282547 - protein, 8 aa, Influenza virus
ITIGISGP

SEQ ID NO: 282548 - protein, 8 aa, Influenza virus
IGISGPDD

SEQ ID NO: 282549 - protein, 8 aa, Influenza virus
GISGPDDG

SEQ ID NO: 282550 - protein, 8 aa, Influenza virus
ISGPDDGA

SEQ ID NO: 282551 - protein, 8 aa, Influenza virus
SGPDDGAV

SEQ ID NO: 282552 - protein, 8 aa, Influenza virus
GPDDGAVA

SEQ ID NO: 282553 - protein, 8 aa, Influenza virus
PDDGAVAV

SEQ ID NO: 282554 - protein, 8 aa, Influenza virus
DDGAVAVL

SEQ ID NO: 282555 - protein, 8 aa, Influenza virus
DGAVAVLK

SEQ ID NO: 282556 - protein, 8 aa, Influenza virus
EAVAVLKY

SEQ ID NO: 282557 - protein, 8 aa, Influenza virus
AVAVVKYN

SEQ ID NO: 282558 - protein, 8 aa, Influenza virus
VAVVKYNG

SEQ ID NO: 282559 - protein, 8 aa, Influenza virus
AVLKYNGM

SEQ ID NO: 282560 - protein, 8 aa, Influenza virus
VLKYNGMI

SEQ ID NO: 282561 - protein, 8 aa, Influenza virus
LKYNGMIT

SEQ ID NO: 282562 - protein, 8 aa, Influenza virus
ITGTIKSW

SEQ ID NO: 282563 - protein, 8 aa, Influenza virus
IMRTQESE

SEQ ID NO: 282564 - protein, 8 aa, Influenza virus
RTQESECV

SEQ ID NO: 282565 - protein, 8 aa, Influenza virus
TQESECVC

SEQ ID NO: 282566 - protein, 8 aa, Influenza virus
CMNGSCFT

SEQ ID NO: 282567 - protein, 8 aa, Influenza virus
NGSCFTIM

SEQ ID NO: 282568 - protein, 8 aa, Influenza virus
GSCFTIMT

SEQ ID NO: 282569 - protein, 8 aa, Influenza virus
SCFTIMTD

SEQ ID NO: 282570 - protein, 8 aa, Influenza virus
CFTIMTDG

SEQ ID NO: 282571 - protein, 8 aa, Influenza virus
FTIMTDGP

SEQ ID NO: 282572 - protein, 8 aa, Influenza virus
TIMTDGPS

SEQ ID NO: 282573 - protein, 8 aa, Influenza virus
GKRGKWVK

SEQ ID NO: 282574 - protein, 8 aa, Influenza virus
APNFHYEE

SEQ ID NO: 282575 - protein, 8 aa, Influenza virus
PNFHYEEC

SEQ ID NO: 282576 - protein, 8 aa, Influenza virus
NFHYEECS

SEQ ID NO: 282577 - protein, 8 aa, Influenza virus
FHYEECSC

SEQ ID NO: 282578 - protein, 8 aa, Influenza virus
YYEECSCY

SEQ ID NO: 282579 - protein, 8 aa, Influenza virus
EECSCYPE

SEQ ID NO: 282580 - protein, 8 aa, Influenza virus
ECSCYPDT

SEQ ID NO: 282581 - protein, 8 aa, Influenza virus
MCVCRDNW

SEQ ID NO: 282582 - protein, 8 aa, Influenza virus
VCRDNWHA

SEQ ID NO: 282583 - protein, 8 aa, Influenza virus
CRDNWHAS

SEQ ID NO: 282584 - protein, 8 aa, Influenza virus
RDNWHASN

SEQ ID NO: 282585 - protein, 8 aa, Influenza virus
DNWHASNR

SEQ ID NO: 282586 - protein, 8 aa, Influenza virus
NWHASNRP

SEQ ID NO: 282587 - protein, 8 aa, Influenza virus
WHASNRPW

SEQ ID NO: 282588 - protein, 8 aa, Influenza virus
HASNRPWV

SEQ ID NO: 282589 - protein, 8 aa, Influenza virus
ASNRPWVS

SEQ ID NO: 282590 - protein, 8 aa, Influenza virus
SNRPWISF

SEQ ID NO: 282591 - protein, 8 aa, Influenza virus
NRPWVSFD

SEQ ID NO: 282592 - protein, 8 aa, Influenza virus
RPWVSFDQ

SEQ ID NO: 282593 - protein, 8 aa, Influenza virus
YQMGYICS

SEQ ID NO: 282594 - protein, 8 aa, Influenza virus
QMGYICSG

SEQ ID NO: 282595 - protein, 8 aa, Influenza virus
IGYICSGI

SEQ ID NO: 282596 - protein, 8 aa, Influenza virus
GYICSGIF

SEQ ID NO: 282597 - protein, 8 aa, Influenza virus
YICSGIFG

SEQ ID NO: 282598 - protein, 8 aa, Influenza virus
ICSGIFGD

SEQ ID NO: 282599 - protein, 8 aa, Influenza virus
CSGIFGDN

SEQ ID NO: 282600 - protein, 8 aa, Influenza virus
SGIFGDNP

SEQ ID NO: 282601 - protein, 8 aa, Influenza virus
GIFGDNPR

SEQ ID NO: 282602 - protein, 8 aa, Influenza virus
VFGDNPRP

SEQ ID NO: 282603 - protein, 8 aa, Influenza virus
GVKGFSYK

SEQ ID NO: 282604 - protein, 8 aa, Influenza virus
VKGFSYKY

SEQ ID NO: 282605 - protein, 8 aa, Influenza virus
KGFSYKYG

SEQ ID NO: 282606 - protein, 8 aa, Influenza virus
RYGNGVWI

SEQ ID NO: 282607 - protein, 8 aa, Influenza virus
YDNGVWIG

SEQ ID NO: 282608 - protein, 8 aa, Influenza virus
DNGVWIGR

SEQ ID NO: 282609 - protein, 8 aa, Influenza virus
DGVWIGRT

SEQ ID NO: 282610 - protein, 8 aa, Influenza virus
VWIGRTKN

SEQ ID NO: 282611 - protein, 8 aa, Influenza virus
GFEMVWDP

SEQ ID NO: 282612 - protein, 8 aa, Influenza virus
FEMIWDPD

SEQ ID NO: 282613 - protein, 8 aa, Influenza virus
EMIWDPDG

SEQ ID NO: 282614 - protein, 8 aa, Influenza virus
MIWDPDGW

SEQ ID NO: 282615 - protein, 8 aa, Influenza virus
IWDPDGWT

SEQ ID NO: 282616 - protein, 8 aa, Influenza virus
NEWSGYSG

SEQ ID NO: 282617 - protein, 8 aa, Influenza virus
EWSGYSGS

SEQ ID NO: 282618 - protein, 8 aa, Influenza virus
SGYSGSFI

SEQ ID NO: 282619 - protein, 8 aa, Influenza virus
GYSGSFIQ

SEQ ID NO: 282620 - protein, 8 aa, Influenza virus
YSGSFIQH

SEQ ID NO: 282621 - protein, 8 aa, Influenza virus
SGSFIQHP

SEQ ID NO: 282622 - protein, 8 aa, Influenza virus
GSFIQHPE

SEQ ID NO: 282623 - protein, 8 aa, Influenza virus
SFIQHPEL

SEQ ID NO: 282624 - protein, 8 aa, Influenza virus
FIQHPELT

SEQ ID NO: 282625 - protein, 8 aa, Influenza virus
IQHPELTG

SEQ ID NO: 282626 - protein, 8 aa, Influenza virus
QHPELTGM

SEQ ID NO: 282627 - protein, 8 aa, Influenza virus
HPELTGMN

SEQ ID NO: 282628 - protein, 8 aa, Influenza virus
PELTGMNC

SEQ ID NO: 282629 - protein, 8 aa, Influenza virus
DCMRPCFW

SEQ ID NO: 282630 - protein, 8 aa, Influenza virus
CMRPCFWV

SEQ ID NO: 282631 - protein, 8 aa, Influenza virus
MRPCFWVE

SEQ ID NO: 282632 - protein, 8 aa, Influenza virus
KPCFWVEL

SEQ ID NO: 282633 - protein, 8 aa, Influenza virus
PCFWVELV

SEQ ID NO: 282634 - protein, 8 aa, Influenza virus
CFWVELVR

SEQ ID NO: 282635 - protein, 8 aa, Influenza virus
FWVELVRG

SEQ ID NO: 282636 - protein, 8 aa, Influenza virus
WVELVRGL

SEQ ID NO: 282637 - protein, 8 aa, Influenza virus
VELVRGLP

SEQ ID NO: 282638 - protein, 8 aa, Influenza virus
ATIWTSGS

SEQ ID NO: 282639 - protein, 8 aa, Influenza virus
TIWASGSS

SEQ ID NO: 282640 - protein, 8 aa, Influenza virus
IWASGSSI

SEQ ID NO: 282641 - protein, 8 aa, Influenza virus
WASGSSIS

SEQ ID NO: 282642 - protein, 8 aa, Influenza virus
ASGSSISF

SEQ ID NO: 282643 - protein, 8 aa, Influenza virus
SGSIISFC

SEQ ID NO: 282644 - protein, 8 aa, Influenza virus
GSIISFCG

SEQ ID NO: 282645 - protein, 8 aa, Influenza virus
SIISFCGV

SEQ ID NO: 282646 - protein, 8 aa, Influenza virus
SISFCGVD

SEQ ID NO: 282647 - protein, 8 aa, Influenza virus
NWSWPDGA

SEQ ID NO: 282648 - protein, 8 aa, Influenza virus
WSWPDGAD

SEQ ID NO: 282649 - protein, 8 aa, Influenza virus
SWPDGADL

SEQ ID NO: 282650 - protein, 8 aa, Influenza virus
WPDGADLP

SEQ ID NO: 282651 - protein, 8 aa, Influenza virus
PDGADLPF

SEQ ID NO: 282652 - protein, 8 aa, Influenza virus
GFAPFAKD

SEQ ID NO: 282653 - protein, 8 aa, Influenza virus
FAPFAKDN

SEQ ID NO: 282654 - protein, 8 aa, Influenza virus
APFAKDNS

SEQ ID NO: 282655 - protein, 8 aa, Influenza virus
PFAKDNSI

SEQ ID NO: 282656 - protein, 8 aa, Influenza virus
FAKDNSIR

SEQ ID NO: 282657 - protein, 8 aa, Influenza virus
AKDNSIRL

SEQ ID NO: 282658 - protein, 8 aa, Influenza virus
KDNSVRLS

SEQ ID NO: 282659 - protein, 8 aa, Influenza virus
DNSVRLSA

SEQ ID NO: 282660 - protein, 8 aa, Influenza virus
NSIRLSAS

SEQ ID NO: 282661 - protein, 8 aa, Influenza virus
SIRLSASG

SEQ ID NO: 282662 - protein, 8 aa, Influenza virus
IWITREPY

SEQ ID NO: 282663 - protein, 8 aa, Influenza virus
WITREPYV

SEQ ID NO: 282664 - protein, 8 aa, Influenza virus
ITREPYVS

SEQ ID NO: 282665 - protein, 8 aa, Influenza virus
TRELYVSC

SEQ ID NO: 282666 - protein, 8 aa, Influenza virus
REPYVSCG

SEQ ID NO: 282667 - protein, 8 aa, Influenza virus
RCYQFALG

SEQ ID NO: 282668 - protein, 8 aa, Influenza virus
PHRTLLMN

SEQ ID NO: 282669 - protein, 8 aa, Influenza virus
HRTLLMNE

SEQ ID NO: 282670 - protein, 8 aa, Influenza virus
RTLLMSEL

SEQ ID NO: 282671 - protein, 8 aa, Influenza virus
TLLMSELG

SEQ ID NO: 282672 - protein, 8 aa, Influenza virus
LLMSELGV

SEQ ID NO: 282673 - protein, 8 aa, Influenza virus
LMSELGVP

SEQ ID NO: 282674 - protein, 8 aa, Influenza virus
MSELGVPF

SEQ ID NO: 282675 - protein, 8 aa, Influenza virus
SELGVPFH

SEQ ID NO: 282676 - protein, 8 aa, Influenza virus
ELGIPFHL

SEQ ID NO: 282677 - protein, 8 aa, Influenza virus
LGVPFHLA

SEQ ID NO: 282678 - protein, 8 aa, Influenza virus
GVPFHLAT

SEQ ID NO: 282679 - protein, 8 aa, Influenza virus
VPFHLGTR

SEQ ID NO: 282680 - protein, 8 aa, Influenza virus
PFHLGTRQ

SEQ ID NO: 282681 - protein, 8 aa, Influenza virus
FHLGTRQV

SEQ ID NO: 282682 - protein, 8 aa, Influenza virus
HLGTRQVC

SEQ ID NO: 282683 - protein, 8 aa, Influenza virus
TRQVCIAW

SEQ ID NO: 282684 - protein, 8 aa, Influenza virus
RQVCIAWS

SEQ ID NO: 282685 - protein, 8 aa, Influenza virus
QVCMAWSS

SEQ ID NO: 282686 - protein, 8 aa, Influenza virus
VCMAWSSS

SEQ ID NO: 282687 - protein, 8 aa, Influenza virus
CMAWSSSS

SEQ ID NO: 282688 - protein, 8 aa, Influenza virus
MAWSSSSC

SEQ ID NO: 282689 - protein, 8 aa, Influenza virus
AWSSSSCY

SEQ ID NO: 282690 - protein, 8 aa, Influenza virus
WSSSSCYD

SEQ ID NO: 282691 - protein, 8 aa, Influenza virus
SSSSCYDG

SEQ ID NO: 282692 - protein, 8 aa, Influenza virus
SSSCHDGR

SEQ ID NO: 282693 - protein, 8 aa, Influenza virus
SSCHDGRA

SEQ ID NO: 282694 - protein, 8 aa, Influenza virus
SCHDGRAW

SEQ ID NO: 282695 - protein, 8 aa, Influenza virus
CHDGRAWL

SEQ ID NO: 282696 - protein, 8 aa, Influenza virus
HDGRAWLH

SEQ ID NO: 282697 - protein, 8 aa, Influenza virus
DGRAWLHV

SEQ ID NO: 282698 - protein, 8 aa, Influenza virus
GRAWLHVC

SEQ ID NO: 282699 - protein, 8 aa, Influenza virus
AWLHVCIT

SEQ ID NO: 282700 - protein, 8 aa, Influenza virus
WLHVCITG

SEQ ID NO: 282701 - protein, 8 aa, Influenza virus
NATASIIY

SEQ ID NO: 282702 - protein, 8 aa, Influenza virus
KILRTQES

SEQ ID NO: 282703 - protein, 8 aa, Influenza virus
QESECICI

SEQ ID NO: 282704 - protein, 8 aa, Influenza virus
ESECVCIS

SEQ ID NO: 282705 - protein, 8 aa, Influenza virus
SECVCISG

SEQ ID NO: 282706 - protein, 8 aa, Influenza virus
CAVVMTDG

SEQ ID NO: 282707 - protein, 8 aa, Influenza virus
AVVMTDGS

SEQ ID NO: 282708 - protein, 8 aa, Influenza virus
VVMTDGNA

SEQ ID NO: 282709 - protein, 8 aa, Influenza virus
VMTDGNAS

SEQ ID NO: 282710 - protein, 8 aa, Influenza virus
MTDGSASE

SEQ ID NO: 282711 - protein, 8 aa, Influenza virus
IREGLILE

SEQ ID NO: 282712 - protein, 8 aa, Influenza virus
REGLILEY

SEQ ID NO: 282713 - protein, 8 aa, Influenza virus
GSAQHIEE

SEQ ID NO: 282714 - protein, 8 aa, Influenza virus
SAQHIEEC

SEQ ID NO: 282715 - protein, 8 aa, Influenza virus
AQHIEECS

SEQ ID NO: 282716 - protein, 8 aa, Influenza virus
QHIEECSC

SEQ ID NO: 282717 - protein, 8 aa, Influenza virus
HIEECSCY

SEQ ID NO: 282718 - protein, 8 aa, Influenza virus
IEECSCYP

SEQ ID NO: 282719 - protein, 8 aa, Influenza virus
EECSCYPQ

SEQ ID NO: 282720 - protein, 8 aa, Influenza virus
ECSCYPQY

SEQ ID NO: 282721 - protein, 8 aa, Influenza virus
SYPNVRCV

SEQ ID NO: 282722 - protein, 8 aa, Influenza virus
VRCICRDN

SEQ ID NO: 282723 - protein, 8 aa, Influenza virus
RCICRDNW

SEQ ID NO: 282724 - protein, 8 aa, Influenza virus
CICRDNWK

SEQ ID NO: 282725 - protein, 8 aa, Influenza virus
ICRDNWKG

SEQ ID NO: 282726 - protein, 8 aa, Influenza virus
CRDNWRGS

SEQ ID NO: 282727 - protein, 8 aa, Influenza virus
RDNWRGSN

SEQ ID NO: 282728 - protein, 8 aa, Influenza virus
DNWRGSNR

SEQ ID NO: 282729 - protein, 8 aa, Influenza virus
NWRGSNRP

SEQ ID NO: 282730 - protein, 8 aa, Influenza virus
WKGSNRPV

SEQ ID NO: 282731 - protein, 8 aa, Influenza virus
YLCSGLVG

SEQ ID NO: 282732 - protein, 8 aa, Influenza virus
LCSGLVGD

SEQ ID NO: 282733 - protein, 8 aa, Influenza virus
LVGDTPRN

SEQ ID NO: 282734 - protein, 8 aa, Influenza virus
PGVKGWAF

SEQ ID NO: 282735 - protein, 8 aa, Influenza virus
VKGWAFDN

SEQ ID NO: 282736 - protein, 8 aa, Influenza virus
DIWMGRTI

SEQ ID NO: 282737 - protein, 8 aa, Influenza virus
RSGYETFR

SEQ ID NO: 282738 - protein, 8 aa, Influenza virus
SGYETFRV

SEQ ID NO: 282739 - protein, 8 aa, Influenza virus
GYETFRVI

SEQ ID NO: 282740 - protein, 8 aa, Influenza virus
SGYSGVFS

SEQ ID NO: 282741 - protein, 8 aa, Influenza virus
GYSGVFSV

SEQ ID NO: 282742 - protein, 8 aa, Influenza virus
YSGVFSVE

SEQ ID NO: 282743 - protein, 8 aa, Influenza virus
CVNRCFYV

SEQ ID NO: 282744 - protein, 8 aa, Influenza virus
VNRCFYVE

SEQ ID NO: 282745 - protein, 8 aa, Influenza virus
YVELIRGS

SEQ ID NO: 282746 - protein, 8 aa, Influenza virus
VLWTSNSI

SEQ ID NO: 282747 - protein, 8 aa, Influenza virus
LWTSNSIV

SEQ ID NO: 282748 - protein, 8 aa, Influenza virus
WTSNSIIV

SEQ ID NO: 282749 - protein, 8 aa, Influenza virus
TSNSIIVF

SEQ ID NO: 282750 - protein, 8 aa, Influenza virus
SNSIIVFC

SEQ ID NO: 282751 - protein, 8 aa, Influenza virus
NSIIVFCG

SEQ ID NO: 282752 - protein, 8 aa, Influenza virus
SIIVFCGT

SEQ ID NO: 282753 - protein, 8 aa, Influenza virus
IIVFCGTS

SEQ ID NO: 282754 - protein, 8 aa, Influenza virus
IVFCGTSG

SEQ ID NO: 282755 - protein, 8 aa, Influenza virus
AFCGTSGT

SEQ ID NO: 282756 - protein, 8 aa, Influenza virus
GTSGTYGS

SEQ ID NO: 282757 - protein, 8 aa, Influenza virus
TSGTYGSG

SEQ ID NO: 282758 - protein, 8 aa, Influenza virus
SGTYGSGS

SEQ ID NO: 282759 - protein, 8 aa, Influenza virus
GTYGSGSW

SEQ ID NO: 282760 - protein, 8 aa, Influenza virus
TYGSGSWP

SEQ ID NO: 282761 - protein, 8 aa, Influenza virus
YGSGSWPD

SEQ ID NO: 282762 - protein, 8 aa, Influenza virus
GSGSWPDG

SEQ ID NO: 282763 - protein, 8 aa, Influenza virus
SGSWPDGA

SEQ ID NO: 282764 - protein, 8 aa, Influenza virus
GSWPDGAN

SEQ ID NO: 282765 - protein, 8 aa, Influenza virus
SWPDGANI

SEQ ID NO: 282766 - protein, 8 aa, Influenza virus
DIKSHAYI

SEQ ID NO: 282767 - protein, 8 aa, Influenza virus
INFMPYIS

SEQ ID NO: 282768 - protein, 8 aa, Influenza virus
SCLYKLSQ

SEQ ID NO: 282769 - protein, 8 aa, Influenza virus
FMPYISFA

SEQ ID NO: 282770 - protein, 8 aa, Influenza virus
ALLIGIGN

SEQ ID NO: 282771 - protein, 8 aa, Influenza virus
LLIGIGNL

SEQ ID NO: 282772 - protein, 8 aa, Influenza virus
GVGNLIFN

SEQ ID NO: 282773 - protein, 8 aa, Influenza virus
GNLIFNTV

SEQ ID NO: 282774 - protein, 8 aa, Influenza virus
NLIFNTVI

SEQ ID NO: 282775 - protein, 8 aa, Influenza virus
LIFNTVIH

SEQ ID NO: 282776 - protein, 8 aa, Influenza virus
FNTVIHGK

SEQ ID NO: 282777 - protein, 8 aa, Influenza virus
LPLCPFKG

SEQ ID NO: 282778 - protein, 8 aa, Influenza virus
PLCPFKGF

SEQ ID NO: 282779 - protein, 8 aa, Influenza virus
LCPFKGFF

SEQ ID NO: 282780 - protein, 8 aa, Influenza virus
CPFKGFFP

SEQ ID NO: 282781 - protein, 8 aa, Influenza virus
PFKGFFPF

SEQ ID NO: 282782 - protein, 8 aa, Influenza virus
FKGFFPFH

SEQ ID NO: 282783 - protein, 8 aa, Influenza virus
KGFFPFHK

SEQ ID NO: 282784 - protein, 8 aa, Influenza virus
PFHKDNAL

SEQ ID NO: 282785 - protein, 8 aa, Influenza virus
FHKDNALR

SEQ ID NO: 282786 - protein, 8 aa, Influenza virus
HKDNALRL

SEQ ID NO: 282787 - protein, 8 aa, Influenza virus
KDNALRLA

SEQ ID NO: 282788 - protein, 8 aa, Influenza virus
DNALRLAE

SEQ ID NO: 282789 - protein, 8 aa, Influenza virus
NALRLAEN

SEQ ID NO: 282790 - protein, 8 aa, Influenza virus
IIVTREPY

SEQ ID NO: 282791 - protein, 8 aa, Influenza virus
IVTREPYI

SEQ ID NO: 282792 - protein, 8 aa, Influenza virus
VTREPYIS

SEQ ID NO: 282793 - protein, 8 aa, Influenza virus
TREPYISC

SEQ ID NO: 282794 - protein, 8 aa, Influenza virus
REPYISCD

SEQ ID NO: 282795 - protein, 8 aa, Influenza virus
EPYISCDN

SEQ ID NO: 282796 - protein, 8 aa, Influenza virus
DCWSFALA

SEQ ID NO: 282797 - protein, 8 aa, Influenza virus
SFALAQGT

SEQ ID NO: 282798 - protein, 8 aa, Influenza virus
FALAQGTL

SEQ ID NO: 282799 - protein, 8 aa, Influenza virus
ALAQGALV

SEQ ID NO: 282800 - protein, 8 aa, Influenza virus
LAQGALVG

SEQ ID NO: 282801 - protein, 8 aa, Influenza virus
AQGALVGT

SEQ ID NO: 282802 - protein, 8 aa, Influenza virus
LVGTKHSN

SEQ ID NO: 282803 - protein, 8 aa, Influenza virus
LGTNHSNG

SEQ ID NO: 282804 - protein, 8 aa, Influenza virus
GTNHSNGT

SEQ ID NO: 282805 - protein, 8 aa, Influenza virus
HSNGTNKD

SEQ ID NO: 282806 - protein, 8 aa, Influenza virus
SNGTNKDR

SEQ ID NO: 282807 - protein, 8 aa, Influenza virus
NGTNKDRT

SEQ ID NO: 282808 - protein, 8 aa, Influenza virus
KDRTSYRS

SEQ ID NO: 282809 - protein, 8 aa, Influenza virus
DRTSYRSL

SEQ ID NO: 282810 - protein, 8 aa, Influenza virus
RTSYRSLI

SEQ ID NO: 282811 - protein, 8 aa, Influenza virus
TPYRSLIQ

SEQ ID NO: 282812 - protein, 8 aa, Influenza virus
PYRSLIQF

SEQ ID NO: 282813 - protein, 8 aa, Influenza virus
YRSLIQFP

SEQ ID NO: 282814 - protein, 8 aa, Influenza virus
RSLIRFPV

SEQ ID NO: 282815 - protein, 8 aa, Influenza virus
SLIRFPVG

SEQ ID NO: 282816 - protein, 8 aa, Influenza virus
GVAPVLGN

SEQ ID NO: 282817 - protein, 8 aa, Influenza virus
VAPVLGNY

SEQ ID NO: 282818 - protein, 8 aa, Influenza virus
APVLGNYR

SEQ ID NO: 282819 - protein, 8 aa, Influenza virus
PVLGNYRE

SEQ ID NO: 282820 - protein, 8 aa, Influenza virus
EICVAWSS

SEQ ID NO: 282821 - protein, 8 aa, Influenza virus
CVAWSSSS

SEQ ID NO: 282822 - protein, 8 aa, Influenza virus
VAWSSSSC

SEQ ID NO: 282823 - protein, 8 aa, Influenza virus
SSSCFDGR

SEQ ID NO: 282824 - protein, 8 aa, Influenza virus
SSCFDGRE

SEQ ID NO: 282825 - protein, 8 aa, Influenza virus
SCFDGREW

SEQ ID NO: 282826 - protein, 8 aa, Influenza virus
CFDGKEWL

SEQ ID NO: 282827 - protein, 8 aa, Influenza virus
FDGKEWLH

SEQ ID NO: 282828 - protein, 8 aa, Influenza virus
DGKEWMHI

SEQ ID NO: 282829 - protein, 8 aa, Influenza virus
GKEWMHIC

SEQ ID NO: 282830 - protein, 8 aa, Influenza virus
RDILRTQE

SEQ ID NO: 282831 - protein, 8 aa, Influenza virus
NILRTQES

SEQ ID NO: 282832 - protein, 8 aa, Influenza virus
QESECQCL

SEQ ID NO: 282833 - protein, 8 aa, Influenza virus
VTDGPAAS

SEQ ID NO: 282834 - protein, 8 aa, Influenza virus
TDGPAANN

SEQ ID NO: 282835 - protein, 8 aa, Influenza virus
DGPAANNA

SEQ ID NO: 282836 - protein, 8 aa, Influenza virus
ADHRIYWI

SEQ ID NO: 282837 - protein, 8 aa, Influenza virus
DHRIYWIR

SEQ ID NO: 282838 - protein, 8 aa, Influenza virus
KIKHLEEC

SEQ ID NO: 282839 - protein, 8 aa, Influenza virus
IKHLEECS

SEQ ID NO: 282840 - protein, 8 aa, Influenza virus
KHLEECSC

SEQ ID NO: 282841 - protein, 8 aa, Influenza virus
LEECSCYT

SEQ ID NO: 282842 - protein, 8 aa, Influenza virus
EECSCYTD

SEQ ID NO: 282843 - protein, 8 aa, Influenza virus
DVYCVCRD

SEQ ID NO: 282844 - protein, 8 aa, Influenza virus
VYCVCRDN

SEQ ID NO: 282845 - protein, 8 aa, Influenza virus
YCVCRDNW

SEQ ID NO: 282846 - protein, 8 aa, Influenza virus
CVCRDNWK

SEQ ID NO: 282847 - protein, 8 aa, Influenza virus
VCRDNWKG

SEQ ID NO: 282848 - protein, 8 aa, Influenza virus
KGSNRPWV

SEQ ID NO: 282849 - protein, 8 aa, Influenza virus
GSNRPWVR

SEQ ID NO: 282850 - protein, 8 aa, Influenza virus
SNRPWVRM

SEQ ID NO: 282851 - protein, 8 aa, Influenza virus
NRPWVRMN

SEQ ID NO: 282852 - protein, 8 aa, Influenza virus
RPWVRMNN

SEQ ID NO: 282853 - protein, 8 aa, Influenza virus
PWVRMNNE

SEQ ID NO: 282854 - protein, 8 aa, Influenza virus
WVRMNNET

SEQ ID NO: 282855 - protein, 8 aa, Influenza virus
VRMNNETI

SEQ ID NO: 282856 - protein, 8 aa, Influenza virus
RMNNETIL

SEQ ID NO: 282857 - protein, 8 aa, Influenza virus
MNNETILE

SEQ ID NO: 282858 - protein, 8 aa, Influenza virus
SNETILET

SEQ ID NO: 282859 - protein, 8 aa, Influenza virus
NETIIETG

SEQ ID NO: 282860 - protein, 8 aa, Influenza virus
ETIIETGY

SEQ ID NO: 282861 - protein, 8 aa, Influenza virus
TILETGYI

SEQ ID NO: 282862 - protein, 8 aa, Influenza virus
ILETGYIC

SEQ ID NO: 282863 - protein, 8 aa, Influenza virus
LETGYICS

SEQ ID NO: 282864 - protein, 8 aa, Influenza virus
ETGYICSK

SEQ ID NO: 282865 - protein, 8 aa, Influenza virus
TGYICSKF

SEQ ID NO: 282866 - protein, 8 aa, Influenza virus
GYICSKFH

SEQ ID NO: 282867 - protein, 8 aa, Influenza virus
YICSKFHS

SEQ ID NO: 282868 - protein, 8 aa, Influenza virus
ICSKFHSD

SEQ ID NO: 282869 - protein, 8 aa, Influenza virus
HSDTPRPD

SEQ ID NO: 282870 - protein, 8 aa, Influenza virus
SDTPRPDD

SEQ ID NO: 282871 - protein, 8 aa, Influenza virus
DTPRPDDP

SEQ ID NO: 282872 - protein, 8 aa, Influenza virus
TPRPDDPS

SEQ ID NO: 282873 - protein, 8 aa, Influenza virus
GLGVKGFG

SEQ ID NO: 282874 - protein, 8 aa, Influenza virus
RGVKGFGF

SEQ ID NO: 282875 - protein, 8 aa, Influenza virus
GVKGFGFR

SEQ ID NO: 282876 - protein, 8 aa, Influenza virus
GDDVWLGR

SEQ ID NO: 282877 - protein, 8 aa, Influenza virus
DDVWLGRT

SEQ ID NO: 282878 - protein, 8 aa, Influenza virus
DVWLGRTI

SEQ ID NO: 282879 - protein, 8 aa, Influenza virus
VWLGRTIS

SEQ ID NO: 282880 - protein, 8 aa, Influenza virus
GRSGFEVI

SEQ ID NO: 282881 - protein, 8 aa, Influenza virus
RSGFEVIK

SEQ ID NO: 282882 - protein, 8 aa, Influenza virus
SGFEVIKV

SEQ ID NO: 282883 - protein, 8 aa, Influenza virus
IKVSNGWI

SEQ ID NO: 282884 - protein, 8 aa, Influenza virus
TQTLVSNS

SEQ ID NO: 282885 - protein, 8 aa, Influenza virus
QTLVSNSD

SEQ ID NO: 282886 - protein, 8 aa, Influenza virus
TLVSNSDW

SEQ ID NO: 282887 - protein, 8 aa, Influenza virus
LVSNSDWS

SEQ ID NO: 282888 - protein, 8 aa, Influenza virus
VSNSDWSG

SEQ ID NO: 282889 - protein, 8 aa, Influenza virus
SNSDWSGY

SEQ ID NO: 282890 - protein, 8 aa, Influenza virus
NSDWSGYS

SEQ ID NO: 282891 - protein, 8 aa, Influenza virus
SDWSGYSG

SEQ ID NO: 282892 - protein, 8 aa, Influenza virus
SGYSGSFV

SEQ ID NO: 282893 - protein, 8 aa, Influenza virus
GYSGSFII

SEQ ID NO: 282894 - protein, 8 aa, Influenza virus
DCFQPCFY

SEQ ID NO: 282895 - protein, 8 aa, Influenza virus
CFQPCFYI

SEQ ID NO: 282896 - protein, 8 aa, Influenza virus
FQPCFYIE

SEQ ID NO: 282897 - protein, 8 aa, Influenza virus
QPCFYIEL

SEQ ID NO: 282898 - protein, 8 aa, Influenza virus
PCFYIELI

SEQ ID NO: 282899 - protein, 8 aa, Influenza virus
CFYIELIR

SEQ ID NO: 282900 - protein, 8 aa, Influenza virus
FYIELIRG

SEQ ID NO: 282901 - protein, 8 aa, Influenza virus
YIELIRGR

SEQ ID NO: 282902 - protein, 8 aa, Influenza virus
ELIRGKPN

SEQ ID NO: 282903 - protein, 8 aa, Influenza virus
VSWASNSI

SEQ ID NO: 282904 - protein, 8 aa, Influenza virus
SWASNSIV

SEQ ID NO: 282905 - protein, 8 aa, Influenza virus
WASNSIVT

SEQ ID NO: 282906 - protein, 8 aa, Influenza virus
TSNSMVTF

SEQ ID NO: 282907 - protein, 8 aa, Influenza virus
SNSMVTFC

SEQ ID NO: 282908 - protein, 8 aa, Influenza virus
NSMVTFCG

SEQ ID NO: 282909 - protein, 8 aa, Influenza virus
SMVTFCGL

SEQ ID NO: 282910 - protein, 8 aa, Influenza virus
IVTFCGLN

SEQ ID NO: 282911 - protein, 8 aa, Influenza virus
VTFCGLNN

SEQ ID NO: 282912 - protein, 8 aa, Influenza virus
TFCGLNNE

SEQ ID NO: 282913 - protein, 8 aa, Influenza virus
FCGLNNEP

SEQ ID NO: 282914 - protein, 8 aa, Influenza virus
CGLNNEPG

SEQ ID NO: 282915 - protein, 8 aa, Influenza virus
GLNNEPGS

SEQ ID NO: 282916 - protein, 8 aa, Influenza virus
LNNEPGSG

SEQ ID NO: 282917 - protein, 8 aa, Influenza virus
NEPGSGDW

SEQ ID NO: 282918 - protein, 8 aa, Influenza virus
EPGSGDWP

SEQ ID NO: 282919 - protein, 8 aa, Influenza virus
PGSGDWPD

SEQ ID NO: 282920 - protein, 8 aa, Influenza virus
GSGDWPDG

SEQ ID NO: 282921 - protein, 8 aa, Influenza virus
SGNWPDGA

SEQ ID NO: 282922 - protein, 8 aa, Influenza virus
WPDGANIG

SEQ ID NO: 282923 - protein, 8 aa, Influenza virus
PDGANIGF

SEQ ID NO: 282924 - protein, 8 aa, Influenza virus
DGANIGFM

SEQ ID NO: 282925 - protein, 8 aa, Influenza virus
GANIGFMP

SEQ ID NO: 282926 - protein, 8 aa, Influenza virus
ANIGFMPK

SEQ ID NO: 282927 - protein, 8 aa, Influenza virus
MNPNQSII

SEQ ID NO: 282928 - protein, 8 aa, Influenza virus
NPNQMIIT

SEQ ID NO: 282929 - protein, 8 aa, Influenza virus
PNQSIITI

SEQ ID NO: 282930 - protein, 8 aa, Influenza virus
RSKIITIG

SEQ ID NO: 282931 - protein, 8 aa, Influenza virus
QMIITIGS

SEQ ID NO: 282932 - protein, 8 aa, Influenza virus
IITIGSVS

SEQ ID NO: 282933 - protein, 8 aa, Influenza virus
LTTIGLLL

SEQ ID NO: 282934 - protein, 8 aa, Influenza virus
TTIGLLLQ

SEQ ID NO: 282935 - protein, 8 aa, Influenza virus
TIGLLLQI

SEQ ID NO: 282936 - protein, 8 aa, Influenza virus
IGLLLQIT

SEQ ID NO: 282937 - protein, 8 aa, Influenza virus
GLLLQIIS

SEQ ID NO: 282938 - protein, 8 aa, Influenza virus
LLLQIISL

SEQ ID NO: 282939 - protein, 8 aa, Influenza virus
LLQIISLC

SEQ ID NO: 282940 - protein, 8 aa, Influenza virus
LQIISLCS

SEQ ID NO: 282941 - protein, 8 aa, Influenza virus
QIISLCSI

SEQ ID NO: 282942 - protein, 8 aa, Influenza virus
IISLCSIW

SEQ ID NO: 282943 - protein, 8 aa, Influenza virus
ISLCSIWF

SEQ ID NO: 282944 - protein, 8 aa, Influenza virus
WFSHYNQM

SEQ ID NO: 282945 - protein, 8 aa, Influenza virus
FSHYNQMT

SEQ ID NO: 282946 - protein, 8 aa, Influenza virus
SHYNQMTQ

SEQ ID NO: 282947 - protein, 8 aa, Influenza virus
HYNQMTQA

SEQ ID NO: 282948 - protein, 8 aa, Influenza virus
CSNDTINY

SEQ ID NO: 282949 - protein, 8 aa, Influenza virus
SNDTINYY

SEQ ID NO: 282950 - protein, 8 aa, Influenza virus
NDTINYYN

SEQ ID NO: 282951 - protein, 8 aa, Influenza virus
DTINYYNE

SEQ ID NO: 282952 - protein, 8 aa, Influenza virus
TINYYNET

SEQ ID NO: 282953 - protein, 8 aa, Influenza virus
INYYNETF

SEQ ID NO: 282954 - protein, 8 aa, Influenza virus
YNETFVNI

SEQ ID NO: 282955 - protein, 8 aa, Influenza virus
NETFVNIT

SEQ ID NO: 282956 - protein, 8 aa, Influenza virus
ETFVNVTH

SEQ ID NO: 282957 - protein, 8 aa, Influenza virus
TFVNVTHV

SEQ ID NO: 282958 - protein, 8 aa, Influenza virus
FVNVTHVQ

SEQ ID NO: 282959 - protein, 8 aa, Influenza virus
VNVTHVQN

SEQ ID NO: 282960 - protein, 8 aa, Influenza virus
NVTHVQNN

SEQ ID NO: 282961 - protein, 8 aa, Influenza virus
VTHVQNNY

SEQ ID NO: 282962 - protein, 8 aa, Influenza virus
THVQNNYT

SEQ ID NO: 282963 - protein, 8 aa, Influenza virus
HVQNNYTT

SEQ ID NO: 282964 - protein, 8 aa, Influenza virus
VQNNYTTI

SEQ ID NO: 282965 - protein, 8 aa, Influenza virus
LCPVKGWA

SEQ ID NO: 282966 - protein, 8 aa, Influenza virus
CPVKGWAP

SEQ ID NO: 282967 - protein, 8 aa, Influenza virus
PVKGWAPL

SEQ ID NO: 282968 - protein, 8 aa, Influenza virus
VKGWAPLS

SEQ ID NO: 282969 - protein, 8 aa, Influenza virus
KGWAPLSK

SEQ ID NO: 282970 - protein, 8 aa, Influenza virus
VFVIREPC

SEQ ID NO: 282971 - protein, 8 aa, Influenza virus
FVIREPCI

SEQ ID NO: 282972 - protein, 8 aa, Influenza virus
VIREPFVS

SEQ ID NO: 282973 - protein, 8 aa, Influenza virus
IREPCISC

SEQ ID NO: 282974 - protein, 8 aa, Influenza virus
REPCISCS

SEQ ID NO: 282975 - protein, 8 aa, Influenza virus
EPFISCSV

SEQ ID NO: 282976 - protein, 8 aa, Influenza virus
ISCSINEC

SEQ ID NO: 282977 - protein, 8 aa, Influenza virus
SCSINECR

SEQ ID NO: 282978 - protein, 8 aa, Influenza virus
CSINECRT

SEQ ID NO: 282979 - protein, 8 aa, Influenza virus
SINECRTF

SEQ ID NO: 282980 - protein, 8 aa, Influenza virus
INECRTFF

SEQ ID NO: 282981 - protein, 8 aa, Influenza virus
NECRTFFL

SEQ ID NO: 282982 - protein, 8 aa, Influenza virus
RTLMSCPM

SEQ ID NO: 282983 - protein, 8 aa, Influenza virus
TLMSCPMG

SEQ ID NO: 282984 - protein, 8 aa, Influenza virus
LMSCPMGV

SEQ ID NO: 282985 - protein, 8 aa, Influenza virus
MSCPMGVA

SEQ ID NO: 282986 - protein, 8 aa, Influenza virus
SCPMGVAP

SEQ ID NO: 282987 - protein, 8 aa, Influenza virus
CPMGVAPS

SEQ ID NO: 282988 - protein, 8 aa, Influenza virus
PMGVAPSP

SEQ ID NO: 282989 - protein, 8 aa, Influenza virus
MGVAPSPS

SEQ ID NO: 282990 - protein, 8 aa, Influenza virus
ATACSDGS

SEQ ID NO: 282991 - protein, 8 aa, Influenza virus
TACSDGSG

SEQ ID NO: 282992 - protein, 8 aa, Influenza virus
ACSDGSGW

SEQ ID NO: 282993 - protein, 8 aa, Influenza virus
CSDGSGWL

SEQ ID NO: 282994 - protein, 8 aa, Influenza virus
SDGSGWLT

SEQ ID NO: 282995 - protein, 8 aa, Influenza virus
DGPGWLTI

SEQ ID NO: 282996 - protein, 8 aa, Influenza virus
GPGWLTIG

SEQ ID NO: 282997 - protein, 8 aa, Influenza virus
PGWLTIGI

SEQ ID NO: 282998 - protein, 8 aa, Influenza virus
GWLTIGIT

SEQ ID NO: 282999 - protein, 8 aa, Influenza virus
WLTIGITG

SEQ ID NO: 283000 - protein, 8 aa, Influenza virus
LTIGITGP

SEQ ID NO: 283001 - protein, 8 aa, Influenza virus
TIGITGPD

SEQ ID NO: 283002 - protein, 8 aa, Influenza virus
LGITGPDS

SEQ ID NO: 283003 - protein, 8 aa, Influenza virus
GITGPDST

SEQ ID NO: 283004 - protein, 8 aa, Influenza virus
ITGPDSTA

SEQ ID NO: 283005 - protein, 8 aa, Influenza virus
TGPDSTAV

SEQ ID NO: 283006 - protein, 8 aa, Influenza virus
GPDSTAVA

SEQ ID NO: 283007 - protein, 8 aa, Influenza virus
PDSTAVAV

SEQ ID NO: 283008 - protein, 8 aa, Influenza virus
DSTAVAVI

SEQ ID NO: 283009 - protein, 8 aa, Influenza virus
STAVAVIK

SEQ ID NO: 283010 - protein, 8 aa, Influenza virus
TAVAVIKY

SEQ ID NO: 283011 - protein, 8 aa, Influenza virus
AVAVIKYN

SEQ ID NO: 283012 - protein, 8 aa, Influenza virus
VAVIKYNG

SEQ ID NO: 283013 - protein, 8 aa, Influenza virus
AVIKYNGI

SEQ ID NO: 283014 - protein, 8 aa, Influenza virus
VIKYNGII

SEQ ID NO: 283015 - protein, 8 aa, Influenza virus
IKYNGIIT

SEQ ID NO: 283016 - protein, 8 aa, Influenza virus
KYNGVITD

SEQ ID NO: 283017 - protein, 8 aa, Influenza virus
YNGVITDT

SEQ ID NO: 283018 - protein, 8 aa, Influenza virus
NGVITDTL

SEQ ID NO: 283019 - protein, 8 aa, Influenza virus
GVITDTLK

SEQ ID NO: 283020 - protein, 8 aa, Influenza virus
VITDTLKS

SEQ ID NO: 283021 - protein, 8 aa, Influenza virus
ITDTFKSW

SEQ ID NO: 283022 - protein, 8 aa, Influenza virus
TDTFKSWK

SEQ ID NO: 283023 - protein, 8 aa, Influenza virus
DTFKSWKG

SEQ ID NO: 283024 - protein, 8 aa, Influenza virus
TFKSWKGN

SEQ ID NO: 283025 - protein, 8 aa, Influenza virus
FKSWKGNI

SEQ ID NO: 283026 - protein, 8 aa, Influenza virus
DEFCYTLM

SEQ ID NO: 283027 - protein, 8 aa, Influenza virus
EFCYTLMT

SEQ ID NO: 283028 - protein, 8 aa, Influenza virus
FCYTLMTD

SEQ ID NO: 283029 - protein, 8 aa, Influenza virus
CYTLMTDG

SEQ ID NO: 283030 - protein, 8 aa, Influenza virus
YTLMTDGP

SEQ ID NO: 283031 - protein, 8 aa, Influenza virus
TLMTDGPS

SEQ ID NO: 283032 - protein, 8 aa, Influenza virus
LMTDGPSD

SEQ ID NO: 283033 - protein, 8 aa, Influenza virus
MTDGPSDA

SEQ ID NO: 283034 - protein, 8 aa, Influenza virus
TDGPSNAQ

SEQ ID NO: 283035 - protein, 8 aa, Influenza virus
DGPSNAQA

SEQ ID NO: 283036 - protein, 8 aa, Influenza virus
GPSNAQAF

SEQ ID NO: 283037 - protein, 8 aa, Influenza virus
PSNAQAFY

SEQ ID NO: 283038 - protein, 8 aa, Influenza virus
SNAQAFYK

SEQ ID NO: 283039 - protein, 8 aa, Influenza virus
NAQAFYKI

SEQ ID NO: 283040 - protein, 8 aa, Influenza virus
AQAFYKLL

SEQ ID NO: 283041 - protein, 8 aa, Influenza virus
FYKILKIK

SEQ ID NO: 283042 - protein, 8 aa, Influenza virus
YKILKIKK

SEQ ID NO: 283043 - protein, 8 aa, Influenza virus
KILKIKKG

SEQ ID NO: 283044 - protein, 8 aa, Influenza virus
ILKIKKGK

SEQ ID NO: 283045 - protein, 8 aa, Influenza virus
LKIKKGKI

SEQ ID NO: 283046 - protein, 8 aa, Influenza virus
KIKKGKIV

SEQ ID NO: 283047 - protein, 8 aa, Influenza virus
DVDATGYH

SEQ ID NO: 283048 - protein, 8 aa, Influenza virus
ATGYHFEE

SEQ ID NO: 283049 - protein, 8 aa, Influenza virus
TGYHFEEC

SEQ ID NO: 283050 - protein, 8 aa, Influenza virus
GYHFEECS

SEQ ID NO: 283051 - protein, 8 aa, Influenza virus
YHFEECSC

SEQ ID NO: 283052 - protein, 8 aa, Influenza virus
CSCYPSGE

SEQ ID NO: 283053 - protein, 8 aa, Influenza virus
SCYPSGEN

SEQ ID NO: 283054 - protein, 8 aa, Influenza virus
NVECVCRD

SEQ ID NO: 283055 - protein, 8 aa, Influenza virus
VECVCRDN

SEQ ID NO: 283056 - protein, 8 aa, Influenza virus
QGSNRPWI

SEQ ID NO: 283057 - protein, 8 aa, Influenza virus
PWIRFNSN

SEQ ID NO: 283058 - protein, 8 aa, Influenza virus
WIRFNSNL

SEQ ID NO: 283059 - protein, 8 aa, Influenza virus
IRFNSNLD

SEQ ID NO: 283060 - protein, 8 aa, Influenza virus
RFNSNLDY

SEQ ID NO: 283061 - protein, 8 aa, Influenza virus
FNSNLDYQ

SEQ ID NO: 283062 - protein, 8 aa, Influenza virus
NSNLDYQI

SEQ ID NO: 283063 - protein, 8 aa, Influenza virus
SNLDYQIG

SEQ ID NO: 283064 - protein, 8 aa, Influenza virus
NLDYQIGY

SEQ ID NO: 283065 - protein, 8 aa, Influenza virus
LDYQIGYI

SEQ ID NO: 283066 - protein, 8 aa, Influenza virus
DYQIGYIC

SEQ ID NO: 283067 - protein, 8 aa, Influenza virus
YQIGYICS

SEQ ID NO: 283068 - protein, 8 aa, Influenza virus
QIGYICSG

SEQ ID NO: 283069 - protein, 8 aa, Influenza virus
IGYVCSGV

SEQ ID NO: 283070 - protein, 8 aa, Influenza virus
GYVCSGVF

SEQ ID NO: 283071 - protein, 8 aa, Influenza virus
YVCSGVFG

SEQ ID NO: 283072 - protein, 8 aa, Influenza virus
VCSGVFGD

SEQ ID NO: 283073 - protein, 8 aa, Influenza virus
CSGVFGDN

SEQ ID NO: 283074 - protein, 8 aa, Influenza virus
SGVFGDNP

SEQ ID NO: 283075 - protein, 8 aa, Influenza virus
GVFGDNPR

SEQ ID NO: 283076 - protein, 8 aa, Influenza virus
VFGDNPRP

SEQ ID NO: 283077 - protein, 8 aa, Influenza virus
FGDNPRPA

SEQ ID NO: 283078 - protein, 8 aa, Influenza virus
GDNPRPAD

SEQ ID NO: 283079 - protein, 8 aa, Influenza virus
DNPRPADG

SEQ ID NO: 283080 - protein, 8 aa, Influenza virus
PRPADGTG

SEQ ID NO: 283081 - protein, 8 aa, Influenza virus
RPADGTGS

SEQ ID NO: 283082 - protein, 8 aa, Influenza virus
PADGTGSC

SEQ ID NO: 283083 - protein, 8 aa, Influenza virus
GPINNGKG

SEQ ID NO: 283084 - protein, 8 aa, Influenza virus
PINNGKGR

SEQ ID NO: 283085 - protein, 8 aa, Influenza virus
INNGKGRY

SEQ ID NO: 283086 - protein, 8 aa, Influenza virus
TKSLESRR

SEQ ID NO: 283087 - protein, 8 aa, Influenza virus
KNLESRSG

SEQ ID NO: 283088 - protein, 8 aa, Influenza virus
NLESRSGF

SEQ ID NO: 283089 - protein, 8 aa, Influenza virus
SRSGFEMI

SEQ ID NO: 283090 - protein, 8 aa, Influenza virus
RSGFEMIW

SEQ ID NO: 283091 - protein, 8 aa, Influenza virus
SGFEMIWD

SEQ ID NO: 283092 - protein, 8 aa, Influenza virus
GFEMIWDA

SEQ ID NO: 283093 - protein, 8 aa, Influenza virus
FEMIWDAN

SEQ ID NO: 283094 - protein, 8 aa, Influenza virus
EMIWDANG

SEQ ID NO: 283095 - protein, 8 aa, Influenza virus
MIWDANGW

SEQ ID NO: 283096 - protein, 8 aa, Influenza virus
IWDANGWV

SEQ ID NO: 283097 - protein, 8 aa, Influenza virus
WDANGWVT

SEQ ID NO: 283098 - protein, 8 aa, Influenza virus
DANGWVTA

SEQ ID NO: 283099 - protein, 8 aa, Influenza virus
DNGWVSTD

SEQ ID NO: 283100 - protein, 8 aa, Influenza virus
GWVSTDKN

SEQ ID NO: 283101 - protein, 8 aa, Influenza virus
WVSTDKNS

SEQ ID NO: 283102 - protein, 8 aa, Influenza virus
VSTDKNSN

SEQ ID NO: 283103 - protein, 8 aa, Influenza virus
STDKNSNG

SEQ ID NO: 283104 - protein, 8 aa, Influenza virus
TDKNSNGV

SEQ ID NO: 283105 - protein, 8 aa, Influenza virus
DKNSNGVQ

SEQ ID NO: 283106 - protein, 8 aa, Influenza virus
KNSNGVQD

SEQ ID NO: 283107 - protein, 8 aa, Influenza virus
NSNGVQDI

SEQ ID NO: 283108 - protein, 8 aa, Influenza virus
VQDIIDNN

SEQ ID NO: 283109 - protein, 8 aa, Influenza virus
QDIIDNNN

SEQ ID NO: 283110 - protein, 8 aa, Influenza virus
DIIDNNNW

SEQ ID NO: 283111 - protein, 8 aa, Influenza virus
IIDNNNWS

SEQ ID NO: 283112 - protein, 8 aa, Influenza virus
IDNNNWSG

SEQ ID NO: 283113 - protein, 8 aa, Influenza virus
DNNNWSGY

SEQ ID NO: 283114 - protein, 8 aa, Influenza virus
NNNWSGYS

SEQ ID NO: 283115 - protein, 8 aa, Influenza virus
NNWSGYSG

SEQ ID NO: 283116 - protein, 8 aa, Influenza virus
SGSFSIRW

SEQ ID NO: 283117 - protein, 8 aa, Influenza virus
GSFSIRWE

SEQ ID NO: 283118 - protein, 8 aa, Influenza virus
SFSIRWET

SEQ ID NO: 283119 - protein, 8 aa, Influenza virus
FSIRWETT

SEQ ID NO: 283120 - protein, 8 aa, Influenza virus
SIRWETTG

SEQ ID NO: 283121 - protein, 8 aa, Influenza virus
IRWETTGR

SEQ ID NO: 283122 - protein, 8 aa, Influenza virus
RWETTGRN

SEQ ID NO: 283123 - protein, 8 aa, Influenza virus
WETTGRNC

SEQ ID NO: 283124 - protein, 8 aa, Influenza virus
TTGRNCTI

SEQ ID NO: 283125 - protein, 8 aa, Influenza virus
TGRNCTIP

SEQ ID NO: 283126 - protein, 8 aa, Influenza virus
GRNCTIPC

SEQ ID NO: 283127 - protein, 8 aa, Influenza virus
RNCTIPCF

SEQ ID NO: 283128 - protein, 8 aa, Influenza virus
NCTIPCFW

SEQ ID NO: 283129 - protein, 8 aa, Influenza virus
CTIPCFWV

SEQ ID NO: 283130 - protein, 8 aa, Influenza virus
TIPCFWVE

SEQ ID NO: 283131 - protein, 8 aa, Influenza virus
IPCFWVEM

SEQ ID NO: 283132 - protein, 8 aa, Influenza virus
IRGQPKER

SEQ ID NO: 283133 - protein, 8 aa, Influenza virus
RGQPKEKA

SEQ ID NO: 283134 - protein, 8 aa, Influenza virus
GQPKEKAI

SEQ ID NO: 283135 - protein, 8 aa, Influenza virus
QPKEKAIW

SEQ ID NO: 283136 - protein, 8 aa, Influenza virus
PKEKAIWT

SEQ ID NO: 283137 - protein, 8 aa, Influenza virus
KEKAIWTS

SEQ ID NO: 283138 - protein, 8 aa, Influenza virus
EKAIWTSG

SEQ ID NO: 283139 - protein, 8 aa, Influenza virus
KAIWTSGS

SEQ ID NO: 283140 - protein, 8 aa, Influenza virus
AIWTSGSS

SEQ ID NO: 283141 - protein, 8 aa, Influenza virus
SIAFCGVD

SEQ ID NO: 283142 - protein, 8 aa, Influenza virus
IAFCGVDS

SEQ ID NO: 283143 - protein, 8 aa, Influenza virus
AFCGVDSD

SEQ ID NO: 283144 - protein, 8 aa, Influenza virus
FCGVDSDT

SEQ ID NO: 283145 - protein, 8 aa, Influenza virus
CGVDSDTT

SEQ ID NO: 283146 - protein, 8 aa, Influenza virus
GVDSDTTG

SEQ ID NO: 283147 - protein, 8 aa, Influenza virus
VDSDTTGW

SEQ ID NO: 283148 - protein, 8 aa, Influenza virus
SDTTSWSW

SEQ ID NO: 283149 - protein, 8 aa, Influenza virus
DTTSWSWP

SEQ ID NO: 283150 - protein, 8 aa, Influenza virus
TTSWSWPD

SEQ ID NO: 283151 - protein, 8 aa, Influenza virus
TSWSWPDG

SEQ ID NO: 283152 - protein, 8 aa, Influenza virus
SWSWPDGA

SEQ ID NO: 283153 - protein, 8 aa, Influenza virus
SWPDGALF

SEQ ID NO: 283154 - protein, 8 aa, Influenza virus
PDGALLPL

SEQ ID NO: 283155 - protein, 8 aa, Influenza virus
DGALLPLT

SEQ ID NO: 283156 - protein, 8 aa, Influenza virus
LLPFDIDR

SEQ ID NO: 283157 - protein, 8 aa, Influenza virus
KIITIGSI

SEQ ID NO: 283158 - protein, 8 aa, Influenza virus
IITIGSIS

SEQ ID NO: 283159 - protein, 8 aa, Influenza virus
ITIGSISL

SEQ ID NO: 283160 - protein, 8 aa, Influenza virus
TIGSISLG

SEQ ID NO: 283161 - protein, 8 aa, Influenza virus
IGSISLGL

SEQ ID NO: 283162 - protein, 8 aa, Influenza virus
GSISLGLV

SEQ ID NO: 283163 - protein, 8 aa, Influenza virus
NILLHVAS

SEQ ID NO: 283164 - protein, 8 aa, Influenza virus
ILLHVASI

SEQ ID NO: 283165 - protein, 8 aa, Influenza virus
TTEIYNET

SEQ ID NO: 283166 - protein, 8 aa, Influenza virus
TEIYNETV

SEQ ID NO: 283167 - protein, 8 aa, Influenza virus
EIYNETVR

SEQ ID NO: 283168 - protein, 8 aa, Influenza virus
VYNETVRL

SEQ ID NO: 283169 - protein, 8 aa, Influenza virus
YNETVRVE

SEQ ID NO: 283170 - protein, 8 aa, Influenza virus
NETVRVET

SEQ ID NO: 283171 - protein, 8 aa, Influenza virus
ETVRVETV

SEQ ID NO: 283172 - protein, 8 aa, Influenza virus
VTIPINNT

SEQ ID NO: 283173 - protein, 8 aa, Influenza virus
IIPVNNTI

SEQ ID NO: 283174 - protein, 8 aa, Influenza virus
IPVNNTIY

SEQ ID NO: 283175 - protein, 8 aa, Influenza virus
DFLNNTEP

SEQ ID NO: 283176 - protein, 8 aa, Influenza virus
FFNNTEPL

SEQ ID NO: 283177 - protein, 8 aa, Influenza virus
FNNTEPLC

SEQ ID NO: 283178 - protein, 8 aa, Influenza virus
NNTEPLCE

SEQ ID NO: 283179 - protein, 8 aa, Influenza virus
NTEPLCEV

SEQ ID NO: 283180 - protein, 8 aa, Influenza virus
TEPLCEVS

SEQ ID NO: 283181 - protein, 8 aa, Influenza virus
EPLCEVSG

SEQ ID NO: 283182 - protein, 8 aa, Influenza virus
PLCEVSGF

SEQ ID NO: 283183 - protein, 8 aa, Influenza virus
LCEVSGFA

SEQ ID NO: 283184 - protein, 8 aa, Influenza virus
CEVSGFAI

SEQ ID NO: 283185 - protein, 8 aa, Influenza virus
SGFAIISK

SEQ ID NO: 283186 - protein, 8 aa, Influenza virus
GFAIFSKD

SEQ ID NO: 283187 - protein, 8 aa, Influenza virus
FAIFSKDN

SEQ ID NO: 283188 - protein, 8 aa, Influenza virus
AIISKDNG

SEQ ID NO: 283189 - protein, 8 aa, Influenza virus
IISKDNGI

SEQ ID NO: 283190 - protein, 8 aa, Influenza virus
ISKDNGIR

SEQ ID NO: 283191 - protein, 8 aa, Influenza virus
SKDNGIRV

SEQ ID NO: 283192 - protein, 8 aa, Influenza virus
KDNGIRVG

SEQ ID NO: 283193 - protein, 8 aa, Influenza virus
DNGIRVGS

SEQ ID NO: 283194 - protein, 8 aa, Influenza virus
NGIRVGSR

SEQ ID NO: 283195 - protein, 8 aa, Influenza virus
GIRVGSRG

SEQ ID NO: 283196 - protein, 8 aa, Influenza virus
IRVGSRGH

SEQ ID NO: 283197 - protein, 8 aa, Influenza virus
RIGSRGHI

SEQ ID NO: 283198 - protein, 8 aa, Influenza virus
IGSRGHIF

SEQ ID NO: 283199 - protein, 8 aa, Influenza virus
GSRGHIFV

SEQ ID NO: 283200 - protein, 8 aa, Influenza virus
SRGHIFVI

SEQ ID NO: 283201 - protein, 8 aa, Influenza virus
RGHIFVIR

SEQ ID NO: 283202 - protein, 8 aa, Influenza virus
GHIFVIRE

SEQ ID NO: 283203 - protein, 8 aa, Influenza virus
HIFVIREP

SEQ ID NO: 283204 - protein, 8 aa, Influenza virus
IFVIREPF

SEQ ID NO: 283205 - protein, 8 aa, Influenza virus
VIREPFVS

SEQ ID NO: 283206 - protein, 8 aa, Influenza virus
IREPFVSC

SEQ ID NO: 283207 - protein, 8 aa, Influenza virus
REPFVSCG

SEQ ID NO: 283208 - protein, 8 aa, Influenza virus
EPFVSCGP

SEQ ID NO: 283209 - protein, 8 aa, Influenza virus
PFVACGPS

SEQ ID NO: 283210 - protein, 8 aa, Influenza virus
FVACGPSE

SEQ ID NO: 283211 - protein, 8 aa, Influenza virus
VACGPSEC

SEQ ID NO: 283212 - protein, 8 aa, Influenza virus
ACGPSECR

SEQ ID NO: 283213 - protein, 8 aa, Influenza virus
CGPSECRT

SEQ ID NO: 283214 - protein, 8 aa, Influenza virus
GPSECRTF

SEQ ID NO: 283215 - protein, 8 aa, Influenza virus
PSECRTFF

SEQ ID NO: 283216 - protein, 8 aa, Influenza virus
SECRTFFL

SEQ ID NO: 283217 - protein, 8 aa, Influenza virus
QGALLNDR

SEQ ID NO: 283218 - protein, 8 aa, Influenza virus
CVLLNDKH

SEQ ID NO: 283219 - protein, 8 aa, Influenza virus
VLLNDKHS

SEQ ID NO: 283220 - protein, 8 aa, Influenza virus
RHSNNTVK

SEQ ID NO: 283221 - protein, 8 aa, Influenza virus
RALMSVPM

SEQ ID NO: 283222 - protein, 8 aa, Influenza virus
ALMSVPMG

SEQ ID NO: 283223 - protein, 8 aa, Influenza virus
LMSVLLGS

SEQ ID NO: 283224 - protein, 8 aa, Influenza virus
MSVPMGSS

SEQ ID NO: 283225 - protein, 8 aa, Influenza virus
SVPLGSSS

SEQ ID NO: 283226 - protein, 8 aa, Influenza virus
VLLGSSPN

SEQ ID NO: 283227 - protein, 8 aa, Influenza virus
PLGSSSNA

SEQ ID NO: 283228 - protein, 8 aa, Influenza virus
MGSSPNAY

SEQ ID NO: 283229 - protein, 8 aa, Influenza virus
SPNAYQAR

SEQ ID NO: 283230 - protein, 8 aa, Influenza virus
PNAYQARF

SEQ ID NO: 283231 - protein, 8 aa, Influenza virus
NAYQARFE

SEQ ID NO: 283232 - protein, 8 aa, Influenza virus
AYQARFES

SEQ ID NO: 283233 - protein, 8 aa, Influenza virus
YQARFESV

SEQ ID NO: 283234 - protein, 8 aa, Influenza virus
FESVGWSA

SEQ ID NO: 283235 - protein, 8 aa, Influenza virus
ESVGWSAT

SEQ ID NO: 283236 - protein, 8 aa, Influenza virus
SVGWSATA

SEQ ID NO: 283237 - protein, 8 aa, Influenza virus
VGWSATAC

SEQ ID NO: 283238 - protein, 8 aa, Influenza virus
GWSATACH

SEQ ID NO: 283239 - protein, 8 aa, Influenza virus
TACHDGKK

SEQ ID NO: 283240 - protein, 8 aa, Influenza virus
ACHDGKKW

SEQ ID NO: 283241 - protein, 8 aa, Influenza virus
CHDGKKWL

SEQ ID NO: 283242 - protein, 8 aa, Influenza virus
WMAIGVSG

SEQ ID NO: 283243 - protein, 8 aa, Influenza virus
GVSGADDD

SEQ ID NO: 283244 - protein, 8 aa, Influenza virus
VSGADDDA

SEQ ID NO: 283245 - protein, 8 aa, Influenza virus
SGADNDAY

SEQ ID NO: 283246 - protein, 8 aa, Influenza virus
GADNDAYA

SEQ ID NO: 283247 - protein, 8 aa, Influenza virus
ADNDAYAV

SEQ ID NO: 283248 - protein, 8 aa, Influenza virus
DNDAYAVI

SEQ ID NO: 283249 - protein, 8 aa, Influenza virus
NDAYAVIH

SEQ ID NO: 283250 - protein, 8 aa, Influenza virus
AVIHYGGV

SEQ ID NO: 283251 - protein, 8 aa, Influenza virus
VIHYGGVP

SEQ ID NO: 283252 - protein, 8 aa, Influenza virus
IHYGGVPT

SEQ ID NO: 283253 - protein, 8 aa, Influenza virus
HYGGVPTD

SEQ ID NO: 283254 - protein, 8 aa, Influenza virus
YGGVPTDV

SEQ ID NO: 283255 - protein, 8 aa, Influenza virus
GGVPTDVV

SEQ ID NO: 283256 - protein, 8 aa, Influenza virus
GVPTDVVR

SEQ ID NO: 283257 - protein, 8 aa, Influenza virus
VPTDVVRS

SEQ ID NO: 283258 - protein, 8 aa, Influenza virus
PTDVIRSW

SEQ ID NO: 283259 - protein, 8 aa, Influenza virus
TDVVRSWK

SEQ ID NO: 283260 - protein, 8 aa, Influenza virus
DVVRSWKK

SEQ ID NO: 283261 - protein, 8 aa, Influenza virus
VVRSWKKQ

SEQ ID NO: 283262 - protein, 8 aa, Influenza virus
VRSWKKQI

SEQ ID NO: 283263 - protein, 8 aa, Influenza virus
RSWKKQIL

SEQ ID NO: 283264 - protein, 8 aa, Influenza virus
SWKKQILR

SEQ ID NO: 283265 - protein, 8 aa, Influenza virus
WKKQILRT

SEQ ID NO: 283266 - protein, 8 aa, Influenza virus
KKQILRTQ

SEQ ID NO: 283267 - protein, 8 aa, Influenza virus
KKILRTQE

SEQ ID NO: 283268 - protein, 8 aa, Influenza virus
KILRTQES

SEQ ID NO: 283269 - protein, 8 aa, Influenza virus
QESSCVCV

SEQ ID NO: 283270 - protein, 8 aa, Influenza virus
ESSCVCMN

SEQ ID NO: 283271 - protein, 8 aa, Influenza virus
SSCVCMNG

SEQ ID NO: 283272 - protein, 8 aa, Influenza virus
VMTDGPAS

SEQ ID NO: 283273 - protein, 8 aa, Influenza virus
MTDGPANS

SEQ ID NO: 283274 - protein, 8 aa, Influenza virus
TDGPANSQ

SEQ ID NO: 283275 - protein, 8 aa, Influenza virus
DGPANSQA

SEQ ID NO: 283276 - protein, 8 aa, Influenza virus
GPANSQAS

SEQ ID NO: 283277 - protein, 8 aa, Influenza virus
PANSQASY

SEQ ID NO: 283278 - protein, 8 aa, Influenza virus
ANSQASYK

SEQ ID NO: 283279 - protein, 8 aa, Influenza virus
NSQASYKI

SEQ ID NO: 283280 - protein, 8 aa, Influenza virus
SQASYKIF

SEQ ID NO: 283281 - protein, 8 aa, Influenza virus
QASYRIFK

SEQ ID NO: 283282 - protein, 8 aa, Influenza virus
ASYRIFKS

SEQ ID NO: 283283 - protein, 8 aa, Influenza virus
SYKIFKSQ

SEQ ID NO: 283284 - protein, 8 aa, Influenza virus
EISFQGGH

SEQ ID NO: 283285 - protein, 8 aa, Influenza virus
ISFQGGHI

SEQ ID NO: 283286 - protein, 8 aa, Influenza virus
LFQGGHIE

SEQ ID NO: 283287 - protein, 8 aa, Influenza virus
FRGGHIEE

SEQ ID NO: 283288 - protein, 8 aa, Influenza virus
QSGHIEEC

SEQ ID NO: 283289 - protein, 8 aa, Influenza virus
ECSCYPNM

SEQ ID NO: 283290 - protein, 8 aa, Influenza virus
CSCYPNMG

SEQ ID NO: 283291 - protein, 8 aa, Influenza virus
SCYPNMGK

SEQ ID NO: 283292 - protein, 8 aa, Influenza virus
CYPNMGKV

SEQ ID NO: 283293 - protein, 8 aa, Influenza virus
YPNMGKVE

SEQ ID NO: 283294 - protein, 8 aa, Influenza virus
PNMGKVEC

SEQ ID NO: 283295 - protein, 8 aa, Influenza virus
NMGKVECV

SEQ ID NO: 283296 - protein, 8 aa, Influenza virus
MGKVECVC

SEQ ID NO: 283297 - protein, 8 aa, Influenza virus
GQVECVCR

SEQ ID NO: 283298 - protein, 8 aa, Influenza virus
QVECVCRD

SEQ ID NO: 283299 - protein, 8 aa, Influenza virus
WNGMNRPV

SEQ ID NO: 283300 - protein, 8 aa, Influenza virus
NGMNRPVL

SEQ ID NO: 283301 - protein, 8 aa, Influenza virus
YNVGYLCA

SEQ ID NO: 283302 - protein, 8 aa, Influenza virus
NVGYLCAG

SEQ ID NO: 283303 - protein, 8 aa, Influenza virus
IPTDTPRI

SEQ ID NO: 283304 - protein, 8 aa, Influenza virus
PTDTPRIQ

SEQ ID NO: 283305 - protein, 8 aa, Influenza virus
TDTPRIQD

SEQ ID NO: 283306 - protein, 8 aa, Influenza virus
DTPRVQDN

SEQ ID NO: 283307 - protein, 8 aa, Influenza virus
NAIGGSGT

SEQ ID NO: 283308 - protein, 8 aa, Influenza virus
AIGGSGTN

SEQ ID NO: 283309 - protein, 8 aa, Influenza virus
IGGSGTNN

SEQ ID NO: 283310 - protein, 8 aa, Influenza virus
GGSGTDNY

SEQ ID NO: 283311 - protein, 8 aa, Influenza virus
GSGTDNYG

SEQ ID NO: 283312 - protein, 8 aa, Influenza virus
SGTDNYGV

SEQ ID NO: 283313 - protein, 8 aa, Influenza virus
GTDNYGVK

SEQ ID NO: 283314 - protein, 8 aa, Influenza virus
TDNYGVKG

SEQ ID NO: 283315 - protein, 8 aa, Influenza virus
DNYGVKGF

SEQ ID NO: 283316 - protein, 8 aa, Influenza virus
GFGFRQGT

SEQ ID NO: 283317 - protein, 8 aa, Influenza virus
FGFRQGTS

SEQ ID NO: 283318 - protein, 8 aa, Influenza virus
GFRQGTSV

SEQ ID NO: 283319 - protein, 8 aa, Influenza virus
FRQGTSVW

SEQ ID NO: 283320 - protein, 8 aa, Influenza virus
RQGTSVWA

SEQ ID NO: 283321 - protein, 8 aa, Influenza virus
QGTSVWAG

SEQ ID NO: 283322 - protein, 8 aa, Influenza virus
GTSVWAGR

SEQ ID NO: 283323 - protein, 8 aa, Influenza virus
TSVWAGRT

SEQ ID NO: 283324 - protein, 8 aa, Influenza virus
SVWAGRTI

SEQ ID NO: 283325 - protein, 8 aa, Influenza virus
VWAGRTIS

SEQ ID NO: 283326 - protein, 8 aa, Influenza virus
STSSRSGF

SEQ ID NO: 283327 - protein, 8 aa, Influenza virus
TSSRSGFE

SEQ ID NO: 283328 - protein, 8 aa, Influenza virus
SSRSGFEV

SEQ ID NO: 283329 - protein, 8 aa, Influenza virus
SRSGFEVL

SEQ ID NO: 283330 - protein, 8 aa, Influenza virus
RSGFEVLL

SEQ ID NO: 283331 - protein, 8 aa, Influenza virus
SGFEVLLI

SEQ ID NO: 283332 - protein, 8 aa, Influenza virus
GFEVLLIE

SEQ ID NO: 283333 - protein, 8 aa, Influenza virus
FEVLLIED

SEQ ID NO: 283334 - protein, 8 aa, Influenza virus
EVLLIEDG

SEQ ID NO: 283335 - protein, 8 aa, Influenza virus
VLLIEDGW

SEQ ID NO: 283336 - protein, 8 aa, Influenza virus
EILNNKNW

SEQ ID NO: 283337 - protein, 8 aa, Influenza virus
VLNNRNWS

SEQ ID NO: 283338 - protein, 8 aa, Influenza virus
LNNMNWSG

SEQ ID NO: 283339 - protein, 8 aa, Influenza virus
NNRNWSGY

SEQ ID NO: 283340 - protein, 8 aa, Influenza virus
NRNWSGYS

SEQ ID NO: 283341 - protein, 8 aa, Influenza virus
RNWSGYSG

SEQ ID NO: 283342 - protein, 8 aa, Influenza virus
NWSGYSGS

SEQ ID NO: 283343 - protein, 8 aa, Influenza virus
WSGYSGSF

SEQ ID NO: 283344 - protein, 8 aa, Influenza virus
SGYSGSFT

SEQ ID NO: 283345 - protein, 8 aa, Influenza virus
GYSGSFTI

SEQ ID NO: 283346 - protein, 8 aa, Influenza virus
YSGSFTIP

SEQ ID NO: 283347 - protein, 8 aa, Influenza virus
SGAFTIPT

SEQ ID NO: 283348 - protein, 8 aa, Influenza virus
FTIPTAMT

SEQ ID NO: 283349 - protein, 8 aa, Influenza virus
CIVPCFWL

SEQ ID NO: 283350 - protein, 8 aa, Influenza virus
IVPCFWLE

SEQ ID NO: 283351 - protein, 8 aa, Influenza virus
WLEMIRGR

SEQ ID NO: 283352 - protein, 8 aa, Influenza virus
LEMIRGRP

SEQ ID NO: 283353 - protein, 8 aa, Influenza virus
EMIRGRPE

SEQ ID NO: 283354 - protein, 8 aa, Influenza virus
MIRGRPEE

SEQ ID NO: 283355 - protein, 8 aa, Influenza virus
IRGKPEEG

SEQ ID NO: 283356 - protein, 8 aa, Influenza virus
PEEGTSIW

SEQ ID NO: 283357 - protein, 8 aa, Influenza virus
EEGTSIWT

SEQ ID NO: 283358 - protein, 8 aa, Influenza virus
EGTSIWTS

SEQ ID NO: 283359 - protein, 8 aa, Influenza virus
GTSIWTSS

SEQ ID NO: 283360 - protein, 8 aa, Influenza virus
NSIWTSSS

SEQ ID NO: 283361 - protein, 8 aa, Influenza virus
TVFCGVSG

SEQ ID NO: 283362 - protein, 8 aa, Influenza virus
VFCGVSGE

SEQ ID NO: 283363 - protein, 8 aa, Influenza virus
FCGVSGEV

SEQ ID NO: 283364 - protein, 8 aa, Influenza virus
CGVSGEVP

SEQ ID NO: 283365 - protein, 8 aa, Influenza virus
GVSGEVPG

SEQ ID NO: 283366 - protein, 8 aa, Influenza virus
VSGEVPGW

SEQ ID NO: 283367 - protein, 8 aa, Influenza virus
SGEVPGWS

SEQ ID NO: 283368 - protein, 8 aa, Influenza virus
GEVPGWSW

SEQ ID NO: 283369 - protein, 8 aa, Influenza virus
EAPGWSWD

SEQ ID NO: 283370 - protein, 8 aa, Influenza virus
VPGWSWGD

SEQ ID NO: 283371 - protein, 8 aa, Influenza virus
PEWSWDDG

SEQ ID NO: 283372 - protein, 8 aa, Influenza virus
EWSWDDGA

SEQ ID NO: 283373 - protein, 8 aa, Influenza virus
DDGAILPL

SEQ ID NO: 283374 - protein, 8 aa, Influenza virus
DGAILPFG

SEQ ID NO: 283375 - protein, 8 aa, Influenza virus
GAILPLTS

SEQ ID NO: 283376 - protein, 8 aa, Influenza virus
AILPFGID

SEQ ID NO: 283377 - protein, 8 aa, Influenza virus
ILPLTSIR

SEQ ID NO: 283378 - protein, 8 aa, Influenza virus
MNPNQKIT

SEQ ID NO: 283379 - protein, 8 aa, Influenza virus
NPNQKITC

SEQ ID NO: 283380 - protein, 8 aa, Influenza virus
PNQKITCI

SEQ ID NO: 283381 - protein, 8 aa, Influenza virus
NQKITCIS

SEQ ID NO: 283382 - protein, 8 aa, Influenza virus
QKITCISA

SEQ ID NO: 283383 - protein, 8 aa, Influenza virus
ITCISATG

SEQ ID NO: 283384 - protein, 8 aa, Influenza virus
CISATGVT

SEQ ID NO: 283385 - protein, 8 aa, Influenza virus
ISATGVTL

SEQ ID NO: 283386 - protein, 8 aa, Influenza virus
SATGVTLS

SEQ ID NO: 283387 - protein, 8 aa, Influenza virus
ATGVTLSV

SEQ ID NO: 283388 - protein, 8 aa, Influenza virus
TGVTLSVV

SEQ ID NO: 283389 - protein, 8 aa, Influenza virus
GVTLSVVS

SEQ ID NO: 283390 - protein, 8 aa, Influenza virus
VTLSVVSL

SEQ ID NO: 283391 - protein, 8 aa, Influenza virus
ALSVVSLL

SEQ ID NO: 283392 - protein, 8 aa, Influenza virus
LSVVSLLV

SEQ ID NO: 283393 - protein, 8 aa, Influenza virus
SVVSLLVG

SEQ ID NO: 283394 - protein, 8 aa, Influenza virus
GIANLGLN

SEQ ID NO: 283395 - protein, 8 aa, Influenza virus
IANLGLNI

SEQ ID NO: 283396 - protein, 8 aa, Influenza virus
ANLGLNVG

SEQ ID NO: 283397 - protein, 8 aa, Influenza virus
NLGLNIGI

SEQ ID NO: 283398 - protein, 8 aa, Influenza virus
LGLNIGIH

SEQ ID NO: 283399 - protein, 8 aa, Influenza virus
LTKPLCEV

SEQ ID NO: 283400 - protein, 8 aa, Influenza virus
KPLCEVSS

SEQ ID NO: 283401 - protein, 8 aa, Influenza virus
PLCEVSSW

SEQ ID NO: 283402 - protein, 8 aa, Influenza virus
LCEVSSWH

SEQ ID NO: 283403 - protein, 8 aa, Influenza virus
CEVSSWHI

SEQ ID NO: 283404 - protein, 8 aa, Influenza virus
EVSSWHIL

SEQ ID NO: 283405 - protein, 8 aa, Influenza virus
VSSWHILS

SEQ ID NO: 283406 - protein, 8 aa, Influenza virus
SSWHILSK

SEQ ID NO: 283407 - protein, 8 aa, Influenza virus
SWHIFSKD

SEQ ID NO: 283408 - protein, 8 aa, Influenza virus
WHIFSKDN

SEQ ID NO: 283409 - protein, 8 aa, Influenza virus
HIFSKDNA

SEQ ID NO: 283410 - protein, 8 aa, Influenza virus
IFSKDNAI

SEQ ID NO: 283411 - protein, 8 aa, Influenza virus
FSKDNAIR

SEQ ID NO: 283412 - protein, 8 aa, Influenza virus
NAIRIGEN

SEQ ID NO: 283413 - protein, 8 aa, Influenza virus
AIRIGENA

SEQ ID NO: 283414 - protein, 8 aa, Influenza virus
IRIGENAH

SEQ ID NO: 283415 - protein, 8 aa, Influenza virus
RIGENAHI

SEQ ID NO: 283416 - protein, 8 aa, Influenza virus
IGENAHIL

SEQ ID NO: 283417 - protein, 8 aa, Influenza virus
NAHILVTR

SEQ ID NO: 283418 - protein, 8 aa, Influenza virus
AHVLVTRE

SEQ ID NO: 283419 - protein, 8 aa, Influenza virus
HVLVTREP

SEQ ID NO: 283420 - protein, 8 aa, Influenza virus
VLVTREPY

SEQ ID NO: 283421 - protein, 8 aa, Influenza virus
REPYLSCD

SEQ ID NO: 283422 - protein, 8 aa, Influenza virus
EPYLSCDP

SEQ ID NO: 283423 - protein, 8 aa, Influenza virus
GCRMFALS

SEQ ID NO: 283424 - protein, 8 aa, Influenza virus
SQGTTLKG

SEQ ID NO: 283425 - protein, 8 aa, Influenza virus
QGTTLRGQ

SEQ ID NO: 283426 - protein, 8 aa, Influenza virus
GTTLRGQH

SEQ ID NO: 283427 - protein, 8 aa, Influenza virus
TTLRGQHA

SEQ ID NO: 283428 - protein, 8 aa, Influenza virus
TLRGQHAN

SEQ ID NO: 283429 - protein, 8 aa, Influenza virus
LRGQHANG

SEQ ID NO: 283430 - protein, 8 aa, Influenza virus
RGQHANGT

SEQ ID NO: 283431 - protein, 8 aa, Influenza virus
GQHANGTI

SEQ ID NO: 283432 - protein, 8 aa, Influenza virus
QHANGTIH

SEQ ID NO: 283433 - protein, 8 aa, Influenza virus
HANGTMHD

SEQ ID NO: 283434 - protein, 8 aa, Influenza virus
ANGTMHDR

SEQ ID NO: 283435 - protein, 8 aa, Influenza virus
NGTMHDRS

SEQ ID NO: 283436 - protein, 8 aa, Influenza virus
GTIHDRSQ

SEQ ID NO: 283437 - protein, 8 aa, Influenza virus
TIHDRSQF

SEQ ID NO: 283438 - protein, 8 aa, Influenza virus
IHDRSQFR

SEQ ID NO: 283439 - protein, 8 aa, Influenza virus
HDRSQFRA

SEQ ID NO: 283440 - protein, 8 aa, Influenza virus
DRSQFRAL

SEQ ID NO: 283441 - protein, 8 aa, Influenza virus
RSPFRALV

SEQ ID NO: 283442 - protein, 8 aa, Influenza virus
SPFRALVS

SEQ ID NO: 283443 - protein, 8 aa, Influenza virus
PFRALVSW

SEQ ID NO: 283444 - protein, 8 aa, Influenza virus
FRALVSWE

SEQ ID NO: 283445 - protein, 8 aa, Influenza virus
RALVSWEM

SEQ ID NO: 283446 - protein, 8 aa, Influenza virus
ALVSWEMG

SEQ ID NO: 283447 - protein, 8 aa, Influenza virus
LVSWEMGQ

SEQ ID NO: 283448 - protein, 8 aa, Influenza virus
VSWEMGQA

SEQ ID NO: 283449 - protein, 8 aa, Influenza virus
SWGMGQAP

SEQ ID NO: 283450 - protein, 8 aa, Influenza virus
WGMGQAPS

SEQ ID NO: 283451 - protein, 8 aa, Influenza virus
GMGQAPSP

SEQ ID NO: 283452 - protein, 8 aa, Influenza virus
MGLAPSPY

SEQ ID NO: 283453 - protein, 8 aa, Influenza virus
GQAPSPYT

SEQ ID NO: 283454 - protein, 8 aa, Influenza virus
VECIGWSS

SEQ ID NO: 283455 - protein, 8 aa, Influenza virus
ECIGWSST

SEQ ID NO: 283456 - protein, 8 aa, Influenza virus
CIGWSSTS

SEQ ID NO: 283457 - protein, 8 aa, Influenza virus
IGWSSTSC

SEQ ID NO: 283458 - protein, 8 aa, Influenza virus
STSCHDGM

SEQ ID NO: 283459 - protein, 8 aa, Influenza virus
TSCHDGMS

SEQ ID NO: 283460 - protein, 8 aa, Influenza virus
SCHDGMSR

SEQ ID NO: 283461 - protein, 8 aa, Influenza virus
CHDGMSRM

SEQ ID NO: 283462 - protein, 8 aa, Influenza virus
HDGMSRMS

SEQ ID NO: 283463 - protein, 8 aa, Influenza virus
SRMSICIS

SEQ ID NO: 283464 - protein, 8 aa, Influenza virus
RMSICISG

SEQ ID NO: 283465 - protein, 8 aa, Influenza virus
MSICISGP

SEQ ID NO: 283466 - protein, 8 aa, Influenza virus
SICISGPN

SEQ ID NO: 283467 - protein, 8 aa, Influenza virus
ICISGPNN

SEQ ID NO: 283468 - protein, 8 aa, Influenza virus
CISGPNNN

SEQ ID NO: 283469 - protein, 8 aa, Influenza virus
ISGPNNNA

SEQ ID NO: 283470 - protein, 8 aa, Influenza virus
SGPNDNAS

SEQ ID NO: 283471 - protein, 8 aa, Influenza virus
GPNDNASA

SEQ ID NO: 283472 - protein, 8 aa, Influenza virus
PNDNASAV

SEQ ID NO: 283473 - protein, 8 aa, Influenza virus
NDNASAVV

SEQ ID NO: 283474 - protein, 8 aa, Influenza virus
DNASAVVW

SEQ ID NO: 283475 - protein, 8 aa, Influenza virus
NASAVIWY

SEQ ID NO: 283476 - protein, 8 aa, Influenza virus
TEIPSWAG

SEQ ID NO: 283477 - protein, 8 aa, Influenza virus
EIPSWAGN

SEQ ID NO: 283478 - protein, 8 aa, Influenza virus
IPSWAGNI

SEQ ID NO: 283479 - protein, 8 aa, Influenza virus
PSWAGNIL

SEQ ID NO: 283480 - protein, 8 aa, Influenza virus
SWEGNILR

SEQ ID NO: 283481 - protein, 8 aa, Influenza virus
WEGNILRT

SEQ ID NO: 283482 - protein, 8 aa, Influenza virus
EGNILRTQ

SEQ ID NO: 283483 - protein, 8 aa, Influenza virus
ESECVCHK

SEQ ID NO: 283484 - protein, 8 aa, Influenza virus
SECVCHKG

SEQ ID NO: 283485 - protein, 8 aa, Influenza virus
ECVCHKGI

SEQ ID NO: 283486 - protein, 8 aa, Influenza virus
CVCHKGIC

SEQ ID NO: 283487 - protein, 8 aa, Influenza virus
VCHKGICP

SEQ ID NO: 283488 - protein, 8 aa, Influenza virus
CHKGICPV

SEQ ID NO: 283489 - protein, 8 aa, Influenza virus
HKGICPVV

SEQ ID NO: 283490 - protein, 8 aa, Influenza virus
GVCPVVMT

SEQ ID NO: 283491 - protein, 8 aa, Influenza virus
VCPVVMTD

SEQ ID NO: 283492 - protein, 8 aa, Influenza virus
VMTDGPAS

SEQ ID NO: 283493 - protein, 8 aa, Influenza virus
MTDGPASN

SEQ ID NO: 283494 - protein, 8 aa, Influenza virus
TDGPANNK

SEQ ID NO: 283495 - protein, 8 aa, Influenza virus
DGPANNKA

SEQ ID NO: 283496 - protein, 8 aa, Influenza virus
GNAQHIEE

SEQ ID NO: 283497 - protein, 8 aa, Influenza virus
NAQHIEEC

SEQ ID NO: 283498 - protein, 8 aa, Influenza virus
EECSCYGS

SEQ ID NO: 283499 - protein, 8 aa, Influenza virus
VKCICRDN

SEQ ID NO: 283500 - protein, 8 aa, Influenza virus
KCVCRDNW

SEQ ID NO: 283501 - protein, 8 aa, Influenza virus
CVCRDNWK

SEQ ID NO: 283502 - protein, 8 aa, Influenza virus
VCRDNWKG

SEQ ID NO: 283503 - protein, 8 aa, Influenza virus
CRDNWRGA

SEQ ID NO: 283504 - protein, 8 aa, Influenza virus
RDNWRGAN

SEQ ID NO: 283505 - protein, 8 aa, Influenza virus
DNWRGANR

SEQ ID NO: 283506 - protein, 8 aa, Influenza virus
NWRGANRP

SEQ ID NO: 283507 - protein, 8 aa, Influenza virus
WKGANRPI

SEQ ID NO: 283508 - protein, 8 aa, Influenza virus
KGANRPII

SEQ ID NO: 283509 - protein, 8 aa, Influenza virus
GANRPVII

SEQ ID NO: 283510 - protein, 8 aa, Influenza virus
ANRPVIII

SEQ ID NO: 283511 - protein, 8 aa, Influenza virus
NRPVITID

SEQ ID NO: 283512 - protein, 8 aa, Influenza virus
MTHMSKYL

SEQ ID NO: 283513 - protein, 8 aa, Influenza virus
THMSKYLC

SEQ ID NO: 283514 - protein, 8 aa, Influenza virus
HMSKYLCS

SEQ ID NO: 283515 - protein, 8 aa, Influenza virus
YLCSKVLT

SEQ ID NO: 283516 - protein, 8 aa, Influenza virus
LCSKVLTD

SEQ ID NO: 283517 - protein, 8 aa, Influenza virus
CSKVLTDT

SEQ ID NO: 283518 - protein, 8 aa, Influenza virus
SKVLTDTS

SEQ ID NO: 283519 - protein, 8 aa, Influenza virus
KVLTDTSR

SEQ ID NO: 283520 - protein, 8 aa, Influenza virus
VLTDTSRP

SEQ ID NO: 283521 - protein, 8 aa, Influenza virus
LTDTSRPS

SEQ ID NO: 283522 - protein, 8 aa, Influenza virus
TDTSRPSD

SEQ ID NO: 283523 - protein, 8 aa, Influenza virus
DTSRPSDP

SEQ ID NO: 283524 - protein, 8 aa, Influenza virus
GGGPDPGV

SEQ ID NO: 283525 - protein, 8 aa, Influenza virus
GGPDPGVK

SEQ ID NO: 283526 - protein, 8 aa, Influenza virus
GPDPGVKG

SEQ ID NO: 283527 - protein, 8 aa, Influenza virus
VKGFAFLN

SEQ ID NO: 283528 - protein, 8 aa, Influenza virus
KGFAFLNG

SEQ ID NO: 283529 - protein, 8 aa, Influenza virus
ENSWLGRT

SEQ ID NO: 283530 - protein, 8 aa, Influenza virus
NSWLGRTT

SEQ ID NO: 283531 - protein, 8 aa, Influenza virus
SWLGRTTS

SEQ ID NO: 283532 - protein, 8 aa, Influenza virus
WLGRTTSK

SEQ ID NO: 283533 - protein, 8 aa, Influenza virus
LGRTTSKD

SEQ ID NO: 283534 - protein, 8 aa, Influenza virus
GRTTSKDS

SEQ ID NO: 283535 - protein, 8 aa, Influenza virus
RTTSKDSR

SEQ ID NO: 283536 - protein, 8 aa, Influenza virus
TTSKDSRS

SEQ ID NO: 283537 - protein, 8 aa, Influenza virus
TSKDSRSG

SEQ ID NO: 283538 - protein, 8 aa, Influenza virus
SKDLRSGY

SEQ ID NO: 283539 - protein, 8 aa, Influenza virus
KDLRSGYE

SEQ ID NO: 283540 - protein, 8 aa, Influenza virus
DSRSGYEV

SEQ ID NO: 283541 - protein, 8 aa, Influenza virus
SRSGYEVL

SEQ ID NO: 283542 - protein, 8 aa, Influenza virus
RSGYEVLK

SEQ ID NO: 283543 - protein, 8 aa, Influenza virus
SGYEVLKV

SEQ ID NO: 283544 - protein, 8 aa, Influenza virus
GYEVLKVP

SEQ ID NO: 283545 - protein, 8 aa, Influenza virus
YEVLKVPN

SEQ ID NO: 283546 - protein, 8 aa, Influenza virus
EVLKVPNA

SEQ ID NO: 283547 - protein, 8 aa, Influenza virus
VLKVPNAE

SEQ ID NO: 283548 - protein, 8 aa, Influenza virus
LKVPNAEI

SEQ ID NO: 283549 - protein, 8 aa, Influenza virus
IVNNQDWS

SEQ ID NO: 283550 - protein, 8 aa, Influenza virus
VNNQDWSG

SEQ ID NO: 283551 - protein, 8 aa, Influenza virus
NNQDWSGY

SEQ ID NO: 283552 - protein, 8 aa, Influenza virus
NQDWSGYS

SEQ ID NO: 283553 - protein, 8 aa, Influenza virus
QDWSGYSG

SEQ ID NO: 283554 - protein, 8 aa, Influenza virus
NWSGYSGS

SEQ ID NO: 283555 - protein, 8 aa, Influenza virus
WSGYSGSF

SEQ ID NO: 283556 - protein, 8 aa, Influenza virus
SGYSGSFI

SEQ ID NO: 283557 - protein, 8 aa, Influenza virus
GYSGSFID

SEQ ID NO: 283558 - protein, 8 aa, Influenza virus
YSGSFIDY

SEQ ID NO: 283559 - protein, 8 aa, Influenza virus
SGSFIDYW

SEQ ID NO: 283560 - protein, 8 aa, Influenza virus
KECFNPCF

SEQ ID NO: 283561 - protein, 8 aa, Influenza virus
YVELIRGM

SEQ ID NO: 283562 - protein, 8 aa, Influenza virus
VELIRGMP

SEQ ID NO: 283563 - protein, 8 aa, Influenza virus
ELIRGMPK

SEQ ID NO: 283564 - protein, 8 aa, Influenza virus
LIRGMPKE

SEQ ID NO: 283565 - protein, 8 aa, Influenza virus
IRGRPKEN

SEQ ID NO: 283566 - protein, 8 aa, Influenza virus
ESSVFWTS

SEQ ID NO: 283567 - protein, 8 aa, Influenza virus
SSVFWTSN

SEQ ID NO: 283568 - protein, 8 aa, Influenza virus
SVFWTSNS

SEQ ID NO: 283569 - protein, 8 aa, Influenza virus
VFWTSNSI

SEQ ID NO: 283570 - protein, 8 aa, Influenza virus
FWTSNSIV

SEQ ID NO: 283571 - protein, 8 aa, Influenza virus
IVALCGSR

SEQ ID NO: 283572 - protein, 8 aa, Influenza virus
VALCGSRE

SEQ ID NO: 283573 - protein, 8 aa, Influenza virus
ALCGSRER

SEQ ID NO: 283574 - protein, 8 aa, Influenza virus
LCGSRERL

SEQ ID NO: 283575 - protein, 8 aa, Influenza virus
CGSRERLG

SEQ ID NO: 283576 - protein, 8 aa, Influenza virus
GSRERLGS

SEQ ID NO: 283577 - protein, 8 aa, Influenza virus
SRERLGSW

SEQ ID NO: 283578 - protein, 8 aa, Influenza virus
RERLGSWS

SEQ ID NO: 283579 - protein, 8 aa, Influenza virus
EQLGSWSW

SEQ ID NO: 283580 - protein, 8 aa, Influenza virus
QLGSWSWH

SEQ ID NO: 283581 - protein, 8 aa, Influenza virus
WHDGAEIT

SEQ ID NO: 283582 - protein, 8 aa, Influenza virus
HDGAEITY

SEQ ID NO: 283583 - protein, 8 aa, Influenza virus
DGAEITYF

SEQ ID NO: 283584 - protein, 8 aa, Influenza virus
GAEITYFK

SEQ ID NO: 283585 - protein, 8 aa, Influenza virus
MNPSQKLF

SEQ ID NO: 283586 - protein, 8 aa, Influenza virus
NPNQKLFT

SEQ ID NO: 283587 - protein, 8 aa, Influenza virus
PNQKLFAS

SEQ ID NO: 283588 - protein, 8 aa, Influenza virus
NQKLFASS

SEQ ID NO: 283589 - protein, 8 aa, Influenza virus
QKLFASSG

SEQ ID NO: 283590 - protein, 8 aa, Influenza virus
KLFASSGI

SEQ ID NO: 283591 - protein, 8 aa, Influenza virus
LFASSGIA

SEQ ID NO: 283592 - protein, 8 aa, Influenza virus
FASSGIAI

SEQ ID NO: 283593 - protein, 8 aa, Influenza virus
LNLIIGIS

SEQ ID NO: 283594 - protein, 8 aa, Influenza virus
NLIIGISN

SEQ ID NO: 283595 - protein, 8 aa, Influenza virus
LIIGISNV

SEQ ID NO: 283596 - protein, 8 aa, Influenza virus
IIGISNVG

SEQ ID NO: 283597 - protein, 8 aa, Influenza virus
IGISNMSL

SEQ ID NO: 283598 - protein, 8 aa, Influenza virus
GISNMSLN

SEQ ID NO: 283599 - protein, 8 aa, Influenza virus
SNMSLNIS

SEQ ID NO: 283600 - protein, 8 aa, Influenza virus
NMSLNISL

SEQ ID NO: 283601 - protein, 8 aa, Influenza virus
MSLNISLY

SEQ ID NO: 283602 - protein, 8 aa, Influenza virus
SLNISLYS

SEQ ID NO: 283603 - protein, 8 aa, Influenza virus
LNISLYSK

SEQ ID NO: 283604 - protein, 8 aa, Influenza virus
KNTYVNNT

SEQ ID NO: 283605 - protein, 8 aa, Influenza virus
NTYINNTT

SEQ ID NO: 283606 - protein, 8 aa, Influenza virus
TYVNNTTI

SEQ ID NO: 283607 - protein, 8 aa, Influenza virus
YVNNTTII

SEQ ID NO: 283608 - protein, 8 aa, Influenza virus
YLLLNKSL

SEQ ID NO: 283609 - protein, 8 aa, Influenza virus
LLLNKSLC

SEQ ID NO: 283610 - protein, 8 aa, Influenza virus
LLNKSLCN

SEQ ID NO: 283611 - protein, 8 aa, Influenza virus
LNKSLCNV

SEQ ID NO: 283612 - protein, 8 aa, Influenza virus
LCNVEGWV

SEQ ID NO: 283613 - protein, 8 aa, Influenza virus
GWVVIAKD

SEQ ID NO: 283614 - protein, 8 aa, Influenza virus
WVVIAKDN

SEQ ID NO: 283615 - protein, 8 aa, Influenza virus
VVIAKDNA

SEQ ID NO: 283616 - protein, 8 aa, Influenza virus
VIAKDNAV

SEQ ID NO: 283617 - protein, 8 aa, Influenza virus
IAKDNAVR

SEQ ID NO: 283618 - protein, 8 aa, Influenza virus
AKDNAVRF

SEQ ID NO: 283619 - protein, 8 aa, Influenza virus
KDNAVRFG

SEQ ID NO: 283620 - protein, 8 aa, Influenza virus
DNAVRFGE

SEQ ID NO: 283621 - protein, 8 aa, Influenza virus
NAVRFGES

SEQ ID NO: 283622 - protein, 8 aa, Influenza virus
AVRFGESE

SEQ ID NO: 283623 - protein, 8 aa, Influenza virus
VRFGESEQ

SEQ ID NO: 283624 - protein, 8 aa, Influenza virus
RFGESEQV

SEQ ID NO: 283625 - protein, 8 aa, Influenza virus
FGESEQVI

SEQ ID NO: 283626 - protein, 8 aa, Influenza virus
GESEQVIV

SEQ ID NO: 283627 - protein, 8 aa, Influenza virus
ESEQVIVT

SEQ ID NO: 283628 - protein, 8 aa, Influenza virus
SEQVIVTR

SEQ ID NO: 283629 - protein, 8 aa, Influenza virus
EQVIVTRE

SEQ ID NO: 283630 - protein, 8 aa, Influenza virus
QVIVTREP

SEQ ID NO: 283631 - protein, 8 aa, Influenza virus
VIVTREPY

SEQ ID NO: 283632 - protein, 8 aa, Influenza virus
PYVSCDPT

SEQ ID NO: 283633 - protein, 8 aa, Influenza virus
GCRMYALH

SEQ ID NO: 283634 - protein, 8 aa, Influenza virus
CRMYALHQ

SEQ ID NO: 283635 - protein, 8 aa, Influenza virus
RMYALHQG

SEQ ID NO: 283636 - protein, 8 aa, Influenza virus
QGTTIRNR

SEQ ID NO: 283637 - protein, 8 aa, Influenza virus
GTTIRNRH

SEQ ID NO: 283638 - protein, 8 aa, Influenza virus
TTIRNRHS

SEQ ID NO: 283639 - protein, 8 aa, Influenza virus
TIRNRHSN

SEQ ID NO: 283640 - protein, 8 aa, Influenza virus
IRNKHSNS

SEQ ID NO: 283641 - protein, 8 aa, Influenza virus
RNKHSNST

SEQ ID NO: 283642 - protein, 8 aa, Influenza virus
NKHSNSTT

SEQ ID NO: 283643 - protein, 8 aa, Influenza virus
KHSNSTTH

SEQ ID NO: 283644 - protein, 8 aa, Influenza virus
HSNSTTHD

SEQ ID NO: 283645 - protein, 8 aa, Influenza virus
SNSTTHDR

SEQ ID NO: 283646 - protein, 8 aa, Influenza virus
NSTTHDRT

SEQ ID NO: 283647 - protein, 8 aa, Influenza virus
TTHDRTAF

SEQ ID NO: 283648 - protein, 8 aa, Influenza virus
THDRTAFR

SEQ ID NO: 283649 - protein, 8 aa, Influenza virus
HDRTTFRG

SEQ ID NO: 283650 - protein, 8 aa, Influenza virus
DRTTFRGL

SEQ ID NO: 283651 - protein, 8 aa, Influenza virus
RTAFRGLM

SEQ ID NO: 283652 - protein, 8 aa, Influenza virus
TAFRGLMS

SEQ ID NO: 283653 - protein, 8 aa, Influenza virus
AFRGLMST

SEQ ID NO: 283654 - protein, 8 aa, Influenza virus
FRGLISTH

SEQ ID NO: 283655 - protein, 8 aa, Influenza virus
RGLISTHL

SEQ ID NO: 283656 - protein, 8 aa, Influenza virus
GLISTHLG

SEQ ID NO: 283657 - protein, 8 aa, Influenza virus
STPLGTPP

SEQ ID NO: 283658 - protein, 8 aa, Influenza virus
SNSDFMCV

SEQ ID NO: 283659 - protein, 8 aa, Influenza virus
NSDFMCVG

SEQ ID NO: 283660 - protein, 8 aa, Influenza virus
SDFMCVGW

SEQ ID NO: 283661 - protein, 8 aa, Influenza virus
DFMCVGWS

SEQ ID NO: 283662 - protein, 8 aa, Influenza virus
FMCVGWSS

SEQ ID NO: 283663 - protein, 8 aa, Influenza virus
MCVGWSST

SEQ ID NO: 283664 - protein, 8 aa, Influenza virus
CVGWSSTT

SEQ ID NO: 283665 - protein, 8 aa, Influenza virus
VGWSSTTC

SEQ ID NO: 283666 - protein, 8 aa, Influenza virus
GWSSTTCH

SEQ ID NO: 283667 - protein, 8 aa, Influenza virus
WSSTTCHD

SEQ ID NO: 283668 - protein, 8 aa, Influenza virus
SSTTCHDG

SEQ ID NO: 283669 - protein, 8 aa, Influenza virus
STTCHDGI

SEQ ID NO: 283670 - protein, 8 aa, Influenza virus
CHDGVGRM

SEQ ID NO: 283671 - protein, 8 aa, Influenza virus
HDGVGRMT

SEQ ID NO: 283672 - protein, 8 aa, Influenza virus
DGVGRMTI

SEQ ID NO: 283673 - protein, 8 aa, Influenza virus
GVGRMTIC

SEQ ID NO: 283674 - protein, 8 aa, Influenza virus
GRMTICIQ

SEQ ID NO: 283675 - protein, 8 aa, Influenza virus
RMTICIQG

SEQ ID NO: 283676 - protein, 8 aa, Influenza virus
MTICIQGN

SEQ ID NO: 283677 - protein, 8 aa, Influenza virus
TICIQGNN

SEQ ID NO: 283678 - protein, 8 aa, Influenza virus
QGNNNNAT

SEQ ID NO: 283679 - protein, 8 aa, Influenza virus
GNNNNATA

SEQ ID NO: 283680 - protein, 8 aa, Influenza virus
NNNNATAT

SEQ ID NO: 283681 - protein, 8 aa, Influenza virus
NNNATATV

SEQ ID NO: 283682 - protein, 8 aa, Influenza virus
NNATATVY

SEQ ID NO: 283683 - protein, 8 aa, Influenza virus
ATATVYYN

SEQ ID NO: 283684 - protein, 8 aa, Influenza virus
TATVYYNR

SEQ ID NO: 283685 - protein, 8 aa, Influenza virus
ATVYYNRR

SEQ ID NO: 283686 - protein, 8 aa, Influenza virus
TVYYNRRL

SEQ ID NO: 283687 - protein, 8 aa, Influenza virus
VYYNRRLT

SEQ ID NO: 283688 - protein, 8 aa, Influenza virus
YYNRRLTT

SEQ ID NO: 283689 - protein, 8 aa, Influenza virus
YNRRLTTT

SEQ ID NO: 283690 - protein, 8 aa, Influenza virus
NRRLTTTI

SEQ ID NO: 283691 - protein, 8 aa, Influenza virus
KRLTTTIK

SEQ ID NO: 283692 - protein, 8 aa, Influenza virus
RLTTTIKP

SEQ ID NO: 283693 - protein, 8 aa, Influenza virus
LTTTIKPW

SEQ ID NO: 283694 - protein, 8 aa, Influenza virus
TTTIKPWA

SEQ ID NO: 283695 - protein, 8 aa, Influenza virus
TTIKTWAR

SEQ ID NO: 283696 - protein, 8 aa, Influenza virus
TIKTWARN

SEQ ID NO: 283697 - protein, 8 aa, Influenza virus
IKTWARNI

SEQ ID NO: 283698 - protein, 8 aa, Influenza virus
KTWARNIL

SEQ ID NO: 283699 - protein, 8 aa, Influenza virus
TWARNILR

SEQ ID NO: 283700 - protein, 8 aa, Influenza virus
WARNILRT

SEQ ID NO: 283701 - protein, 8 aa, Influenza virus
ARNILRTQ

SEQ ID NO: 283702 - protein, 8 aa, Influenza virus
RNILRTQE

SEQ ID NO: 283703 - protein, 8 aa, Influenza virus
KILRTQES

SEQ ID NO: 283704 - protein, 8 aa, Influenza virus
ESECVRHN

SEQ ID NO: 283705 - protein, 8 aa, Influenza virus
SECVCHNS

SEQ ID NO: 283706 - protein, 8 aa, Influenza virus
ECVCHNST

SEQ ID NO: 283707 - protein, 8 aa, Influenza virus
CVCHNSTC

SEQ ID NO: 283708 - protein, 8 aa, Influenza virus
VCHNGTCA

SEQ ID NO: 283709 - protein, 8 aa, Influenza virus
GTCAVVMT

SEQ ID NO: 283710 - protein, 8 aa, Influenza virus
TCAVVMTD

SEQ ID NO: 283711 - protein, 8 aa, Influenza virus
CAVVMTDG

SEQ ID NO: 283712 - protein, 8 aa, Influenza virus
VVMTDGSA

SEQ ID NO: 283713 - protein, 8 aa, Influenza virus
VMTDGSAS

SEQ ID NO: 283714 - protein, 8 aa, Influenza virus
MTDGPANN

SEQ ID NO: 283715 - protein, 8 aa, Influenza virus
TDGPANNQ

SEQ ID NO: 283716 - protein, 8 aa, Influenza virus
DGPANNQA

SEQ ID NO: 283717 - protein, 8 aa, Influenza virus
ASSQAHTK

SEQ ID NO: 283718 - protein, 8 aa, Influenza virus
LKGSAKHI

SEQ ID NO: 283719 - protein, 8 aa, Influenza virus
KGSAKHIE

SEQ ID NO: 283720 - protein, 8 aa, Influenza virus
GSAKHIEE

SEQ ID NO: 283721 - protein, 8 aa, Influenza virus
SAKHIEEC

SEQ ID NO: 283722 - protein, 8 aa, Influenza virus
AKHIEECS

SEQ ID NO: 283723 - protein, 8 aa, Influenza virus
KHIEECSC

SEQ ID NO: 283724 - protein, 8 aa, Influenza virus
HIEEWSCY

SEQ ID NO: 283725 - protein, 8 aa, Influenza virus
IEECPCYG

SEQ ID NO: 283726 - protein, 8 aa, Influenza virus
ECSCYGHS

SEQ ID NO: 283727 - protein, 8 aa, Influenza virus
RVTCVCRD

SEQ ID NO: 283728 - protein, 8 aa, Influenza virus
ATCVCRDN

SEQ ID NO: 283729 - protein, 8 aa, Influenza virus
SCVCRDNW

SEQ ID NO: 283730 - protein, 8 aa, Influenza virus
CGCRDNWQ

SEQ ID NO: 283731 - protein, 8 aa, Influenza virus
ICRDNWQG

SEQ ID NO: 283732 - protein, 8 aa, Influenza virus
WQGANRPI

SEQ ID NO: 283733 - protein, 8 aa, Influenza virus
QGANRPII

SEQ ID NO: 283734 - protein, 8 aa, Influenza virus
GANRPIIE

SEQ ID NO: 283735 - protein, 8 aa, Influenza virus
ANRPIIEI

SEQ ID NO: 283736 - protein, 8 aa, Influenza virus
NRPIIEID

SEQ ID NO: 283737 - protein, 8 aa, Influenza virus
RPIIEIDM

SEQ ID NO: 283738 - protein, 8 aa, Influenza virus
HTSRYVCT

SEQ ID NO: 283739 - protein, 8 aa, Influenza virus
TSRYVCTG

SEQ ID NO: 283740 - protein, 8 aa, Influenza virus
CTGILTDT

SEQ ID NO: 283741 - protein, 8 aa, Influenza virus
TGILTDTS

SEQ ID NO: 283742 - protein, 8 aa, Influenza virus
GILTDTSR

SEQ ID NO: 283743 - protein, 8 aa, Influenza virus
ILTDTSRP

SEQ ID NO: 283744 - protein, 8 aa, Influenza virus
LTDTSRPG

SEQ ID NO: 283745 - protein, 8 aa, Influenza virus
TDTSRPGD

SEQ ID NO: 283746 - protein, 8 aa, Influenza virus
DTSRPGDK

SEQ ID NO: 283747 - protein, 8 aa, Influenza virus
GDCSNPIT

SEQ ID NO: 283748 - protein, 8 aa, Influenza virus
DCSNPITG

SEQ ID NO: 283749 - protein, 8 aa, Influenza virus
CSNPITGS

SEQ ID NO: 283750 - protein, 8 aa, Influenza virus
SNPITGSP

SEQ ID NO: 283751 - protein, 8 aa, Influenza virus
NPITGSPS

SEQ ID NO: 283752 - protein, 8 aa, Influenza virus
PITGSPSA

SEQ ID NO: 283753 - protein, 8 aa, Influenza virus
ITGSPSAP

SEQ ID NO: 283754 - protein, 8 aa, Influenza virus
TGSPSAPG

SEQ ID NO: 283755 - protein, 8 aa, Influenza virus
APGIKGFG

SEQ ID NO: 283756 - protein, 8 aa, Influenza virus
PGIKGFGF

SEQ ID NO: 283757 - protein, 8 aa, Influenza virus
GIKGFGFL

SEQ ID NO: 283758 - protein, 8 aa, Influenza virus
VKGFGFLN

SEQ ID NO: 283759 - protein, 8 aa, Influenza virus
KGFGFLNG

SEQ ID NO: 283760 - protein, 8 aa, Influenza virus
DNTWLGRT

SEQ ID NO: 283761 - protein, 8 aa, Influenza virus
NTWLGRTF

SEQ ID NO: 283762 - protein, 8 aa, Influenza virus
WLGGTISP

SEQ ID NO: 283763 - protein, 8 aa, Influenza virus
LGRTISPK

SEQ ID NO: 283764 - protein, 8 aa, Influenza virus
GRTISPRL

SEQ ID NO: 283765 - protein, 8 aa, Influenza virus
RTISPRLR

SEQ ID NO: 283766 - protein, 8 aa, Influenza virus
TISPRLRS

SEQ ID NO: 283767 - protein, 8 aa, Influenza virus
ISPRLRSG

SEQ ID NO: 283768 - protein, 8 aa, Influenza virus
SPKLRSGF

SEQ ID NO: 283769 - protein, 8 aa, Influenza virus
PRLRSGFE

SEQ ID NO: 283770 - protein, 8 aa, Influenza virus
RLRSGFEM

SEQ ID NO: 283771 - protein, 8 aa, Influenza virus
LRSGFEML

SEQ ID NO: 283772 - protein, 8 aa, Influenza virus
RSGFEMLR

SEQ ID NO: 283773 - protein, 8 aa, Influenza virus
SGFEMLKV

SEQ ID NO: 283774 - protein, 8 aa, Influenza virus
GFEMLKVP

SEQ ID NO: 283775 - protein, 8 aa, Influenza virus
FEMLKVPN

SEQ ID NO: 283776 - protein, 8 aa, Influenza virus
EMLKVPNA

SEQ ID NO: 283777 - protein, 8 aa, Influenza virus
MLKIPNAE

SEQ ID NO: 283778 - protein, 8 aa, Influenza virus
LKIPNAET

SEQ ID NO: 283779 - protein, 8 aa, Influenza virus
KIPNAETD

SEQ ID NO: 283780 - protein, 8 aa, Influenza virus
IPNAETDP

SEQ ID NO: 283781 - protein, 8 aa, Influenza virus
GRQEIVDN

SEQ ID NO: 283782 - protein, 8 aa, Influenza virus
NRSGYSGS

SEQ ID NO: 283783 - protein, 8 aa, Influenza virus
GSFIDYWN

SEQ ID NO: 283784 - protein, 8 aa, Influenza virus
SFIDYWND

SEQ ID NO: 283785 - protein, 8 aa, Influenza virus
NECYNPCF

SEQ ID NO: 283786 - protein, 8 aa, Influenza virus
VCYNPCFY

SEQ ID NO: 283787 - protein, 8 aa, Influenza virus
GRPEEVKY

SEQ ID NO: 283788 - protein, 8 aa, Influenza virus
RPEEVKYV

SEQ ID NO: 283789 - protein, 8 aa, Influenza virus
PEEAKYVE

SEQ ID NO: 283790 - protein, 8 aa, Influenza virus
EEAKYVEW

SEQ ID NO: 283791 - protein, 8 aa, Influenza virus
EAKYVEWT

SEQ ID NO: 283792 - protein, 8 aa, Influenza virus
AKYVEWTS

SEQ ID NO: 283793 - protein, 8 aa, Influenza virus
KYVEWTSN

SEQ ID NO: 283794 - protein, 8 aa, Influenza virus
YVEWTSNS

SEQ ID NO: 283795 - protein, 8 aa, Influenza virus
VEWTSNSL

SEQ ID NO: 283796 - protein, 8 aa, Influenza virus
WWTSNSLI

SEQ ID NO: 283797 - protein, 8 aa, Influenza virus
WTSNSLIA

SEQ ID NO: 283798 - protein, 8 aa, Influenza virus
TSNSLIAL

SEQ ID NO: 283799 - protein, 8 aa, Influenza virus
SNSLIALC

SEQ ID NO: 283800 - protein, 8 aa, Influenza virus
NSLIALCG

SEQ ID NO: 283801 - protein, 8 aa, Influenza virus
SLIALCGS

SEQ ID NO: 283802 - protein, 8 aa, Influenza virus
LIALCGSP

SEQ ID NO: 283803 - protein, 8 aa, Influenza virus
VALCGSPV

SEQ ID NO: 283804 - protein, 8 aa, Influenza virus
PVGSGSFP

SEQ ID NO: 283805 - protein, 8 aa, Influenza virus
VGPGSFPD

SEQ ID NO: 283806 - protein, 8 aa, Influenza virus
GPGSFPDG

SEQ ID NO: 283807 - protein, 8 aa, Influenza virus
PGSFPDGA

SEQ ID NO: 283808 - protein, 8 aa, Influenza virus
GFFPDGPQ

SEQ ID NO: 283809 - protein, 8 aa, Influenza virus
SLPDGAQI

SEQ ID NO: 283810 - protein, 8 aa, Influenza virus
FPDGAQIK

SEQ ID NO: 283811 - protein, 8 aa, Influenza virus
PDGAQIKY

SEQ ID NO: 283812 - protein, 8 aa, Influenza virus
DGAQIKYF

SEQ ID NO: 283813 - protein, 8 aa, Influenza virus
GAQIKYFS

SEQ ID NO: 283814 - protein, 8 aa, Influenza virus
KEYNETVR

SEQ ID NO: 283815 - protein, 8 aa, Influenza virus
EYNETVRI

SEQ ID NO: 283816 - protein, 8 aa, Influenza virus
YNETVRIE

SEQ ID NO: 283817 - protein, 8 aa, Influenza virus
QGFAPFSK

SEQ ID NO: 283818 - protein, 8 aa, Influenza virus
NGIRIGSK

SEQ ID NO: 283819 - protein, 8 aa, Influenza virus
GIRIGSKG

SEQ ID NO: 283820 - protein, 8 aa, Influenza virus
IRIGSKGH

SEQ ID NO: 283821 - protein, 8 aa, Influenza virus
RIGSRGHI

SEQ ID NO: 283822 - protein, 8 aa, Influenza virus
IGSRGHIF

SEQ ID NO: 283823 - protein, 8 aa, Influenza virus
GSRGHIFV

SEQ ID NO: 283824 - protein, 8 aa, Influenza virus
SRGHIFVI

SEQ ID NO: 283825 - protein, 8 aa, Influenza virus
RGHIFVIR

SEQ ID NO: 283826 - protein, 8 aa, Influenza virus
GHIFVIRE

SEQ ID NO: 283827 - protein, 8 aa, Influenza virus
HIFVIREP

SEQ ID NO: 283828 - protein, 8 aa, Influenza virus
IFVIREPF

SEQ ID NO: 283829 - protein, 8 aa, Influenza virus
FIIREPFV

SEQ ID NO: 283830 - protein, 8 aa, Influenza virus
IIREPFVS

SEQ ID NO: 283831 - protein, 8 aa, Influenza virus
GCRTFFLT

SEQ ID NO: 283832 - protein, 8 aa, Influenza virus
CRTFFLTH

SEQ ID NO: 283833 - protein, 8 aa, Influenza virus
RTFFLTHG

SEQ ID NO: 283834 - protein, 8 aa, Influenza virus
TFFLTHGS

SEQ ID NO: 283835 - protein, 8 aa, Influenza virus
FLTHGSLL

SEQ ID NO: 283836 - protein, 8 aa, Influenza virus
LTHGSLLN

SEQ ID NO: 283837 - protein, 8 aa, Influenza virus
THGSLLND

SEQ ID NO: 283838 - protein, 8 aa, Influenza virus
QGSLLNDR

SEQ ID NO: 283839 - protein, 8 aa, Influenza virus
GSLLNDRH

SEQ ID NO: 283840 - protein, 8 aa, Influenza virus
SLLNDRHS

SEQ ID NO: 283841 - protein, 8 aa, Influenza virus
LLNDRHSN

SEQ ID NO: 283842 - protein, 8 aa, Influenza virus
LNDRHSNG

SEQ ID NO: 283843 - protein, 8 aa, Influenza virus
NDRHSNGT

SEQ ID NO: 283844 - protein, 8 aa, Influenza virus
DKHSNGTI

SEQ ID NO: 283845 - protein, 8 aa, Influenza virus
KHSNGTIK

SEQ ID NO: 283846 - protein, 8 aa, Influenza virus
HSNGTIKD

SEQ ID NO: 283847 - protein, 8 aa, Influenza virus
SNGTIKDR

SEQ ID NO: 283848 - protein, 8 aa, Influenza virus
NGTIKDRS

SEQ ID NO: 283849 - protein, 8 aa, Influenza virus
GTIKDRSP

SEQ ID NO: 283850 - protein, 8 aa, Influenza virus
TVKDRSPF

SEQ ID NO: 283851 - protein, 8 aa, Influenza virus
VKDRSPFR

SEQ ID NO: 283852 - protein, 8 aa, Influenza virus
KDRSPFRT

SEQ ID NO: 283853 - protein, 8 aa, Influenza virus
DRSPFRTL

SEQ ID NO: 283854 - protein, 8 aa, Influenza virus
RSPFRTLM

SEQ ID NO: 283855 - protein, 8 aa, Influenza virus
SPFRTLMS

SEQ ID NO: 283856 - protein, 8 aa, Influenza virus
PFRTLMSV

SEQ ID NO: 283857 - protein, 8 aa, Influenza virus
YRTLMSVK

SEQ ID NO: 283858 - protein, 8 aa, Influenza virus
RTLMSVKI

SEQ ID NO: 283859 - protein, 8 aa, Influenza virus
TLMSVKIG

SEQ ID NO: 283860 - protein, 8 aa, Influenza virus
LMSVKIGQ

SEQ ID NO: 283861 - protein, 8 aa, Influenza virus
MSVKIGQS

SEQ ID NO: 283862 - protein, 8 aa, Influenza virus
VGQSPNVY

SEQ ID NO: 283863 - protein, 8 aa, Influenza virus
GLSPNVYQ

SEQ ID NO: 283864 - protein, 8 aa, Influenza virus
QSPNVYQS

SEQ ID NO: 283865 - protein, 8 aa, Influenza virus
SPNVYQAK

SEQ ID NO: 283866 - protein, 8 aa, Influenza virus
PNVYQAKF

SEQ ID NO: 283867 - protein, 8 aa, Influenza virus
NVYQAKFE

SEQ ID NO: 283868 - protein, 8 aa, Influenza virus
VYQARFES

SEQ ID NO: 283869 - protein, 8 aa, Influenza virus
YQARFESV

SEQ ID NO: 283870 - protein, 8 aa, Influenza virus
QARFESVA

SEQ ID NO: 283871 - protein, 8 aa, Influenza virus
ARFESVAW

SEQ ID NO: 283872 - protein, 8 aa, Influenza virus
RFESVAWS

SEQ ID NO: 283873 - protein, 8 aa, Influenza virus
FESVAWSA

SEQ ID NO: 283874 - protein, 8 aa, Influenza virus
ESVAWSAT

SEQ ID NO: 283875 - protein, 8 aa, Influenza virus
SVAWSATA

SEQ ID NO: 283876 - protein, 8 aa, Influenza virus
ATACHDGR

SEQ ID NO: 283877 - protein, 8 aa, Influenza virus
TACHDGRK

SEQ ID NO: 283878 - protein, 8 aa, Influenza virus
ACHDGRKW

SEQ ID NO: 283879 - protein, 8 aa, Influenza virus
CHDGRKWM

SEQ ID NO: 283880 - protein, 8 aa, Influenza virus
HDGRKWMT

SEQ ID NO: 283881 - protein, 8 aa, Influenza virus
KWMTVGVT

SEQ ID NO: 283882 - protein, 8 aa, Influenza virus
WMTVGVTG

SEQ ID NO: 283883 - protein, 8 aa, Influenza virus
TVGVTGPD

SEQ ID NO: 283884 - protein, 8 aa, Influenza virus
SWAGNILR

SEQ ID NO: 283885 - protein, 8 aa, Influenza virus
WAGNILRT

SEQ ID NO: 283886 - protein, 8 aa, Influenza virus
AGNILRTQ

SEQ ID NO: 283887 - protein, 8 aa, Influenza virus
GNILRTQE

SEQ ID NO: 283888 - protein, 8 aa, Influenza virus
NILRTQES

SEQ ID NO: 283889 - protein, 8 aa, Influenza virus
IMRTQESS

SEQ ID NO: 283890 - protein, 8 aa, Influenza virus
MRTQESSC

SEQ ID NO: 283891 - protein, 8 aa, Influenza virus
ESSCTCIK

SEQ ID NO: 283892 - protein, 8 aa, Influenza virus
SSCTCIKG

SEQ ID NO: 283893 - protein, 8 aa, Influenza virus
GDCYWVMT

SEQ ID NO: 283894 - protein, 8 aa, Influenza virus
DCYWVMTD

SEQ ID NO: 283895 - protein, 8 aa, Influenza virus
CFWVMTDG

SEQ ID NO: 283896 - protein, 8 aa, Influenza virus
FWVMTDGP

SEQ ID NO: 283897 - protein, 8 aa, Influenza virus
MTDGPANK

SEQ ID NO: 283898 - protein, 8 aa, Influenza virus
TDGPANKQ

SEQ ID NO: 283899 - protein, 8 aa, Influenza virus
DGPANKQA

SEQ ID NO: 283900 - protein, 8 aa, Influenza virus
FSGGHIEE

SEQ ID NO: 283901 - protein, 8 aa, Influenza virus
SGGHIEEC

SEQ ID NO: 283902 - protein, 8 aa, Influenza virus
EGHIEECS

SEQ ID NO: 283903 - protein, 8 aa, Influenza virus
ECSCYPND

SEQ ID NO: 283904 - protein, 8 aa, Influenza virus
CSCYPNDG

SEQ ID NO: 283905 - protein, 8 aa, Influenza virus
SCYPNDGK

SEQ ID NO: 283906 - protein, 8 aa, Influenza virus
CYPNDGKV

SEQ ID NO: 283907 - protein, 8 aa, Influenza virus
YPNDGKVE

SEQ ID NO: 283908 - protein, 8 aa, Influenza virus
PNDGKVEC

SEQ ID NO: 283909 - protein, 8 aa, Influenza virus
NEGKVECI

SEQ ID NO: 283910 - protein, 8 aa, Influenza virus
EGKVECIC

SEQ ID NO: 283911 - protein, 8 aa, Influenza virus
GKVECICR

SEQ ID NO: 283912 - protein, 8 aa, Influenza virus
KVECICRD

SEQ ID NO: 283913 - protein, 8 aa, Influenza virus
VECICRDN

SEQ ID NO: 283914 - protein, 8 aa, Influenza virus
ECICRDNW

SEQ ID NO: 283915 - protein, 8 aa, Influenza virus
CICRDNWT

SEQ ID NO: 283916 - protein, 8 aa, Influenza virus
ICRDNWTG

SEQ ID NO: 283917 - protein, 8 aa, Influenza virus
WTGTNRPI

SEQ ID NO: 283918 - protein, 8 aa, Influenza virus
TGTNRPIL

SEQ ID NO: 283919 - protein, 8 aa, Influenza virus
GTNRPILV

SEQ ID NO: 283920 - protein, 8 aa, Influenza virus
TNRPILVI

SEQ ID NO: 283921 - protein, 8 aa, Influenza virus
NRPILVIS

SEQ ID NO: 283922 - protein, 8 aa, Influenza virus
LVISSDLS

SEQ ID NO: 283923 - protein, 8 aa, Influenza virus
VISSDLSY

SEQ ID NO: 283924 - protein, 8 aa, Influenza virus
LSYTVGYL

SEQ ID NO: 283925 - protein, 8 aa, Influenza virus
SYTVGYLC

SEQ ID NO: 283926 - protein, 8 aa, Influenza virus
YTVGYLCA

SEQ ID NO: 283927 - protein, 8 aa, Influenza virus
TVGYLCAG

SEQ ID NO: 283928 - protein, 8 aa, Influenza virus
VGYLCAGI

SEQ ID NO: 283929 - protein, 8 aa, Influenza virus
GYLCAGIP

SEQ ID NO: 283930 - protein, 8 aa, Influenza virus
YLCAGIPT

SEQ ID NO: 283931 - protein, 8 aa, Influenza virus
LCAGIPTD

SEQ ID NO: 283932 - protein, 8 aa, Influenza virus
CAGIPTDT

SEQ ID NO: 283933 - protein, 8 aa, Influenza virus
AGIPTDTP

SEQ ID NO: 283934 - protein, 8 aa, Influenza virus
GIPTDTPR

SEQ ID NO: 283935 - protein, 8 aa, Influenza virus
IPTDTPRG

SEQ ID NO: 283936 - protein, 8 aa, Influenza virus
PTDTPRGE

SEQ ID NO: 283937 - protein, 8 aa, Influenza virus
TDTPRGED

SEQ ID NO: 283938 - protein, 8 aa, Influenza virus
DTPRGEDA

SEQ ID NO: 283939 - protein, 8 aa, Influenza virus
TPRGEDAQ

SEQ ID NO: 283940 - protein, 8 aa, Influenza virus
PRGEDAQF

SEQ ID NO: 283941 - protein, 8 aa, Influenza virus
KGYGVKGF

SEQ ID NO: 283942 - protein, 8 aa, Influenza virus
GFGFRQGT

SEQ ID NO: 283943 - protein, 8 aa, Influenza virus
FGFRQGTD

SEQ ID NO: 283944 - protein, 8 aa, Influenza virus
GFRQGTDV

SEQ ID NO: 283945 - protein, 8 aa, Influenza virus
FRQGTDVW

SEQ ID NO: 283946 - protein, 8 aa, Influenza virus
DVWAGRTI

SEQ ID NO: 283947 - protein, 8 aa, Influenza virus
VWAGRTIS

SEQ ID NO: 283948 - protein, 8 aa, Influenza virus
QTSRSGFE

SEQ ID NO: 283949 - protein, 8 aa, Influenza virus
TSRSGFEV

SEQ ID NO: 283950 - protein, 8 aa, Influenza virus
DDPNWSGY

SEQ ID NO: 283951 - protein, 8 aa, Influenza virus
DPNWSGYS

SEQ ID NO: 283952 - protein, 8 aa, Influenza virus
PNWSGYSG

SEQ ID NO: 283953 - protein, 8 aa, Influenza virus
SGSFTLPI

SEQ ID NO: 283954 - protein, 8 aa, Influenza virus
GSFTLPIE

SEQ ID NO: 283955 - protein, 8 aa, Influenza virus
SFTLPIEL

SEQ ID NO: 283956 - protein, 8 aa, Influenza virus
DCLVPCFW

SEQ ID NO: 283957 - protein, 8 aa, Influenza virus
WVEMIRGE

SEQ ID NO: 283958 - protein, 8 aa, Influenza virus
VEMIRGRP

SEQ ID NO: 283959 - protein, 8 aa, Influenza virus
EMIRGRPE

SEQ ID NO: 283960 - protein, 8 aa, Influenza virus
MIRGRPEE

SEQ ID NO: 283961 - protein, 8 aa, Influenza virus
TVWTSSSS

SEQ ID NO: 283962 - protein, 8 aa, Influenza virus
IWTSSSSV

SEQ ID NO: 283963 - protein, 8 aa, Influenza virus
WTSSSSVV

SEQ ID NO: 283964 - protein, 8 aa, Influenza virus
TSSSSVVM

SEQ ID NO: 283965 - protein, 8 aa, Influenza virus
SSSSVVMC

SEQ ID NO: 283966 - protein, 8 aa, Influenza virus
SSSVVMCG

SEQ ID NO: 283967 - protein, 8 aa, Influenza virus
SSVVMCGV

SEQ ID NO: 283968 - protein, 8 aa, Influenza virus
SVVMCGVD

SEQ ID NO: 283969 - protein, 8 aa, Influenza virus
IVMCGVDY

SEQ ID NO: 283970 - protein, 8 aa, Influenza virus
ASWSWHDG

SEQ ID NO: 283971 - protein, 8 aa, Influenza virus
SWSWHDGA

SEQ ID NO: 283972 - protein, 8 aa, Influenza virus
WSWHDGAV

SEQ ID NO: 283973 - protein, 8 aa, Influenza virus
SWHDGAVL

SEQ ID NO: 283974 - protein, 8 aa, Influenza virus
WHDGAVLP

SEQ ID NO: 283975 - protein, 8 aa, Influenza virus
HDGAVLPF

SEQ ID NO: 283976 - protein, 8 aa, Influenza virus
DGAVLPFD

SEQ ID NO: 283977 - protein, 8 aa, Influenza virus
GAVLPFDI

SEQ ID NO: 283978 - protein, 8 aa, Influenza virus
AVLPFDID

SEQ ID NO: 283979 - protein, 8 aa, Influenza virus
PFDIDKII

SEQ ID NO: 283980 - protein, 8 aa, Influenza virus
FDFDKISQ

SEQ ID NO: 283981 - protein, 8 aa, Influenza virus
MNPNQRIL

SEQ ID NO: 283982 - protein, 8 aa, Influenza virus
NPNQKILF

SEQ ID NO: 283983 - protein, 8 aa, Influenza virus
PNQKILCA

SEQ ID NO: 283984 - protein, 8 aa, Influenza virus
NQKILCAS

SEQ ID NO: 283985 - protein, 8 aa, Influenza virus
QKILCASA

SEQ ID NO: 283986 - protein, 8 aa, Influenza virus
KILCASAT

SEQ ID NO: 283987 - protein, 8 aa, Influenza virus
ILCTSAIA

SEQ ID NO: 283988 - protein, 8 aa, Influenza virus
LCTSAIAI

SEQ ID NO: 283989 - protein, 8 aa, Influenza virus
GVANLGLN

SEQ ID NO: 283990 - protein, 8 aa, Influenza virus
VNLGLNIG

SEQ ID NO: 283991 - protein, 8 aa, Influenza virus
NLGLNVGL

SEQ ID NO: 283992 - protein, 8 aa, Influenza virus
LGLNVGLH

SEQ ID NO: 283993 - protein, 8 aa, Influenza virus
GLNVGLHL

SEQ ID NO: 283994 - protein, 8 aa, Influenza virus
LNIGLHLR

SEQ ID NO: 283995 - protein, 8 aa, Influenza virus
NIGLHLRP

SEQ ID NO: 283996 - protein, 8 aa, Influenza virus
SQTVINNY

SEQ ID NO: 283997 - protein, 8 aa, Influenza virus
QTVINNYY

SEQ ID NO: 283998 - protein, 8 aa, Influenza virus
TVINNYYN

SEQ ID NO: 283999 - protein, 8 aa, Influenza virus
VINNYYNE

SEQ ID NO: 284000 - protein, 8 aa, Influenza virus
INNYYNKT

SEQ ID NO: 284001 - protein, 8 aa, Influenza virus
NNYYNKTN

SEQ ID NO: 284002 - protein, 8 aa, Influenza virus
VTQISNTN

SEQ ID NO: 284003 - protein, 8 aa, Influenza virus
TQISNINI

SEQ ID NO: 284004 - protein, 8 aa, Influenza virus
FNNLTREL

SEQ ID NO: 284005 - protein, 8 aa, Influenza virus
NNLTRELC

SEQ ID NO: 284006 - protein, 8 aa, Influenza virus
NLTRELCT

SEQ ID NO: 284007 - protein, 8 aa, Influenza virus
LTRELCTI

SEQ ID NO: 284008 - protein, 8 aa, Influenza virus
TRELCTIN

SEQ ID NO: 284009 - protein, 8 aa, Influenza virus
RELCTINS

SEQ ID NO: 284010 - protein, 8 aa, Influenza virus
ELCTINSW

SEQ ID NO: 284011 - protein, 8 aa, Influenza virus
TINSWHIF

SEQ ID NO: 284012 - protein, 8 aa, Influenza virus
INSWHIFG

SEQ ID NO: 284013 - protein, 8 aa, Influenza virus
NSWHIFGK

SEQ ID NO: 284014 - protein, 8 aa, Influenza virus
SWHIFGKD

SEQ ID NO: 284015 - protein, 8 aa, Influenza virus
WHIFGKDN

SEQ ID NO: 284016 - protein, 8 aa, Influenza virus
HIFGKDNA

SEQ ID NO: 284017 - protein, 8 aa, Influenza virus
IFGKDNAI

SEQ ID NO: 284018 - protein, 8 aa, Influenza virus
FGKDNAIR

SEQ ID NO: 284019 - protein, 8 aa, Influenza virus
GKDNAIRI

SEQ ID NO: 284020 - protein, 8 aa, Influenza virus
KDNAIRIG

SEQ ID NO: 284021 - protein, 8 aa, Influenza virus
DNAIRIGE

SEQ ID NO: 284022 - protein, 8 aa, Influenza virus
NAVRIGEN

SEQ ID NO: 284023 - protein, 8 aa, Influenza virus
AVRIGENS

SEQ ID NO: 284024 - protein, 8 aa, Influenza virus
RIGENSDV

SEQ ID NO: 284025 - protein, 8 aa, Influenza virus
IGENSDVL

SEQ ID NO: 284026 - protein, 8 aa, Influenza virus
GENSDVLV

SEQ ID NO: 284027 - protein, 8 aa, Influenza virus
ENSDVLVT

SEQ ID NO: 284028 - protein, 8 aa, Influenza virus
NSDVLVTR

SEQ ID NO: 284029 - protein, 8 aa, Influenza virus
SDILVTRE

SEQ ID NO: 284030 - protein, 8 aa, Influenza virus
DILVTREP

SEQ ID NO: 284031 - protein, 8 aa, Influenza virus
ILVTREPY

SEQ ID NO: 284032 - protein, 8 aa, Influenza virus
REPYVSCE

SEQ ID NO: 284033 - protein, 8 aa, Influenza virus
EPYVSCEP

SEQ ID NO: 284034 - protein, 8 aa, Influenza virus
PYVSCEPD

SEQ ID NO: 284035 - protein, 8 aa, Influenza virus
YVSCDPDG

SEQ ID NO: 284036 - protein, 8 aa, Influenza virus
VSCDPDGC

SEQ ID NO: 284037 - protein, 8 aa, Influenza virus
SCDPDGCR

SEQ ID NO: 284038 - protein, 8 aa, Influenza virus
CDPDGCRF

SEQ ID NO: 284039 - protein, 8 aa, Influenza virus
DPDGCRFY

SEQ ID NO: 284040 - protein, 8 aa, Influenza virus
PDGCRFYA

SEQ ID NO: 284041 - protein, 8 aa, Influenza virus
DGCRFYAL

SEQ ID NO: 284042 - protein, 8 aa, Influenza virus
GCRFYALS

SEQ ID NO: 284043 - protein, 8 aa, Influenza virus
QGTTIRGR

SEQ ID NO: 284044 - protein, 8 aa, Influenza virus
GTTIRGRH

SEQ ID NO: 284045 - protein, 8 aa, Influenza virus
TTIRGRHS

SEQ ID NO: 284046 - protein, 8 aa, Influenza virus
TIRGRHSN

SEQ ID NO: 284047 - protein, 8 aa, Influenza virus
IRGRHSNG

SEQ ID NO: 284048 - protein, 8 aa, Influenza virus
RGRHSNGT

SEQ ID NO: 284049 - protein, 8 aa, Influenza virus
GRHSNGTI

SEQ ID NO: 284050 - protein, 8 aa, Influenza virus
RHSNGTIH

SEQ ID NO: 284051 - protein, 8 aa, Influenza virus
HDRSQYRS

SEQ ID NO: 284052 - protein, 8 aa, Influenza virus
DRSQYRSL

SEQ ID NO: 284053 - protein, 8 aa, Influenza virus
RSQYRSLI

SEQ ID NO: 284054 - protein, 8 aa, Influenza virus
SQYRSLIS

SEQ ID NO: 284055 - protein, 8 aa, Influenza virus
QYRSLISW

SEQ ID NO: 284056 - protein, 8 aa, Influenza virus
YRSLISWP

SEQ ID NO: 284057 - protein, 8 aa, Influenza virus
RSLISWPL

SEQ ID NO: 284058 - protein, 8 aa, Influenza virus
SLISWPLS

SEQ ID NO: 284059 - protein, 8 aa, Influenza virus
LVSWPLSS

SEQ ID NO: 284060 - protein, 8 aa, Influenza virus
VSWPLSSP

SEQ ID NO: 284061 - protein, 8 aa, Influenza virus
SWPQSSPP

SEQ ID NO: 284062 - protein, 8 aa, Influenza virus
WPQSSPPT

SEQ ID NO: 284063 - protein, 8 aa, Influenza virus
PQSSPPTV

SEQ ID NO: 284064 - protein, 8 aa, Influenza virus
QSSPPTVY

SEQ ID NO: 284065 - protein, 8 aa, Influenza virus
SPPTVYNT

SEQ ID NO: 284066 - protein, 8 aa, Influenza virus
PPTVYNTR

SEQ ID NO: 284067 - protein, 8 aa, Influenza virus
RIECIGWS

SEQ ID NO: 284068 - protein, 8 aa, Influenza virus
IECIGWSS

SEQ ID NO: 284069 - protein, 8 aa, Influenza virus
STSCHDGK

SEQ ID NO: 284070 - protein, 8 aa, Influenza virus
TSCHDGKS

SEQ ID NO: 284071 - protein, 8 aa, Influenza virus
SCHDGKSR

SEQ ID NO: 284072 - protein, 8 aa, Influenza virus
CHDGKSRM

SEQ ID NO: 284073 - protein, 8 aa, Influenza virus
HDGKSRMS

SEQ ID NO: 284074 - protein, 8 aa, Influenza virus
RMSICVSG

SEQ ID NO: 284075 - protein, 8 aa, Influenza virus
MSICVSGP

SEQ ID NO: 284076 - protein, 8 aa, Influenza virus
SICVSGPN

SEQ ID NO: 284077 - protein, 8 aa, Influenza virus
ICVSGPNN

SEQ ID NO: 284078 - protein, 8 aa, Influenza virus
CVSGPNNN

SEQ ID NO: 284079 - protein, 8 aa, Influenza virus
VSGPNNNA

SEQ ID NO: 284080 - protein, 8 aa, Influenza virus
PNNNASAI

SEQ ID NO: 284081 - protein, 8 aa, Influenza virus
NNNASAVV

SEQ ID NO: 284082 - protein, 8 aa, Influenza virus
NNASAVVW

SEQ ID NO: 284083 - protein, 8 aa, Influenza virus
NASAVVWY

SEQ ID NO: 284084 - protein, 8 aa, Influenza virus
ASAVVWYN

SEQ ID NO: 284085 - protein, 8 aa, Influenza virus
RRPVAEIN

SEQ ID NO: 284086 - protein, 8 aa, Influenza virus
RPVAEINT

SEQ ID NO: 284087 - protein, 8 aa, Influenza virus
PVAEINTW

SEQ ID NO: 284088 - protein, 8 aa, Influenza virus
VAEINTWA

SEQ ID NO: 284089 - protein, 8 aa, Influenza virus
AEINTWAR

SEQ ID NO: 284090 - protein, 8 aa, Influenza virus
ESECVCHS

SEQ ID NO: 284091 - protein, 8 aa, Influenza virus
SECVCHSG

SEQ ID NO: 284092 - protein, 8 aa, Influenza virus
ECVCHNGI

SEQ ID NO: 284093 - protein, 8 aa, Influenza virus
CVCHNGIC

SEQ ID NO: 284094 - protein, 8 aa, Influenza virus
VCHNGICP

SEQ ID NO: 284095 - protein, 8 aa, Influenza virus
CHNGICPV

SEQ ID NO: 284096 - protein, 8 aa, Influenza virus
HNGICPVV

SEQ ID NO: 284097 - protein, 8 aa, Influenza virus
NGICPVVF

SEQ ID NO: 284098 - protein, 8 aa, Influenza virus
GICPVVFT

SEQ ID NO: 284099 - protein, 8 aa, Influenza virus
ICPVVFTD

SEQ ID NO: 284100 - protein, 8 aa, Influenza virus
GSATGPAD

SEQ ID NO: 284101 - protein, 8 aa, Influenza virus
SATGPADT

SEQ ID NO: 284102 - protein, 8 aa, Influenza virus
ATGPADTR

SEQ ID NO: 284103 - protein, 8 aa, Influenza virus
TGPAETRI

SEQ ID NO: 284104 - protein, 8 aa, Influenza virus
GPAETRIY

SEQ ID NO: 284105 - protein, 8 aa, Influenza virus
PAETRIYY

SEQ ID NO: 284106 - protein, 8 aa, Influenza virus
AETRIYYF

SEQ ID NO: 284107 - protein, 8 aa, Influenza virus
TRIYYFKE

SEQ ID NO: 284108 - protein, 8 aa, Influenza virus
RIYYFKEG

SEQ ID NO: 284109 - protein, 8 aa, Influenza virus
EGKTLKWE

SEQ ID NO: 284110 - protein, 8 aa, Influenza virus
GKILKWES

SEQ ID NO: 284111 - protein, 8 aa, Influenza virus
KILKWESL

SEQ ID NO: 284112 - protein, 8 aa, Influenza virus
KWESLTGT

SEQ ID NO: 284113 - protein, 8 aa, Influenza virus
WESLTGTA

SEQ ID NO: 284114 - protein, 8 aa, Influenza virus
LAGTAKHI

SEQ ID NO: 284115 - protein, 8 aa, Influenza virus
AGTAKHIE

SEQ ID NO: 284116 - protein, 8 aa, Influenza virus
KHIEECSS

SEQ ID NO: 284117 - protein, 8 aa, Influenza virus
EECSCYGV

SEQ ID NO: 284118 - protein, 8 aa, Influenza virus
IICTCRDN

SEQ ID NO: 284119 - protein, 8 aa, Influenza virus
ICTCRDNW

SEQ ID NO: 284120 - protein, 8 aa, Influenza virus
GSNRPVIR

SEQ ID NO: 284121 - protein, 8 aa, Influenza virus
SNRPVIRI

SEQ ID NO: 284122 - protein, 8 aa, Influenza virus
NRPVIQIN

SEQ ID NO: 284123 - protein, 8 aa, Influenza virus
RPVIQINP

SEQ ID NO: 284124 - protein, 8 aa, Influenza virus
VMTHTSQY

SEQ ID NO: 284125 - protein, 8 aa, Influenza virus
MKHTSQYI

SEQ ID NO: 284126 - protein, 8 aa, Influenza virus
KHTSQYIC

SEQ ID NO: 284127 - protein, 8 aa, Influenza virus
NPRPNDPT

SEQ ID NO: 284128 - protein, 8 aa, Influenza virus
IGKCNDPY

SEQ ID NO: 284129 - protein, 8 aa, Influenza virus
GKCNEPYP

SEQ ID NO: 284130 - protein, 8 aa, Influenza virus
KCNEPYPG

SEQ ID NO: 284131 - protein, 8 aa, Influenza virus
CNEPYPGN

SEQ ID NO: 284132 - protein, 8 aa, Influenza virus
NEPYPGNN

SEQ ID NO: 284133 - protein, 8 aa, Influenza virus
EPYPGNNN

SEQ ID NO: 284134 - protein, 8 aa, Influenza virus
PYPGNNNK

SEQ ID NO: 284135 - protein, 8 aa, Influenza virus
YPGSNNNG

SEQ ID NO: 284136 - protein, 8 aa, Influenza virus
PGNNBNGV

SEQ ID NO: 284137 - protein, 8 aa, Influenza virus
GNNBNGVK

SEQ ID NO: 284138 - protein, 8 aa, Influenza virus
SNNNGVKG

SEQ ID NO: 284139 - protein, 8 aa, Influenza virus
NBNGVKGF

SEQ ID NO: 284140 - protein, 8 aa, Influenza virus
NNGVKGFA

SEQ ID NO: 284141 - protein, 8 aa, Influenza virus
NGVKGFAY

SEQ ID NO: 284142 - protein, 8 aa, Influenza virus
GVKGFAYL

SEQ ID NO: 284143 - protein, 8 aa, Influenza virus
VKGFSYLN

SEQ ID NO: 284144 - protein, 8 aa, Influenza virus
KGFSYLNG

SEQ ID NO: 284145 - protein, 8 aa, Influenza virus
VNTWLGRT

SEQ ID NO: 284146 - protein, 8 aa, Influenza virus
NTWLGRTT

SEQ ID NO: 284147 - protein, 8 aa, Influenza virus
TWVGRTIS

SEQ ID NO: 284148 - protein, 8 aa, Influenza virus
WLGRTISI

SEQ ID NO: 284149 - protein, 8 aa, Influenza virus
LGRTISIA

SEQ ID NO: 284150 - protein, 8 aa, Influenza virus
GRTISIAS

SEQ ID NO: 284151 - protein, 8 aa, Influenza virus
RTISIASR

SEQ ID NO: 284152 - protein, 8 aa, Influenza virus
TISIASRS

SEQ ID NO: 284153 - protein, 8 aa, Influenza virus
ISIASRSG

SEQ ID NO: 284154 - protein, 8 aa, Influenza virus
SIASRSGY

SEQ ID NO: 284155 - protein, 8 aa, Influenza virus
IASRSGYE

SEQ ID NO: 284156 - protein, 8 aa, Influenza virus
ASRYGYEM

SEQ ID NO: 284157 - protein, 8 aa, Influenza virus
SRAGYEML

SEQ ID NO: 284158 - protein, 8 aa, Influenza virus
RSGYEILK

SEQ ID NO: 284159 - protein, 8 aa, Influenza virus
SGYEILKV

SEQ ID NO: 284160 - protein, 8 aa, Influenza virus
KVPNALID

SEQ ID NO: 284161 - protein, 8 aa, Influenza virus
VPNALTDN

SEQ ID NO: 284162 - protein, 8 aa, Influenza virus
PNALTDNR

SEQ ID NO: 284163 - protein, 8 aa, Influenza virus
NALTDDKS

SEQ ID NO: 284164 - protein, 8 aa, Influenza virus
ALTDDKSK

SEQ ID NO: 284165 - protein, 8 aa, Influenza virus
LTDDKSKP

SEQ ID NO: 284166 - protein, 8 aa, Influenza virus
RSKPIQGQ

SEQ ID NO: 284167 - protein, 8 aa, Influenza virus
SKPIQGQT

SEQ ID NO: 284168 - protein, 8 aa, Influenza virus
PIQGQTIV

SEQ ID NO: 284169 - protein, 8 aa, Influenza virus
QGQTVVLN

SEQ ID NO: 284170 - protein, 8 aa, Influenza virus
GQTVVLNT

SEQ ID NO: 284171 - protein, 8 aa, Influenza virus
QTVVLNTD

SEQ ID NO: 284172 - protein, 8 aa, Influenza virus
TVVLNTDW

SEQ ID NO: 284173 - protein, 8 aa, Influenza virus
VVLNTDWS

SEQ ID NO: 284174 - protein, 8 aa, Influenza virus
VSNTDWSG

SEQ ID NO: 284175 - protein, 8 aa, Influenza virus
SNTDWSGY

SEQ ID NO: 284176 - protein, 8 aa, Influenza virus
SGYSGSFI

SEQ ID NO: 284177 - protein, 8 aa, Influenza virus
GYSGSFID

SEQ ID NO: 284178 - protein, 8 aa, Influenza virus
YSGSFIDY

SEQ ID NO: 284179 - protein, 8 aa, Influenza virus
SGSFIDYW

SEQ ID NO: 284180 - protein, 8 aa, Influenza virus
GSFIDYWA

SEQ ID NO: 284181 - protein, 8 aa, Influenza virus
SFIDYWAK

SEQ ID NO: 284182 - protein, 8 aa, Influenza virus
FIDYWAKG

SEQ ID NO: 284183 - protein, 8 aa, Influenza virus
DYWAEGDC

SEQ ID NO: 284184 - protein, 8 aa, Influenza virus
YWAEGDCY

SEQ ID NO: 284185 - protein, 8 aa, Influenza virus
WAEGDCYR

SEQ ID NO: 284186 - protein, 8 aa, Influenza virus
AEGDCYRA

SEQ ID NO: 284187 - protein, 8 aa, Influenza virus
EGDCYRAC

SEQ ID NO: 284188 - protein, 8 aa, Influenza virus
GDCYRACF

SEQ ID NO: 284189 - protein, 8 aa, Influenza virus
DCYRACFY

SEQ ID NO: 284190 - protein, 8 aa, Influenza virus
IRGRPKEE

SEQ ID NO: 284191 - protein, 8 aa, Influenza virus
RGRPKEEK

SEQ ID NO: 284192 - protein, 8 aa, Influenza virus
GRPKEEKV

SEQ ID NO: 284193 - protein, 8 aa, Influenza virus
RPKEEKVW

SEQ ID NO: 284194 - protein, 8 aa, Influenza virus
PKEEKVWW

SEQ ID NO: 284195 - protein, 8 aa, Influenza virus
KEEKVWWT

SEQ ID NO: 284196 - protein, 8 aa, Influenza virus
EEKVWWTS

SEQ ID NO: 284197 - protein, 8 aa, Influenza virus
EKVWWTSN

SEQ ID NO: 284198 - protein, 8 aa, Influenza virus
RVWWTSNS

SEQ ID NO: 284199 - protein, 8 aa, Influenza virus
WWTSNSII

SEQ ID NO: 284200 - protein, 8 aa, Influenza virus
WTSNSIIS

SEQ ID NO: 284201 - protein, 8 aa, Influenza virus
IISMCSST

SEQ ID NO: 284202 - protein, 8 aa, Influenza virus
ISMCSSTE

SEQ ID NO: 284203 - protein, 8 aa, Influenza virus
TEFLGQWD

SEQ ID NO: 284204 - protein, 8 aa, Influenza virus
EFLGQWDW

SEQ ID NO: 284205 - protein, 8 aa, Influenza virus
FLGQWDWP

SEQ ID NO: 284206 - protein, 8 aa, Influenza virus
LGQWDWPD

SEQ ID NO: 284207 - protein, 8 aa, Influenza virus
GQWDWPDG

SEQ ID NO: 284208 - protein, 8 aa, Influenza virus
QWDWPDGA

SEQ ID NO: 284209 - protein, 8 aa, Influenza virus
WDWPDGAK

SEQ ID NO: 284210 - protein, 8 aa, Influenza virus
DWPDGAKI

SEQ ID NO: 284211 - protein, 8 aa, Influenza virus
WPDGAEIE

SEQ ID NO: 284212 - protein, 8 aa, Influenza virus
PDGAEIEY

SEQ ID NO: 284213 - protein, 8 aa, Influenza virus
DGAEIEYF

SEQ ID NO: 284214 - protein, 8 aa, Influenza virus
GAEIEYFL

SEQ ID NO: 284215 - protein, 8 aa, Influenza virus
GIDKICLG

SEQ ID NO: 284216 - protein, 8 aa, Influenza virus
IDKICLGH

SEQ ID NO: 284217 - protein, 8 aa, Influenza virus
DRICLGHH

SEQ ID NO: 284218 - protein, 8 aa, Influenza virus
RICLGHHA

SEQ ID NO: 284219 - protein, 8 aa, Influenza virus
CLGHHAVP

SEQ ID NO: 284220 - protein, 8 aa, Influenza virus
LGHHAVPN

SEQ ID NO: 284221 - protein, 8 aa, Influenza virus
GHHAVPNG

SEQ ID NO: 284222 - protein, 8 aa, Influenza virus
HHAVPNGT

SEQ ID NO: 284223 - protein, 8 aa, Influenza virus
NGTTVKTL

SEQ ID NO: 284224 - protein, 8 aa, Influenza virus
GTTVKTLT

SEQ ID NO: 284225 - protein, 8 aa, Influenza virus
QEEVTNAT

SEQ ID NO: 284226 - protein, 8 aa, Influenza virus
NATETVEN

SEQ ID NO: 284227 - protein, 8 aa, Influenza virus
KDLGSCHP

SEQ ID NO: 284228 - protein, 8 aa, Influenza virus
DLGSCHPI

SEQ ID NO: 284229 - protein, 8 aa, Influenza virus
LGSCHPIG

SEQ ID NO: 284230 - protein, 8 aa, Influenza virus
GSCHPIGM

SEQ ID NO: 284231 - protein, 8 aa, Influenza virus
HLAGTWDT

SEQ ID NO: 284232 - protein, 8 aa, Influenza virus
GKWDTLIE

SEQ ID NO: 284233 - protein, 8 aa, Influenza virus
KWDTLIER

SEQ ID NO: 284234 - protein, 8 aa, Influenza virus
WDTLIERE

SEQ ID NO: 284235 - protein, 8 aa, Influenza virus
AYCYPGTT

SEQ ID NO: 284236 - protein, 8 aa, Influenza virus
INEEALRQ

SEQ ID NO: 284237 - protein, 8 aa, Influenza virus
NEGALRQK

SEQ ID NO: 284238 - protein, 8 aa, Influenza virus
EGALRQKI

SEQ ID NO: 284239 - protein, 8 aa, Influenza virus
GALRQKIM

SEQ ID NO: 284240 - protein, 8 aa, Influenza virus
QKIMESGE

SEQ ID NO: 284241 - protein, 8 aa, Influenza virus
KIMESGGV

SEQ ID NO: 284242 - protein, 8 aa, Influenza virus
MESGGISK

SEQ ID NO: 284243 - protein, 8 aa, Influenza virus
SFYTELKW

SEQ ID NO: 284244 - protein, 8 aa, Influenza virus
FYTELKWL

SEQ ID NO: 284245 - protein, 8 aa, Influenza virus
ELKWLVSG

SEQ ID NO: 284246 - protein, 8 aa, Influenza virus
KGQSFPQT

SEQ ID NO: 284247 - protein, 8 aa, Influenza virus
GQNFPQTA

SEQ ID NO: 284248 - protein, 8 aa, Influenza virus
QNFPQTAN

SEQ ID NO: 284249 - protein, 8 aa, Influenza virus
NFPQTANT

SEQ ID NO: 284250 - protein, 8 aa, Influenza virus
FPQTANTY

SEQ ID NO: 284251 - protein, 8 aa, Influenza virus
PQTANTYR

SEQ ID NO: 284252 - protein, 8 aa, Influenza virus
QTANTYRN

SEQ ID NO: 284253 - protein, 8 aa, Influenza virus
TANTYRNT

SEQ ID NO: 284254 - protein, 8 aa, Influenza virus
ANTYRNTD

SEQ ID NO: 284255 - protein, 8 aa, Influenza virus
NTYRNTDT

SEQ ID NO: 284256 - protein, 8 aa, Influenza virus
VWGIHHPS

SEQ ID NO: 284257 - protein, 8 aa, Influenza virus
WGIHHPSN

SEQ ID NO: 284258 - protein, 8 aa, Influenza virus
GIHHPSSA

SEQ ID NO: 284259 - protein, 8 aa, Influenza virus
EKNDLYGA

SEQ ID NO: 284260 - protein, 8 aa, Influenza virus
LYGTQPLS

SEQ ID NO: 284261 - protein, 8 aa, Influenza virus
YGTQPLSI

SEQ ID NO: 284262 - protein, 8 aa, Influenza virus
GAQSLSIS

SEQ ID NO: 284263 - protein, 8 aa, Influenza virus
TQSLSISI

SEQ ID NO: 284264 - protein, 8 aa, Influenza virus
QSLSISIG

SEQ ID NO: 284265 - protein, 8 aa, Influenza virus
SLSISIGS

SEQ ID NO: 284266 - protein, 8 aa, Influenza virus
LSISIGSS

SEQ ID NO: 284267 - protein, 8 aa, Influenza virus
SISVESST

SEQ ID NO: 284268 - protein, 8 aa, Influenza virus
ISVESSTY

SEQ ID NO: 284269 - protein, 8 aa, Influenza virus
SVESSTYQ

SEQ ID NO: 284270 - protein, 8 aa, Influenza virus
IGSSTYQN

SEQ ID NO: 284271 - protein, 8 aa, Influenza virus
GSSTYQNS

SEQ ID NO: 284272 - protein, 8 aa, Influenza virus
SSTYQNSF

SEQ ID NO: 284273 - protein, 8 aa, Influenza virus
STYQNSFV

SEQ ID NO: 284274 - protein, 8 aa, Influenza virus
TYQNSFVP

SEQ ID NO: 284275 - protein, 8 aa, Influenza virus
YQNSFVPV

SEQ ID NO: 284276 - protein, 8 aa, Influenza virus
QNSFVPVV

SEQ ID NO: 284277 - protein, 8 aa, Influenza virus
NSFVPVVG

SEQ ID NO: 284278 - protein, 8 aa, Influenza virus
SFVPVVGA

SEQ ID NO: 284279 - protein, 8 aa, Influenza virus
FVPVIGAR

SEQ ID NO: 284280 - protein, 8 aa, Influenza virus
VPVIGARP

SEQ ID NO: 284281 - protein, 8 aa, Influenza virus
PVIGARPQ

SEQ ID NO: 284282 - protein, 8 aa, Influenza virus
VIGARPQV

SEQ ID NO: 284283 - protein, 8 aa, Influenza virus
IGARPQVN

SEQ ID NO: 284284 - protein, 8 aa, Influenza virus
RARPQVNG

SEQ ID NO: 284285 - protein, 8 aa, Influenza virus
DRPLVNGQ

SEQ ID NO: 284286 - protein, 8 aa, Influenza virus
RPQVNGQR

SEQ ID NO: 284287 - protein, 8 aa, Influenza virus
PQVNGQRG

SEQ ID NO: 284288 - protein, 8 aa, Influenza virus
LVNGQSGR

SEQ ID NO: 284289 - protein, 8 aa, Influenza virus
VNGQRGRI

SEQ ID NO: 284290 - protein, 8 aa, Influenza virus
NGQSGRIE

SEQ ID NO: 284291 - protein, 8 aa, Influenza virus
GQSGRIEF

SEQ ID NO: 284292 - protein, 8 aa, Influenza virus
QSGRIEFH

SEQ ID NO: 284293 - protein, 8 aa, Influenza virus
SGRIEFHW

SEQ ID NO: 284294 - protein, 8 aa, Influenza virus
GRIEFHWT

SEQ ID NO: 284295 - protein, 8 aa, Influenza virus
RPGDNITF

SEQ ID NO: 284296 - protein, 8 aa, Influenza virus
PGDSITFS

SEQ ID NO: 284297 - protein, 8 aa, Influenza virus
GDSITFSH

SEQ ID NO: 284298 - protein, 8 aa, Influenza virus
DSITFSHN

SEQ ID NO: 284299 - protein, 8 aa, Influenza virus
SITFSHNG

SEQ ID NO: 284300 - protein, 8 aa, Influenza virus
ITFSDNGG

SEQ ID NO: 284301 - protein, 8 aa, Influenza virus
TFSHNGGR

SEQ ID NO: 284302 - protein, 8 aa, Influenza virus
FSHNGGRI

SEQ ID NO: 284303 - protein, 8 aa, Influenza virus
SHNGGRIA

SEQ ID NO: 284304 - protein, 8 aa, Influenza virus
HNGGRIAP

SEQ ID NO: 284305 - protein, 8 aa, Influenza virus
NGGLIAPD

SEQ ID NO: 284306 - protein, 8 aa, Influenza virus
GGLIAPDR

SEQ ID NO: 284307 - protein, 8 aa, Influenza virus
GLIAPDRV

SEQ ID NO: 284308 - protein, 8 aa, Influenza virus
IAPSRVTK

SEQ ID NO: 284309 - protein, 8 aa, Influenza virus
APSRVTKL

SEQ ID NO: 284310 - protein, 8 aa, Influenza virus
GKGIGIQS

SEQ ID NO: 284311 - protein, 8 aa, Influenza virus
NCESKCFW

SEQ ID NO: 284312 - protein, 8 aa, Influenza virus
CESKCFWR

SEQ ID NO: 284313 - protein, 8 aa, Influenza virus
ESKCFWRG

SEQ ID NO: 284314 - protein, 8 aa, Influenza virus
SKCFWRGG

SEQ ID NO: 284315 - protein, 8 aa, Influenza virus
KCFWRGGS

SEQ ID NO: 284316 - protein, 8 aa, Influenza virus
CFWRGGSI

SEQ ID NO: 284317 - protein, 8 aa, Influenza virus
FWRGGSIN

SEQ ID NO: 284318 - protein, 8 aa, Influenza virus
WRGGSINT

SEQ ID NO: 284319 - protein, 8 aa, Influenza virus
GGSINTRL

SEQ ID NO: 284320 - protein, 8 aa, Influenza virus
GSINTRLP

SEQ ID NO: 284321 - protein, 8 aa, Influenza virus
SINTRLPF

SEQ ID NO: 284322 - protein, 8 aa, Influenza virus
INTRLPFQ

SEQ ID NO: 284323 - protein, 8 aa, Influenza virus
NTRLPFQN

SEQ ID NO: 284324 - protein, 8 aa, Influenza virus
TRLPFQNL

SEQ ID NO: 284325 - protein, 8 aa, Influenza virus
RLPFQNLS

SEQ ID NO: 284326 - protein, 8 aa, Influenza virus
GQCPKYVS

SEQ ID NO: 284327 - protein, 8 aa, Influenza virus
QCPKYVSK

SEQ ID NO: 284328 - protein, 8 aa, Influenza virus
RSLLLATG

SEQ ID NO: 284329 - protein, 8 aa, Influenza virus
SLMLATGM

SEQ ID NO: 284330 - protein, 8 aa, Influenza virus
LMLATGMR

SEQ ID NO: 284331 - protein, 8 aa, Influenza virus
MLATGMRN

SEQ ID NO: 284332 - protein, 8 aa, Influenza virus
GMRNVPEI

SEQ ID NO: 284333 - protein, 8 aa, Influenza virus
QERGLFGA

SEQ ID NO: 284334 - protein, 8 aa, Influenza virus
ERGLFGAI

SEQ ID NO: 284335 - protein, 8 aa, Influenza virus
RGLFGAKA

SEQ ID NO: 284336 - protein, 8 aa, Influenza virus
GLFGAKAG

SEQ ID NO: 284337 - protein, 8 aa, Influenza virus
LFGAKAGF

SEQ ID NO: 284338 - protein, 8 aa, Influenza virus
FGAKAGFI

SEQ ID NO: 284339 - protein, 8 aa, Influenza virus
GAKAGFIE

SEQ ID NO: 284340 - protein, 8 aa, Influenza virus
AKAGFIEN

SEQ ID NO: 284341 - protein, 8 aa, Influenza virus
KAGFIENG

SEQ ID NO: 284342 - protein, 8 aa, Influenza virus
NGWEGMID

SEQ ID NO: 284343 - protein, 8 aa, Influenza virus
GWEGMIDG

SEQ ID NO: 284344 - protein, 8 aa, Influenza virus
WEGMIDGW

SEQ ID NO: 284345 - protein, 8 aa, Influenza virus
EGMIDGWY

SEQ ID NO: 284346 - protein, 8 aa, Influenza virus
GMIDGWYG

SEQ ID NO: 284347 - protein, 8 aa, Influenza virus
MIDGWYGF

SEQ ID NO: 284348 - protein, 8 aa, Influenza virus
IDGWYGFR

SEQ ID NO: 284349 - protein, 8 aa, Influenza virus
RHQNAQGI

SEQ ID NO: 284350 - protein, 8 aa, Influenza virus
HQNAQGIG

SEQ ID NO: 284351 - protein, 8 aa, Influenza virus
QNAQGIGQ

SEQ ID NO: 284352 - protein, 8 aa, Influenza virus
NAQGIGQA

SEQ ID NO: 284353 - protein, 8 aa, Influenza virus
AQGIGQAA

SEQ ID NO: 284354 - protein, 8 aa, Influenza virus
QGIGQAAD

SEQ ID NO: 284355 - protein, 8 aa, Influenza virus
GIGQAADY

SEQ ID NO: 284356 - protein, 8 aa, Influenza virus
IGQAADYK

SEQ ID NO: 284357 - protein, 8 aa, Influenza virus
GQAADYES

SEQ ID NO: 284358 - protein, 8 aa, Influenza virus
QAADYEST

SEQ ID NO: 284359 - protein, 8 aa, Influenza virus
AADYESTQ

SEQ ID NO: 284360 - protein, 8 aa, Influenza virus
ADYKSTQT

SEQ ID NO: 284361 - protein, 8 aa, Influenza virus
DYKSTQTA

SEQ ID NO: 284362 - protein, 8 aa, Influenza virus
YKSTQAAV

SEQ ID NO: 284363 - protein, 8 aa, Influenza virus
AVDQITGK

SEQ ID NO: 284364 - protein, 8 aa, Influenza virus
VDQITGKL

SEQ ID NO: 284365 - protein, 8 aa, Influenza virus
DQVTGKLN

SEQ ID NO: 284366 - protein, 8 aa, Influenza virus
QVTGKLNR

SEQ ID NO: 284367 - protein, 8 aa, Influenza virus
VTGKLNRL

SEQ ID NO: 284368 - protein, 8 aa, Influenza virus
ESIESEFN

SEQ ID NO: 284369 - protein, 8 aa, Influenza virus
SIESEFNE

SEQ ID NO: 284370 - protein, 8 aa, Influenza virus
IESEFNEI

SEQ ID NO: 284371 - protein, 8 aa, Influenza virus
ESEFNEIE

SEQ ID NO: 284372 - protein, 8 aa, Influenza virus
SEFNEIEH

SEQ ID NO: 284373 - protein, 8 aa, Influenza virus
EFNEIEHQ

SEQ ID NO: 284374 - protein, 8 aa, Influenza virus
FNEIEHQI

SEQ ID NO: 284375 - protein, 8 aa, Influenza virus
NEIEHQIG

SEQ ID NO: 284376 - protein, 8 aa, Influenza virus
ETEHQIGN

SEQ ID NO: 284377 - protein, 8 aa, Influenza virus
TEHQIGNV

SEQ ID NO: 284378 - protein, 8 aa, Influenza virus
EYQIGNVI

SEQ ID NO: 284379 - protein, 8 aa, Influenza virus
YQIGNVIN

SEQ ID NO: 284380 - protein, 8 aa, Influenza virus
ITYIWTYQ

SEQ ID NO: 284381 - protein, 8 aa, Influenza virus
TYIWTYQA

SEQ ID NO: 284382 - protein, 8 aa, Influenza virus
YIWTYQAE

SEQ ID NO: 284383 - protein, 8 aa, Influenza virus
TYNAELLV

SEQ ID NO: 284384 - protein, 8 aa, Influenza virus
YQAELLIA

SEQ ID NO: 284385 - protein, 8 aa, Influenza virus
QEELLVAM

SEQ ID NO: 284386 - protein, 8 aa, Influenza virus
NQHTIDMG

SEQ ID NO: 284387 - protein, 8 aa, Influenza virus
QHTIEMTD

SEQ ID NO: 284388 - protein, 8 aa, Influenza virus
HTIDLADS

SEQ ID NO: 284389 - protein, 8 aa, Influenza virus
TIDLADSE

SEQ ID NO: 284390 - protein, 8 aa, Influenza virus
IEMTDSEM

SEQ ID NO: 284391 - protein, 8 aa, Influenza virus
EMTDSEML

SEQ ID NO: 284392 - protein, 8 aa, Influenza virus
MGDSEMLN

SEQ ID NO: 284393 - protein, 8 aa, Influenza virus
ADSTMLNL

SEQ ID NO: 284394 - protein, 8 aa, Influenza virus
SEMLNLYD

SEQ ID NO: 284395 - protein, 8 aa, Influenza virus
EMLNLYDR

SEQ ID NO: 284396 - protein, 8 aa, Influenza virus
MLNLYDRV

SEQ ID NO: 284397 - protein, 8 aa, Influenza virus
LNLYDRVR

SEQ ID NO: 284398 - protein, 8 aa, Influenza virus
NLYDRVRK

SEQ ID NO: 284399 - protein, 8 aa, Influenza virus
LYDRVRKQ

SEQ ID NO: 284400 - protein, 8 aa, Influenza virus
YDRVRKQL

SEQ ID NO: 284401 - protein, 8 aa, Influenza virus
DRVRKQLR

SEQ ID NO: 284402 - protein, 8 aa, Influenza virus
QNAEEDGR

SEQ ID NO: 284403 - protein, 8 aa, Influenza virus
NAEEDGRG

SEQ ID NO: 284404 - protein, 8 aa, Influenza virus
AEEDGRGC

SEQ ID NO: 284405 - protein, 8 aa, Influenza virus
EEDGRGCF

SEQ ID NO: 284406 - protein, 8 aa, Influenza virus
EDGRGCFE

SEQ ID NO: 284407 - protein, 8 aa, Influenza virus
DGRGCFEI

SEQ ID NO: 284408 - protein, 8 aa, Influenza virus
GRGCFEIY

SEQ ID NO: 284409 - protein, 8 aa, Influenza virus
RGCFEIYH

SEQ ID NO: 284410 - protein, 8 aa, Influenza virus
GCFEIYHA

SEQ ID NO: 284411 - protein, 8 aa, Influenza virus
CFEIYHAC

SEQ ID NO: 284412 - protein, 8 aa, Influenza virus
FEIYHACD

SEQ ID NO: 284413 - protein, 8 aa, Influenza virus
SCMESIRN

SEQ ID NO: 284414 - protein, 8 aa, Influenza virus
CMERIRNN

SEQ ID NO: 284415 - protein, 8 aa, Influenza virus
MERIRNNT

SEQ ID NO: 284416 - protein, 8 aa, Influenza virus
ERIRNNTY

SEQ ID NO: 284417 - protein, 8 aa, Influenza virus
SIRNNTYN

SEQ ID NO: 284418 - protein, 8 aa, Influenza virus
IRNNTYNH

SEQ ID NO: 284419 - protein, 8 aa, Influenza virus
RNNTYDHS

SEQ ID NO: 284420 - protein, 8 aa, Influenza virus
NNTYDHSQ

SEQ ID NO: 284421 - protein, 8 aa, Influenza virus
NTYDHSQY

SEQ ID NO: 284422 - protein, 8 aa, Influenza virus
TYDHSQYR

SEQ ID NO: 284423 - protein, 8 aa, Influenza virus
YDHSQYRE

SEQ ID NO: 284424 - protein, 8 aa, Influenza virus
DHSQYREE

SEQ ID NO: 284425 - protein, 8 aa, Influenza virus
HSQYREEA

SEQ ID NO: 284426 - protein, 8 aa, Influenza virus
SQYREEAL

SEQ ID NO: 284427 - protein, 8 aa, Influenza virus
HYREEALL

SEQ ID NO: 284428 - protein, 8 aa, Influenza virus
YREESLLN

SEQ ID NO: 284429 - protein, 8 aa, Influenza virus
REESLLNR

SEQ ID NO: 284430 - protein, 8 aa, Influenza virus
EESLLNRL

SEQ ID NO: 284431 - protein, 8 aa, Influenza virus
EALLNRLS

SEQ ID NO: 284432 - protein, 8 aa, Influenza virus
ALLNRLSI

SEQ ID NO: 284433 - protein, 8 aa, Influenza virus
LLNRLSIN

SEQ ID NO: 284434 - protein, 8 aa, Influenza virus
LNRLNINS

SEQ ID NO: 284435 - protein, 8 aa, Influenza virus
NRLNINSV

SEQ ID NO: 284436 - protein, 8 aa, Influenza virus
INSVKLSS

SEQ ID NO: 284437 - protein, 8 aa, Influenza virus
NSVKLSSG

SEQ ID NO: 284438 - protein, 8 aa, Influenza virus
SVKLSSGY

SEQ ID NO: 284439 - protein, 8 aa, Influenza virus
VTLSSGYK

SEQ ID NO: 284440 - protein, 8 aa, Influenza virus
TLSSGYKD

SEQ ID NO: 284441 - protein, 8 aa, Influenza virus
LSSGYKDI

SEQ ID NO: 284442 - protein, 8 aa, Influenza virus
SSGYKDII

SEQ ID NO: 284443 - protein, 8 aa, Influenza virus
SGYKDIIL

SEQ ID NO: 284444 - protein, 8 aa, Influenza virus
GYKDIILW

SEQ ID NO: 284445 - protein, 8 aa, Influenza virus
YKDIILWF

SEQ ID NO: 284446 - protein, 8 aa, Influenza virus
KDIILWFS

SEQ ID NO: 284447 - protein, 8 aa, Influenza virus
DIILWFSF

SEQ ID NO: 284448 - protein, 8 aa, Influenza virus
IILWFSFG

SEQ ID NO: 284449 - protein, 8 aa, Influenza virus
WFSFGASS

SEQ ID NO: 284450 - protein, 8 aa, Influenza virus
FSFGASSF

SEQ ID NO: 284451 - protein, 8 aa, Influenza virus
SFGASCFI

SEQ ID NO: 284452 - protein, 8 aa, Influenza virus
FGASCFIL

SEQ ID NO: 284453 - protein, 8 aa, Influenza virus
GASCFILL

SEQ ID NO: 284454 - protein, 8 aa, Influenza virus
ASCFILLA

SEQ ID NO: 284455 - protein, 8 aa, Influenza virus
SCFILLAV

SEQ ID NO: 284456 - protein, 8 aa, Influenza virus
FFCLRNGN

SEQ ID NO: 284457 - protein, 8 aa, Influenza virus
FCLRNGNM

SEQ ID NO: 284458 - protein, 8 aa, Influenza virus
CLRNGNMR

SEQ ID NO: 284459 - protein, 8 aa, Influenza virus
GIDKICLG

SEQ ID NO: 284460 - protein, 8 aa, Influenza virus
IDKICLGH

SEQ ID NO: 284461 - protein, 8 aa, Influenza virus
DRICLGHH

SEQ ID NO: 284462 - protein, 8 aa, Influenza virus
RICLGHHA

SEQ ID NO: 284463 - protein, 8 aa, Influenza virus
CLGHHAVP

SEQ ID NO: 284464 - protein, 8 aa, Influenza virus
LGHHAVPN

SEQ ID NO: 284465 - protein, 8 aa, Influenza virus
GHHAVPNG

SEQ ID NO: 284466 - protein, 8 aa, Influenza virus
HHAVPNGT

SEQ ID NO: 284467 - protein, 8 aa, Influenza virus
HAVPNGTI

SEQ ID NO: 284468 - protein, 8 aa, Influenza virus
PNGTIVKT

SEQ ID NO: 284469 - protein, 8 aa, Influenza virus
NGTVVKTL

SEQ ID NO: 284470 - protein, 8 aa, Influenza virus
GTVVKTLT

SEQ ID NO: 284471 - protein, 8 aa, Influenza virus
TIVKTLTS

SEQ ID NO: 284472 - protein, 8 aa, Influenza virus
IVKTLTSE

SEQ ID NO: 284473 - protein, 8 aa, Influenza virus
VKTLTNEQ

SEQ ID NO: 284474 - protein, 8 aa, Influenza virus
KTLTNEQE

SEQ ID NO: 284475 - protein, 8 aa, Influenza virus
TLTNEQEE

SEQ ID NO: 284476 - protein, 8 aa, Influenza virus
LTNEQEEV

SEQ ID NO: 284477 - protein, 8 aa, Influenza virus
EQEEVTNA

SEQ ID NO: 284478 - protein, 8 aa, Influenza virus
QEEVTNAT

SEQ ID NO: 284479 - protein, 8 aa, Influenza virus
EKVTNATE

SEQ ID NO: 284480 - protein, 8 aa, Influenza virus
KVTNATET

SEQ ID NO: 284481 - protein, 8 aa, Influenza virus
NATETVEN

SEQ ID NO: 284482 - protein, 8 aa, Influenza virus
ATETVEST

SEQ ID NO: 284483 - protein, 8 aa, Influenza virus
YKDLGSCH

SEQ ID NO: 284484 - protein, 8 aa, Influenza virus
KDLGSCHP

SEQ ID NO: 284485 - protein, 8 aa, Influenza virus
DLGSCHPI

SEQ ID NO: 284486 - protein, 8 aa, Influenza virus
LGSCHPIG

SEQ ID NO: 284487 - protein, 8 aa, Influenza virus
GSCHPIGM

SEQ ID NO: 284488 - protein, 8 aa, Influenza virus
SCHPIGMV

SEQ ID NO: 284489 - protein, 8 aa, Influenza virus
CHPIGMII

SEQ ID NO: 284490 - protein, 8 aa, Influenza virus
HPIGMIIG

SEQ ID NO: 284491 - protein, 8 aa, Influenza virus
IGTPVCDP

SEQ ID NO: 284492 - protein, 8 aa, Influenza virus
GTPVCDPH

SEQ ID NO: 284493 - protein, 8 aa, Influenza virus
TPVCDPHL

SEQ ID NO: 284494 - protein, 8 aa, Influenza virus
PVCDPHLT

SEQ ID NO: 284495 - protein, 8 aa, Influenza virus
ACDLYLTG

SEQ ID NO: 284496 - protein, 8 aa, Influenza virus
CDPHLTGT

SEQ ID NO: 284497 - protein, 8 aa, Influenza virus
DPHLTGTW

SEQ ID NO: 284498 - protein, 8 aa, Influenza virus
LYLTGTWD

SEQ ID NO: 284499 - protein, 8 aa, Influenza virus
YLTGTWDT

SEQ ID NO: 284500 - protein, 8 aa, Influenza virus
LTGIWDTL

SEQ ID NO: 284501 - protein, 8 aa, Influenza virus
TGKWDTLI

SEQ ID NO: 284502 - protein, 8 aa, Influenza virus
GMWDTLIE

SEQ ID NO: 284503 - protein, 8 aa, Influenza virus
KWDTLIER

SEQ ID NO: 284504 - protein, 8 aa, Influenza virus
WDTLIERE

SEQ ID NO: 284505 - protein, 8 aa, Influenza virus
DTLIEREN

SEQ ID NO: 284506 - protein, 8 aa, Influenza virus
TLIERENA

SEQ ID NO: 284507 - protein, 8 aa, Influenza virus
AIAYCYPG

SEQ ID NO: 284508 - protein, 8 aa, Influenza virus
IAHCYPGA

SEQ ID NO: 284509 - protein, 8 aa, Influenza virus
AHCYPGAT

SEQ ID NO: 284510 - protein, 8 aa, Influenza virus
HCYPGATI

SEQ ID NO: 284511 - protein, 8 aa, Influenza virus
CYPGATIN

SEQ ID NO: 284512 - protein, 8 aa, Influenza virus
YPGATINE

SEQ ID NO: 284513 - protein, 8 aa, Influenza virus
PGATINEE

SEQ ID NO: 284514 - protein, 8 aa, Influenza virus
GATINEEA

SEQ ID NO: 284515 - protein, 8 aa, Influenza virus
ATINEEAL

SEQ ID NO: 284516 - protein, 8 aa, Influenza virus
TINEEALR

SEQ ID NO: 284517 - protein, 8 aa, Influenza virus
INEEALRQ

SEQ ID NO: 284518 - protein, 8 aa, Influenza virus
NEGALRQK

SEQ ID NO: 284519 - protein, 8 aa, Influenza virus
EGALRQKI

SEQ ID NO: 284520 - protein, 8 aa, Influenza virus
GALRQKIM

SEQ ID NO: 284521 - protein, 8 aa, Influenza virus
IMESGGIS

SEQ ID NO: 284522 - protein, 8 aa, Influenza virus
MESGGISK

SEQ ID NO: 284523 - protein, 8 aa, Influenza virus
ESGGISKI

SEQ ID NO: 284524 - protein, 8 aa, Influenza virus
SGGIDKIG

SEQ ID NO: 284525 - protein, 8 aa, Influenza virus
GGIDKIGT

SEQ ID NO: 284526 - protein, 8 aa, Influenza virus
FIYGSSIN

SEQ ID NO: 284527 - protein, 8 aa, Influenza virus
IYGSSINS

SEQ ID NO: 284528 - protein, 8 aa, Influenza virus
YESSINPA

SEQ ID NO: 284529 - protein, 8 aa, Influenza virus
ESSINPAG

SEQ ID NO: 284530 - protein, 8 aa, Influenza virus
SINSAGDT

SEQ ID NO: 284531 - protein, 8 aa, Influenza virus
GGDSFYAE

SEQ ID NO: 284532 - protein, 8 aa, Influenza virus
GDSFYAEL

SEQ ID NO: 284533 - protein, 8 aa, Influenza virus
DSFYAELK

SEQ ID NO: 284534 - protein, 8 aa, Influenza virus
YAELKWLI

SEQ ID NO: 284535 - protein, 8 aa, Influenza virus
AELKWLIS

SEQ ID NO: 284536 - protein, 8 aa, Influenza virus
ELKWLISK

SEQ ID NO: 284537 - protein, 8 aa, Influenza virus
LKWLVSKT

SEQ ID NO: 284538 - protein, 8 aa, Influenza virus
KWLVSKTK

SEQ ID NO: 284539 - protein, 8 aa, Influenza virus
WLVSKTKG

SEQ ID NO: 284540 - protein, 8 aa, Influenza virus
LVSKTKGQ

SEQ ID NO: 284541 - protein, 8 aa, Influenza virus
KGQNFPRT

SEQ ID NO: 284542 - protein, 8 aa, Influenza virus
QNFPQTAN

SEQ ID NO: 284543 - protein, 8 aa, Influenza virus
NFPQTANT

SEQ ID NO: 284544 - protein, 8 aa, Influenza virus
FPQTANTY

SEQ ID NO: 284545 - protein, 8 aa, Influenza virus
PQTANTYR

SEQ ID NO: 284546 - protein, 8 aa, Influenza virus
QTANTYRN

SEQ ID NO: 284547 - protein, 8 aa, Influenza virus
TANTYRNT

SEQ ID NO: 284548 - protein, 8 aa, Influenza virus
ANTYRNTD

SEQ ID NO: 284549 - protein, 8 aa, Influenza virus
NTYRNTDT

SEQ ID NO: 284550 - protein, 8 aa, Influenza virus
EHLIVWGI

SEQ ID NO: 284551 - protein, 8 aa, Influenza virus
HLIVWGIH

SEQ ID NO: 284552 - protein, 8 aa, Influenza virus
LIVWGIHH

SEQ ID NO: 284553 - protein, 8 aa, Influenza virus
IVWGIHHP

SEQ ID NO: 284554 - protein, 8 aa, Influenza virus
VWGIHHPS

SEQ ID NO: 284555 - protein, 8 aa, Influenza virus
GIHHPSSA

SEQ ID NO: 284556 - protein, 8 aa, Influenza virus
IHHPSSTK

SEQ ID NO: 284557 - protein, 8 aa, Influenza virus
HHPSSTKE

SEQ ID NO: 284558 - protein, 8 aa, Influenza virus
HPSSTKEK

SEQ ID NO: 284559 - protein, 8 aa, Influenza virus
PSSTKEKN

SEQ ID NO: 284560 - protein, 8 aa, Influenza virus
SSAQEKND

SEQ ID NO: 284561 - protein, 8 aa, Influenza virus
SAQEKNDL

SEQ ID NO: 284562 - protein, 8 aa, Influenza virus
TKEKNDLY

SEQ ID NO: 284563 - protein, 8 aa, Influenza virus
KEKNDLYG

SEQ ID NO: 284564 - protein, 8 aa, Influenza virus
EKNELYGT

SEQ ID NO: 284565 - protein, 8 aa, Influenza virus
KNELYGTQ

SEQ ID NO: 284566 - protein, 8 aa, Influenza virus
NELYGTQS

SEQ ID NO: 284567 - protein, 8 aa, Influenza virus
DLYGTQPL

SEQ ID NO: 284568 - protein, 8 aa, Influenza virus
LYGTQPLS

SEQ ID NO: 284569 - protein, 8 aa, Influenza virus
YGTQPLSI

SEQ ID NO: 284570 - protein, 8 aa, Influenza virus
GTQPLSIS

SEQ ID NO: 284571 - protein, 8 aa, Influenza virus
TQSLSISI

SEQ ID NO: 284572 - protein, 8 aa, Influenza virus
QSLSISVE

SEQ ID NO: 284573 - protein, 8 aa, Influenza virus
SLSISVES

SEQ ID NO: 284574 - protein, 8 aa, Influenza virus
LSISVESS

SEQ ID NO: 284575 - protein, 8 aa, Influenza virus
SISVESST

SEQ ID NO: 284576 - protein, 8 aa, Influenza virus
ISVESSTY

SEQ ID NO: 284577 - protein, 8 aa, Influenza virus
SVESSTYQ

SEQ ID NO: 284578 - protein, 8 aa, Influenza virus
VESSTYQN

SEQ ID NO: 284579 - protein, 8 aa, Influenza virus
ESSTYQNN

SEQ ID NO: 284580 - protein, 8 aa, Influenza virus
SSTYQNSF

SEQ ID NO: 284581 - protein, 8 aa, Influenza virus
STYQNSFV

SEQ ID NO: 284582 - protein, 8 aa, Influenza virus
TYQNSFVP

SEQ ID NO: 284583 - protein, 8 aa, Influenza virus
YQNSFVPV

SEQ ID NO: 284584 - protein, 8 aa, Influenza virus
QNSFVPVV

SEQ ID NO: 284585 - protein, 8 aa, Influenza virus
NSFVPVVG

SEQ ID NO: 284586 - protein, 8 aa, Influenza virus
SFVPVVGA

SEQ ID NO: 284587 - protein, 8 aa, Influenza virus
NGQSGRIN

SEQ ID NO: 284588 - protein, 8 aa, Influenza virus
GQSGRINF

SEQ ID NO: 284589 - protein, 8 aa, Influenza virus
QSGRINFH

SEQ ID NO: 284590 - protein, 8 aa, Influenza virus
SGRINFHW

SEQ ID NO: 284591 - protein, 8 aa, Influenza virus
GRIDFHWA

SEQ ID NO: 284592 - protein, 8 aa, Influenza virus
VVQPGDNI

SEQ ID NO: 284593 - protein, 8 aa, Influenza virus
VRPGDNIT

SEQ ID NO: 284594 - protein, 8 aa, Influenza virus
RPGDNITF

SEQ ID NO: 284595 - protein, 8 aa, Influenza virus
PGDNIIFS

SEQ ID NO: 284596 - protein, 8 aa, Influenza virus
GDNIIFSH

SEQ ID NO: 284597 - protein, 8 aa, Influenza virus
DNITFSDN

SEQ ID NO: 284598 - protein, 8 aa, Influenza virus
NITFLHNG

SEQ ID NO: 284599 - protein, 8 aa, Influenza virus
ITFSDNGG

SEQ ID NO: 284600 - protein, 8 aa, Influenza virus
TFLHNGGL

SEQ ID NO: 284601 - protein, 8 aa, Influenza virus
FSHNGGLV

SEQ ID NO: 284602 - protein, 8 aa, Influenza virus
SDNGGLIA

SEQ ID NO: 284603 - protein, 8 aa, Influenza virus
HNGGLVAP

SEQ ID NO: 284604 - protein, 8 aa, Influenza virus
NGGLVAPS

SEQ ID NO: 284605 - protein, 8 aa, Influenza virus
GGLIAPDR

SEQ ID NO: 284606 - protein, 8 aa, Influenza virus
GLVAPSRV

SEQ ID NO: 284607 - protein, 8 aa, Influenza virus
LIAPSRVT

SEQ ID NO: 284608 - protein, 8 aa, Influenza virus
IAPSRVTK

SEQ ID NO: 284609 - protein, 8 aa, Influenza virus
APSRVTKL

SEQ ID NO: 284610 - protein, 8 aa, Influenza virus
PSRVSKLR

SEQ ID NO: 284611 - protein, 8 aa, Influenza virus
SRVSKLRG

SEQ ID NO: 284612 - protein, 8 aa, Influenza virus
GRDLGIQS

SEQ ID NO: 284613 - protein, 8 aa, Influenza virus
RGLGIQSD

SEQ ID NO: 284614 - protein, 8 aa, Influenza virus
GLGIQSEA

SEQ ID NO: 284615 - protein, 8 aa, Influenza virus
DNNCESKC

SEQ ID NO: 284616 - protein, 8 aa, Influenza virus
NNCESKCF

SEQ ID NO: 284617 - protein, 8 aa, Influenza virus
NCESKCFW

SEQ ID NO: 284618 - protein, 8 aa, Influenza virus
CESKCFWR

SEQ ID NO: 284619 - protein, 8 aa, Influenza virus
ESKCFWRG

SEQ ID NO: 284620 - protein, 8 aa, Influenza virus
SKCFWRGG

SEQ ID NO: 284621 - protein, 8 aa, Influenza virus
KCFWRGGS

SEQ ID NO: 284622 - protein, 8 aa, Influenza virus
CFWRGGSI

SEQ ID NO: 284623 - protein, 8 aa, Influenza virus
FWKGGSIK

SEQ ID NO: 284624 - protein, 8 aa, Influenza virus
WKGGSIKT

SEQ ID NO: 284625 - protein, 8 aa, Influenza virus
KGGSIKTK

SEQ ID NO: 284626 - protein, 8 aa, Influenza virus
GGSIKTKL

SEQ ID NO: 284627 - protein, 8 aa, Influenza virus
GSIKTKLP

SEQ ID NO: 284628 - protein, 8 aa, Influenza virus
SIKTKLPF

SEQ ID NO: 284629 - protein, 8 aa, Influenza virus
IKTKLPFQ

SEQ ID NO: 284630 - protein, 8 aa, Influenza virus
KTKLPFQN

SEQ ID NO: 284631 - protein, 8 aa, Influenza virus
TRLPFQNL

SEQ ID NO: 284632 - protein, 8 aa, Influenza virus
RLPFQNLS

SEQ ID NO: 284633 - protein, 8 aa, Influenza virus
GQCPKYVS

SEQ ID NO: 284634 - protein, 8 aa, Influenza virus
QCPKYVSK

SEQ ID NO: 284635 - protein, 8 aa, Influenza virus
RSLLLATG

SEQ ID NO: 284636 - protein, 8 aa, Influenza virus
SLMLATGM

SEQ ID NO: 284637 - protein, 8 aa, Influenza virus
LMLATGMR

SEQ ID NO: 284638 - protein, 8 aa, Influenza virus
MLATGMRN

SEQ ID NO: 284639 - protein, 8 aa, Influenza virus
GMRNVPEI

SEQ ID NO: 284640 - protein, 8 aa, Influenza virus
QERGLFGA

SEQ ID NO: 284641 - protein, 8 aa, Influenza virus
ERGLFGAI

SEQ ID NO: 284642 - protein, 8 aa, Influenza virus
FGAKAGFI

SEQ ID NO: 284643 - protein, 8 aa, Influenza virus
GAIAGFLE

SEQ ID NO: 284644 - protein, 8 aa, Influenza virus
AKAGFIEN

SEQ ID NO: 284645 - protein, 8 aa, Influenza virus
IAGFLENG

SEQ ID NO: 284646 - protein, 8 aa, Influenza virus
TGQAADYE

SEQ ID NO: 284647 - protein, 8 aa, Influenza virus
GQAADYES

SEQ ID NO: 284648 - protein, 8 aa, Influenza virus
QAADYEST

SEQ ID NO: 284649 - protein, 8 aa, Influenza virus
AADYESTQ

SEQ ID NO: 284650 - protein, 8 aa, Influenza virus
ADYESTQA

SEQ ID NO: 284651 - protein, 8 aa, Influenza virus
DYESTQAA

SEQ ID NO: 284652 - protein, 8 aa, Influenza virus
YKSTQAAV

SEQ ID NO: 284653 - protein, 8 aa, Influenza virus
KSTQAAVD

SEQ ID NO: 284654 - protein, 8 aa, Influenza virus
STQAAVDQ

SEQ ID NO: 284655 - protein, 8 aa, Influenza virus
TQAAVDQI

SEQ ID NO: 284656 - protein, 8 aa, Influenza virus
QAAVDQIT

SEQ ID NO: 284657 - protein, 8 aa, Influenza virus
AAVDQITG

SEQ ID NO: 284658 - protein, 8 aa, Influenza virus
AVDQITGK

SEQ ID NO: 284659 - protein, 8 aa, Influenza virus
VDQITGKL

SEQ ID NO: 284660 - protein, 8 aa, Influenza virus
DQVTGKLN

SEQ ID NO: 284661 - protein, 8 aa, Influenza virus
QVTGKLNR

SEQ ID NO: 284662 - protein, 8 aa, Influenza virus
VTGKLNRL

SEQ ID NO: 284663 - protein, 8 aa, Influenza virus
ESIESEFN

SEQ ID NO: 284664 - protein, 8 aa, Influenza virus
SIESEFNE

SEQ ID NO: 284665 - protein, 8 aa, Influenza virus
IESEFNEI

SEQ ID NO: 284666 - protein, 8 aa, Influenza virus
ESEFNEIE

SEQ ID NO: 284667 - protein, 8 aa, Influenza virus
SEFNEIEH

SEQ ID NO: 284668 - protein, 8 aa, Influenza virus
EFNEIEHQ

SEQ ID NO: 284669 - protein, 8 aa, Influenza virus
FNEIEHQI

SEQ ID NO: 284670 - protein, 8 aa, Influenza virus
NEIEHQIG

SEQ ID NO: 284671 - protein, 8 aa, Influenza virus
ETEHQIGN

SEQ ID NO: 284672 - protein, 8 aa, Influenza virus
TEHQIGNV

SEQ ID NO: 284673 - protein, 8 aa, Influenza virus
EYQIGNVI

SEQ ID NO: 284674 - protein, 8 aa, Influenza virus
YQIGNVIN

SEQ ID NO: 284675 - protein, 8 aa, Influenza virus
TYNAELLV

SEQ ID NO: 284676 - protein, 8 aa, Influenza virus
YQAELLIA

SEQ ID NO: 284677 - protein, 8 aa, Influenza virus
NAELLVAM

SEQ ID NO: 284678 - protein, 8 aa, Influenza virus
TIDMADST

SEQ ID NO: 284679 - protein, 8 aa, Influenza virus
IDLADSEM

SEQ ID NO: 284680 - protein, 8 aa, Influenza virus
DMADSTML

SEQ ID NO: 284681 - protein, 8 aa, Influenza virus
MADSTMLN

SEQ ID NO: 284682 - protein, 8 aa, Influenza virus
SEMLNLYD

SEQ ID NO: 284683 - protein, 8 aa, Influenza virus
EMLNLYDR

SEQ ID NO: 284684 - protein, 8 aa, Influenza virus
MLNLYDRV

SEQ ID NO: 284685 - protein, 8 aa, Influenza virus
LNLYDRVR

SEQ ID NO: 284686 - protein, 8 aa, Influenza virus
NLYDRVRK

SEQ ID NO: 284687 - protein, 8 aa, Influenza virus
LYDRVRKQ

SEQ ID NO: 284688 - protein, 8 aa, Influenza virus
YDRVRKQL

SEQ ID NO: 284689 - protein, 8 aa, Influenza virus
DRVRKQLR

SEQ ID NO: 284690 - protein, 8 aa, Influenza virus
QNAEEDGR

SEQ ID NO: 284691 - protein, 8 aa, Influenza virus
NAEEDGRG

SEQ ID NO: 284692 - protein, 8 aa, Influenza virus
AEEDGRGC

SEQ ID NO: 284693 - protein, 8 aa, Influenza virus
EEDGRGCF

SEQ ID NO: 284694 - protein, 8 aa, Influenza virus
EDGRGCFE

SEQ ID NO: 284695 - protein, 8 aa, Influenza virus
DGRGCFEI

SEQ ID NO: 284696 - protein, 8 aa, Influenza virus
GRGCFEIY

SEQ ID NO: 284697 - protein, 8 aa, Influenza virus
RGCFEIYH

SEQ ID NO: 284698 - protein, 8 aa, Influenza virus
GCFEIYHA

SEQ ID NO: 284699 - protein, 8 aa, Influenza virus
CFEIYHAC

SEQ ID NO: 284700 - protein, 8 aa, Influenza virus
FEIYHACD

SEQ ID NO: 284701 - protein, 8 aa, Influenza virus
CDDSCMES

SEQ ID NO: 284702 - protein, 8 aa, Influenza virus
DDSCMESI

SEQ ID NO: 284703 - protein, 8 aa, Influenza virus
DSCMESIR

SEQ ID NO: 284704 - protein, 8 aa, Influenza virus
SCMESIRN

SEQ ID NO: 284705 - protein, 8 aa, Influenza virus
CMESIRDN

SEQ ID NO: 284706 - protein, 8 aa, Influenza virus
MESIRDNT

SEQ ID NO: 284707 - protein, 8 aa, Influenza virus
ESIRDNTY

SEQ ID NO: 284708 - protein, 8 aa, Influenza virus
RIRNNTYD

SEQ ID NO: 284709 - protein, 8 aa, Influenza virus
RNNTYDHA

SEQ ID NO: 284710 - protein, 8 aa, Influenza virus
NNTYDHAQ

SEQ ID NO: 284711 - protein, 8 aa, Influenza virus
NTYDHAQY

SEQ ID NO: 284712 - protein, 8 aa, Influenza virus
TYDHAQYR

SEQ ID NO: 284713 - protein, 8 aa, Influenza virus
YDHAQYRE

SEQ ID NO: 284714 - protein, 8 aa, Influenza virus
DHAQYREE

SEQ ID NO: 284715 - protein, 8 aa, Influenza virus
HAQYREEA

SEQ ID NO: 284716 - protein, 8 aa, Influenza virus
AQYREEAL

SEQ ID NO: 284717 - protein, 8 aa, Influenza virus
EALLNRLS

SEQ ID NO: 284718 - protein, 8 aa, Influenza virus
ALLNRLSI

SEQ ID NO: 284719 - protein, 8 aa, Influenza virus
LLNRLSIN

SEQ ID NO: 284720 - protein, 8 aa, Influenza virus
LNRLNINS

SEQ ID NO: 284721 - protein, 8 aa, Influenza virus
NRLNINSV

SEQ ID NO: 284722 - protein, 8 aa, Influenza virus
RLNINSVK

SEQ ID NO: 284723 - protein, 8 aa, Influenza virus
LNINSVKL

SEQ ID NO: 284724 - protein, 8 aa, Influenza virus
NINSVKLS

SEQ ID NO: 284725 - protein, 8 aa, Influenza virus
INSVKLSS

SEQ ID NO: 284726 - protein, 8 aa, Influenza virus
NSVKLSSG

SEQ ID NO: 284727 - protein, 8 aa, Influenza virus
SVKLSSGY

SEQ ID NO: 284728 - protein, 8 aa, Influenza virus
VTLSSGYK

SEQ ID NO: 284729 - protein, 8 aa, Influenza virus
TLSSGYKD

SEQ ID NO: 284730 - protein, 8 aa, Influenza virus
LSSGYKDI

SEQ ID NO: 284731 - protein, 8 aa, Influenza virus
SSGYKDII

SEQ ID NO: 284732 - protein, 8 aa, Influenza virus
SGYKDIIL

SEQ ID NO: 284733 - protein, 8 aa, Influenza virus
GYKDIILW

SEQ ID NO: 284734 - protein, 8 aa, Influenza virus
YKDIILWF

SEQ ID NO: 284735 - protein, 8 aa, Influenza virus
KDIILWFS

SEQ ID NO: 284736 - protein, 8 aa, Influenza virus
DIILWFSF

SEQ ID NO: 284737 - protein, 8 aa, Influenza virus
IILWFSFG

SEQ ID NO: 284738 - protein, 8 aa, Influenza virus
SFGASCFI

SEQ ID NO: 284739 - protein, 8 aa, Influenza virus
FGASCFIL

SEQ ID NO: 284740 - protein, 8 aa, Influenza virus
GASCFILL

SEQ ID NO: 284741 - protein, 8 aa, Influenza virus
ASCFILLA

SEQ ID NO: 284742 - protein, 8 aa, Influenza virus
SCFILLAV

SEQ ID NO: 284743 - protein, 8 aa, Influenza virus
CFVLLAVV

SEQ ID NO: 284744 - protein, 8 aa, Influenza virus
LLAVVMGL

SEQ ID NO: 284745 - protein, 8 aa, Influenza virus
VMGLVFFC

SEQ ID NO: 284746 - protein, 8 aa, Influenza virus
VGLVFFCL

SEQ ID NO: 284747 - protein, 8 aa, Influenza virus
GLVFFCLR

SEQ ID NO: 284748 - protein, 8 aa, Influenza virus
LVFFCLRN

SEQ ID NO: 284749 - protein, 8 aa, Influenza virus
VFFCLRNG

SEQ ID NO: 284750 - protein, 8 aa, Influenza virus
FFCLRNGN

SEQ ID NO: 284751 - protein, 8 aa, Influenza virus
FCLRNGNM

SEQ ID NO: 284752 - protein, 8 aa, Influenza virus
CLRNGNMR

SEQ ID NO: 284753 - protein, 8 aa, Influenza virus
LRNGNMRC

SEQ ID NO: 284754 - protein, 8 aa, Influenza virus
RNGNMRCT

SEQ ID NO: 284755 - protein, 8 aa, Influenza virus
MNPKSKLF

SEQ ID NO: 284756 - protein, 8 aa, Influenza virus
NPNQKLFT

SEQ ID NO: 284757 - protein, 8 aa, Influenza virus
PNQKLFTL

SEQ ID NO: 284758 - protein, 8 aa, Influenza virus
NQKLFTLS

SEQ ID NO: 284759 - protein, 8 aa, Influenza virus
QKLFTLSG

SEQ ID NO: 284760 - protein, 8 aa, Influenza virus
KLFTLSGV

SEQ ID NO: 284761 - protein, 8 aa, Influenza virus
LFTLSGVA

SEQ ID NO: 284762 - protein, 8 aa, Influenza virus
FTLSGVAI

SEQ ID NO: 284763 - protein, 8 aa, Influenza virus
TLSGVAIA

SEQ ID NO: 284764 - protein, 8 aa, Influenza virus
LSGVAVAL

SEQ ID NO: 284765 - protein, 8 aa, Influenza virus
SGVAVALS

SEQ ID NO: 284766 - protein, 8 aa, Influenza virus
LNLIIGIS

SEQ ID NO: 284767 - protein, 8 aa, Influenza virus
NLIIGISN

SEQ ID NO: 284768 - protein, 8 aa, Influenza virus
LIIGISNV

SEQ ID NO: 284769 - protein, 8 aa, Influenza virus
IIGISNVG

SEQ ID NO: 284770 - protein, 8 aa, Influenza virus
ISNVGLNI

SEQ ID NO: 284771 - protein, 8 aa, Influenza virus
SNVGLKVS

SEQ ID NO: 284772 - protein, 8 aa, Influenza virus
NVGLKVSL

SEQ ID NO: 284773 - protein, 8 aa, Influenza virus
VGLKVSLH

SEQ ID NO: 284774 - protein, 8 aa, Influenza virus
GLKVSLHL

SEQ ID NO: 284775 - protein, 8 aa, Influenza virus
LNISLHLK

SEQ ID NO: 284776 - protein, 8 aa, Influenza virus
EKGPKQEE

SEQ ID NO: 284777 - protein, 8 aa, Influenza virus
TQNNTTVV

SEQ ID NO: 284778 - protein, 8 aa, Influenza virus
QNNTTVVE

SEQ ID NO: 284779 - protein, 8 aa, Influenza virus
NNTTVVEN

SEQ ID NO: 284780 - protein, 8 aa, Influenza virus
NTTVVENT

SEQ ID NO: 284781 - protein, 8 aa, Influenza virus
TTVVENTY

SEQ ID NO: 284782 - protein, 8 aa, Influenza virus
TVVENTYV

SEQ ID NO: 284783 - protein, 8 aa, Influenza virus
VVENTYVN

SEQ ID NO: 284784 - protein, 8 aa, Influenza virus
VENTYVNN

SEQ ID NO: 284785 - protein, 8 aa, Influenza virus
ENTYVNKT

SEQ ID NO: 284786 - protein, 8 aa, Influenza virus
NTYVNKTT

SEQ ID NO: 284787 - protein, 8 aa, Influenza virus
TYVNNTTI

SEQ ID NO: 284788 - protein, 8 aa, Influenza virus
YVNNTTII

SEQ ID NO: 284789 - protein, 8 aa, Influenza virus
VNNTTIIT

SEQ ID NO: 284790 - protein, 8 aa, Influenza virus
NNTTIITK

SEQ ID NO: 284791 - protein, 8 aa, Influenza virus
YLLLNKSL

SEQ ID NO: 284792 - protein, 8 aa, Influenza virus
LLLNKSLC

SEQ ID NO: 284793 - protein, 8 aa, Influenza virus
VLNKSLCK

SEQ ID NO: 284794 - protein, 8 aa, Influenza virus
LNKSLCNV

SEQ ID NO: 284795 - protein, 8 aa, Influenza virus
NKSLCNVE

SEQ ID NO: 284796 - protein, 8 aa, Influenza virus
KSLCNVEG

SEQ ID NO: 284797 - protein, 8 aa, Influenza virus
SLCNVEGW

SEQ ID NO: 284798 - protein, 8 aa, Influenza virus
LCNVEGWV

SEQ ID NO: 284799 - protein, 8 aa, Influenza virus
CNVEGWVV

SEQ ID NO: 284800 - protein, 8 aa, Influenza virus
NVEGWVVI

SEQ ID NO: 284801 - protein, 8 aa, Influenza virus
VEGWVVIA

SEQ ID NO: 284802 - protein, 8 aa, Influenza virus
EGWVVIAK

SEQ ID NO: 284803 - protein, 8 aa, Influenza virus
GWVVIAKD

SEQ ID NO: 284804 - protein, 8 aa, Influenza virus
WVVIAKDN

SEQ ID NO: 284805 - protein, 8 aa, Influenza virus
VVIAKDNA

SEQ ID NO: 284806 - protein, 8 aa, Influenza virus
VIAKDNAV

SEQ ID NO: 284807 - protein, 8 aa, Influenza virus
IAKDNAVR

SEQ ID NO: 284808 - protein, 8 aa, Influenza virus
AKDNAVRF

SEQ ID NO: 284809 - protein, 8 aa, Influenza virus
KDNAVRFG

SEQ ID NO: 284810 - protein, 8 aa, Influenza virus
DNAVRFGE

SEQ ID NO: 284811 - protein, 8 aa, Influenza virus
NAVRFGES

SEQ ID NO: 284812 - protein, 8 aa, Influenza virus
AVRFGESE

SEQ ID NO: 284813 - protein, 8 aa, Influenza virus
VRFGESEQ

SEQ ID NO: 284814 - protein, 8 aa, Influenza virus
RFGESEQV

SEQ ID NO: 284815 - protein, 8 aa, Influenza virus
FGESEQVI

SEQ ID NO: 284816 - protein, 8 aa, Influenza virus
GESEQVIV

SEQ ID NO: 284817 - protein, 8 aa, Influenza virus
ESEQVIVT

SEQ ID NO: 284818 - protein, 8 aa, Influenza virus
SEQVIVTR

SEQ ID NO: 284819 - protein, 8 aa, Influenza virus
EQVIVTRE

SEQ ID NO: 284820 - protein, 8 aa, Influenza virus
QVIVTREP

SEQ ID NO: 284821 - protein, 8 aa, Influenza virus
VIVTREPY

SEQ ID NO: 284822 - protein, 8 aa, Influenza virus
PYVSCDPT

SEQ ID NO: 284823 - protein, 8 aa, Influenza virus
YVSCDPTG

SEQ ID NO: 284824 - protein, 8 aa, Influenza virus
VSCDPSGC

SEQ ID NO: 284825 - protein, 8 aa, Influenza virus
SCDPLGCR

SEQ ID NO: 284826 - protein, 8 aa, Influenza virus
CDPLGCRM

SEQ ID NO: 284827 - protein, 8 aa, Influenza virus
DPLGCRMY

SEQ ID NO: 284828 - protein, 8 aa, Influenza virus
PLGCRMYA

SEQ ID NO: 284829 - protein, 8 aa, Influenza virus
LGCRMYAL

SEQ ID NO: 284830 - protein, 8 aa, Influenza virus
GCRMYALH

SEQ ID NO: 284831 - protein, 8 aa, Influenza virus
CRMYALHQ

SEQ ID NO: 284832 - protein, 8 aa, Influenza virus
RMYALHQG

SEQ ID NO: 284833 - protein, 8 aa, Influenza virus
QGTTIRNR

SEQ ID NO: 284834 - protein, 8 aa, Influenza virus
GTTIRNRH

SEQ ID NO: 284835 - protein, 8 aa, Influenza virus
TTIRNRHS

SEQ ID NO: 284836 - protein, 8 aa, Influenza virus
TIRNRHSN

SEQ ID NO: 284837 - protein, 8 aa, Influenza virus
IRNRHSNG

SEQ ID NO: 284838 - protein, 8 aa, Influenza virus
RNRHSNGT

SEQ ID NO: 284839 - protein, 8 aa, Influenza virus
NRHSNGTI

SEQ ID NO: 284840 - protein, 8 aa, Influenza virus
RHSNGTIH

SEQ ID NO: 284841 - protein, 8 aa, Influenza virus
RTAFRGLM

SEQ ID NO: 284842 - protein, 8 aa, Influenza virus
TAFRGLMS

SEQ ID NO: 284843 - protein, 8 aa, Influenza virus
AFRGLMST

SEQ ID NO: 284844 - protein, 8 aa, Influenza virus
FRGLMSTP

SEQ ID NO: 284845 - protein, 8 aa, Influenza virus
RGLMSTPL

SEQ ID NO: 284846 - protein, 8 aa, Influenza virus
GLMSTPLG

SEQ ID NO: 284847 - protein, 8 aa, Influenza virus
LISTPLGT

SEQ ID NO: 284848 - protein, 8 aa, Influenza virus
ISTPLGTP

SEQ ID NO: 284849 - protein, 8 aa, Influenza virus
STPLGTPP

SEQ ID NO: 284850 - protein, 8 aa, Influenza virus
TPLGSPPV

SEQ ID NO: 284851 - protein, 8 aa, Influenza virus
PLGSPPVV

SEQ ID NO: 284852 - protein, 8 aa, Influenza virus
LGSPPVVS

SEQ ID NO: 284853 - protein, 8 aa, Influenza virus
GSPPVVSN

SEQ ID NO: 284854 - protein, 8 aa, Influenza virus
SPPVVSNS

SEQ ID NO: 284855 - protein, 8 aa, Influenza virus
PPVVSNSD

SEQ ID NO: 284856 - protein, 8 aa, Influenza virus
PVVSNSDF

SEQ ID NO: 284857 - protein, 8 aa, Influenza virus
VSNSEFLC

SEQ ID NO: 284858 - protein, 8 aa, Influenza virus
SNSEFLCV

SEQ ID NO: 284859 - protein, 8 aa, Influenza virus
NSEFLCVG

SEQ ID NO: 284860 - protein, 8 aa, Influenza virus
SEFLCVGW

SEQ ID NO: 284861 - protein, 8 aa, Influenza virus
EFLCVGWS

SEQ ID NO: 284862 - protein, 8 aa, Influenza virus
FICVGWSS

SEQ ID NO: 284863 - protein, 8 aa, Influenza virus
ICVGWSST

SEQ ID NO: 284864 - protein, 8 aa, Influenza virus
CVGWSSTT

SEQ ID NO: 284865 - protein, 8 aa, Influenza virus
VGWSSTTC

SEQ ID NO: 284866 - protein, 8 aa, Influenza virus
GWSSTTCH

SEQ ID NO: 284867 - protein, 8 aa, Influenza virus
WSSTTCHD

SEQ ID NO: 284868 - protein, 8 aa, Influenza virus
SSTTCHDG

SEQ ID NO: 284869 - protein, 8 aa, Influenza virus
STSCHDGV

SEQ ID NO: 284870 - protein, 8 aa, Influenza virus
TSCHDGVG

SEQ ID NO: 284871 - protein, 8 aa, Influenza virus
SCHDGVGR

SEQ ID NO: 284872 - protein, 8 aa, Influenza virus
CHDGVGRM

SEQ ID NO: 284873 - protein, 8 aa, Influenza virus
HDGVGRMT

SEQ ID NO: 284874 - protein, 8 aa, Influenza virus
DGVGRMTI

SEQ ID NO: 284875 - protein, 8 aa, Influenza virus
GVGRMTIC

SEQ ID NO: 284876 - protein, 8 aa, Influenza virus
VGRMTICV

SEQ ID NO: 284877 - protein, 8 aa, Influenza virus
GRMTICIQ

SEQ ID NO: 284878 - protein, 8 aa, Influenza virus
RMTICIQG

SEQ ID NO: 284879 - protein, 8 aa, Influenza virus
MTICIQGN

SEQ ID NO: 284880 - protein, 8 aa, Influenza virus
TICIQGNN

SEQ ID NO: 284881 - protein, 8 aa, Influenza virus
ICVQGNNN

SEQ ID NO: 284882 - protein, 8 aa, Influenza virus
CVQGNNNN

SEQ ID NO: 284883 - protein, 8 aa, Influenza virus
VQGNNNNA

SEQ ID NO: 284884 - protein, 8 aa, Influenza virus
QGNNNNAT

SEQ ID NO: 284885 - protein, 8 aa, Influenza virus
GNNNNATA

SEQ ID NO: 284886 - protein, 8 aa, Influenza virus
NNNNATAT

SEQ ID NO: 284887 - protein, 8 aa, Influenza virus
NNNATATV

SEQ ID NO: 284888 - protein, 8 aa, Influenza virus
NNATATVY

SEQ ID NO: 284889 - protein, 8 aa, Influenza virus
ATATVYYN

SEQ ID NO: 284890 - protein, 8 aa, Influenza virus
TATVYYNR

SEQ ID NO: 284891 - protein, 8 aa, Influenza virus
ATVYYNRR

SEQ ID NO: 284892 - protein, 8 aa, Influenza virus
TVYYNRRL

SEQ ID NO: 284893 - protein, 8 aa, Influenza virus
VYYNRRLT

SEQ ID NO: 284894 - protein, 8 aa, Influenza virus
YYNRRLTT

SEQ ID NO: 284895 - protein, 8 aa, Influenza virus
YNRRLTTT

SEQ ID NO: 284896 - protein, 8 aa, Influenza virus
NRRLTTTI

SEQ ID NO: 284897 - protein, 8 aa, Influenza virus
GRLTTTIK

SEQ ID NO: 284898 - protein, 8 aa, Influenza virus
RLTTTIKP

SEQ ID NO: 284899 - protein, 8 aa, Influenza virus
LTTTIKPW

SEQ ID NO: 284900 - protein, 8 aa, Influenza virus
TTTIKPWA

SEQ ID NO: 284901 - protein, 8 aa, Influenza virus
TTIKTWAR

SEQ ID NO: 284902 - protein, 8 aa, Influenza virus
TIKTWARN

SEQ ID NO: 284903 - protein, 8 aa, Influenza virus
IKTWARNI

SEQ ID NO: 284904 - protein, 8 aa, Influenza virus
KTWARNIL

SEQ ID NO: 284905 - protein, 8 aa, Influenza virus
TWARNILR

SEQ ID NO: 284906 - protein, 8 aa, Influenza virus
WARNILRT

SEQ ID NO: 284907 - protein, 8 aa, Influenza virus
ARNILRTQ

SEQ ID NO: 284908 - protein, 8 aa, Influenza virus
RNILRTQE

SEQ ID NO: 284909 - protein, 8 aa, Influenza virus
KILRTQES

SEQ ID NO: 284910 - protein, 8 aa, Influenza virus
VCHNGTCA

SEQ ID NO: 284911 - protein, 8 aa, Influenza virus
CHNGTCAV

SEQ ID NO: 284912 - protein, 8 aa, Influenza virus
HNGTCVVV

SEQ ID NO: 284913 - protein, 8 aa, Influenza virus
NGTCVVVM

SEQ ID NO: 284914 - protein, 8 aa, Influenza virus
GTCVVVMT

SEQ ID NO: 284915 - protein, 8 aa, Influenza virus
TCVVVMTD

SEQ ID NO: 284916 - protein, 8 aa, Influenza virus
CVVVMTDG

SEQ ID NO: 284917 - protein, 8 aa, Influenza virus
VVVMTDGS

SEQ ID NO: 284918 - protein, 8 aa, Influenza virus
VVMTDGSA

SEQ ID NO: 284919 - protein, 8 aa, Influenza virus
VMTDGSAS

SEQ ID NO: 284920 - protein, 8 aa, Influenza virus
MTDGPASS

SEQ ID NO: 284921 - protein, 8 aa, Influenza virus
TDGPASSQ

SEQ ID NO: 284922 - protein, 8 aa, Influenza virus
DGSANSQA

SEQ ID NO: 284923 - protein, 8 aa, Influenza virus
GSASSQAH

SEQ ID NO: 284924 - protein, 8 aa, Influenza virus
SASSQAHT

SEQ ID NO: 284925 - protein, 8 aa, Influenza virus
ASSQAHTK

SEQ ID NO: 284926 - protein, 8 aa, Influenza virus
SSQAHTKV

SEQ ID NO: 284927 - protein, 8 aa, Influenza virus
QAHTKVLY

SEQ ID NO: 284928 - protein, 8 aa, Influenza virus
AHTKVLYF

SEQ ID NO: 284929 - protein, 8 aa, Influenza virus
HTKVLYFH

SEQ ID NO: 284930 - protein, 8 aa, Influenza virus
TKVMYFHK

SEQ ID NO: 284931 - protein, 8 aa, Influenza virus
KVMYFHKG

SEQ ID NO: 284932 - protein, 8 aa, Influenza virus
VLYFHKGI

SEQ ID NO: 284933 - protein, 8 aa, Influenza virus
LYFHKGLI

SEQ ID NO: 284934 - protein, 8 aa, Influenza virus
YFHKGLII

SEQ ID NO: 284935 - protein, 8 aa, Influenza virus
FHKGLIIK

SEQ ID NO: 284936 - protein, 8 aa, Influenza virus
HKGLIIKE

SEQ ID NO: 284937 - protein, 8 aa, Influenza virus
KGLIIKEE

SEQ ID NO: 284938 - protein, 8 aa, Influenza virus
KEEPLKGS

SEQ ID NO: 284939 - protein, 8 aa, Influenza virus
EEPLKGSA

SEQ ID NO: 284940 - protein, 8 aa, Influenza virus
EPLKGSAK

SEQ ID NO: 284941 - protein, 8 aa, Influenza virus
PLKGSAKH

SEQ ID NO: 284942 - protein, 8 aa, Influenza virus
LKGSAKHI

SEQ ID NO: 284943 - protein, 8 aa, Influenza virus
KGSAKHIE

SEQ ID NO: 284944 - protein, 8 aa, Influenza virus
GSAKHIEE

SEQ ID NO: 284945 - protein, 8 aa, Influenza virus
SAKHIEEC

SEQ ID NO: 284946 - protein, 8 aa, Influenza virus
AKHIEECS

SEQ ID NO: 284947 - protein, 8 aa, Influenza virus
KHIEECSC

SEQ ID NO: 284948 - protein, 8 aa, Influenza virus
HVEECSCY

SEQ ID NO: 284949 - protein, 8 aa, Influenza virus
IEECPCYG

SEQ ID NO: 284950 - protein, 8 aa, Influenza virus
ECSCYGHD

SEQ ID NO: 284951 - protein, 8 aa, Influenza virus
CSCYGHDS

SEQ ID NO: 284952 - protein, 8 aa, Influenza virus
SCYGHDSK

SEQ ID NO: 284953 - protein, 8 aa, Influenza virus
CYGHDSKV

SEQ ID NO: 284954 - protein, 8 aa, Influenza virus
YGHDSKVT

SEQ ID NO: 284955 - protein, 8 aa, Influenza virus
GHDSKVTC

SEQ ID NO: 284956 - protein, 8 aa, Influenza virus
QKVTCVCR

SEQ ID NO: 284957 - protein, 8 aa, Influenza virus
KITCVCRD

SEQ ID NO: 284958 - protein, 8 aa, Influenza virus
ITCVCRDN

SEQ ID NO: 284959 - protein, 8 aa, Influenza virus
WQGANRPI

SEQ ID NO: 284960 - protein, 8 aa, Influenza virus
QGANRPII

SEQ ID NO: 284961 - protein, 8 aa, Influenza virus
GANRPVIK

SEQ ID NO: 284962 - protein, 8 aa, Influenza virus
ANRPVIKI

SEQ ID NO: 284963 - protein, 8 aa, Influenza virus
NRPVIKID

SEQ ID NO: 284964 - protein, 8 aa, Influenza virus
RPVIKIDM

SEQ ID NO: 284965 - protein, 8 aa, Influenza virus
TLEHTSRY

SEQ ID NO: 284966 - protein, 8 aa, Influenza virus
LEHTSRYV

SEQ ID NO: 284967 - protein, 8 aa, Influenza virus
EHTSRYVC

SEQ ID NO: 284968 - protein, 8 aa, Influenza virus
HTSRYVCT

SEQ ID NO: 284969 - protein, 8 aa, Influenza virus
TSRYVCTG

SEQ ID NO: 284970 - protein, 8 aa, Influenza virus
SRYVCTGI

SEQ ID NO: 284971 - protein, 8 aa, Influenza virus
RYVCTGIL

SEQ ID NO: 284972 - protein, 8 aa, Influenza virus
YVCTGILT

SEQ ID NO: 284973 - protein, 8 aa, Influenza virus
VCTGILTD

SEQ ID NO: 284974 - protein, 8 aa, Influenza virus
CTGILTDT

SEQ ID NO: 284975 - protein, 8 aa, Influenza virus
TGILTDTS

SEQ ID NO: 284976 - protein, 8 aa, Influenza virus
GILTDTSR

SEQ ID NO: 284977 - protein, 8 aa, Influenza virus
ILTDTSRP

SEQ ID NO: 284978 - protein, 8 aa, Influenza virus
LTDTSRPG

SEQ ID NO: 284979 - protein, 8 aa, Influenza virus
TDTSRPGD

SEQ ID NO: 284980 - protein, 8 aa, Influenza virus
DTSRPGDK

SEQ ID NO: 284981 - protein, 8 aa, Influenza virus
GDCSNPIT

SEQ ID NO: 284982 - protein, 8 aa, Influenza virus
DCSNPITG

SEQ ID NO: 284983 - protein, 8 aa, Influenza virus
CSNPITGS

SEQ ID NO: 284984 - protein, 8 aa, Influenza virus
SNPITGSP

SEQ ID NO: 284985 - protein, 8 aa, Influenza virus
NPITGSPS

SEQ ID NO: 284986 - protein, 8 aa, Influenza virus
PITGSPSA

SEQ ID NO: 284987 - protein, 8 aa, Influenza virus
ITGSPSAP

SEQ ID NO: 284988 - protein, 8 aa, Influenza virus
TGSPSAPG

SEQ ID NO: 284989 - protein, 8 aa, Influenza virus
GSPSAPGV

SEQ ID NO: 284990 - protein, 8 aa, Influenza virus
SPSAPGVK

SEQ ID NO: 284991 - protein, 8 aa, Influenza virus
PSAPGVKG

SEQ ID NO: 284992 - protein, 8 aa, Influenza virus
SAPGVKGF

SEQ ID NO: 284993 - protein, 8 aa, Influenza virus
VKGFGFLN

SEQ ID NO: 284994 - protein, 8 aa, Influenza virus
KGFGFLNG

SEQ ID NO: 284995 - protein, 8 aa, Influenza virus
DNTWLGRT

SEQ ID NO: 284996 - protein, 8 aa, Influenza virus
NTWLGGTI

SEQ ID NO: 284997 - protein, 8 aa, Influenza virus
TWLGRTFS

SEQ ID NO: 284998 - protein, 8 aa, Influenza virus
WLGRTFSP

SEQ ID NO: 284999 - protein, 8 aa, Influenza virus
LGRTISPH

SEQ ID NO: 285000 - protein, 8 aa, Influenza virus
GRTFSPRS

SEQ ID NO: 285001 - protein, 8 aa, Influenza virus
RTFSPRSR

SEQ ID NO: 285002 - protein, 8 aa, Influenza virus
TISPHSRS

SEQ ID NO: 285003 - protein, 8 aa, Influenza virus
ISPHSRSG

SEQ ID NO: 285004 - protein, 8 aa, Influenza virus
SGFEMLKV

SEQ ID NO: 285005 - protein, 8 aa, Influenza virus
GFEMLKVP

SEQ ID NO: 285006 - protein, 8 aa, Influenza virus
FEMLKVPN

SEQ ID NO: 285007 - protein, 8 aa, Influenza virus
EMLKVPNA

SEQ ID NO: 285008 - protein, 8 aa, Influenza virus
MLKIPNAE

SEQ ID NO: 285009 - protein, 8 aa, Influenza virus
LKIPNAET

SEQ ID NO: 285010 - protein, 8 aa, Influenza virus
KIPNAETD

SEQ ID NO: 285011 - protein, 8 aa, Influenza virus
IPNAETDP

SEQ ID NO: 285012 - protein, 8 aa, Influenza virus
PNAETDPN

SEQ ID NO: 285013 - protein, 8 aa, Influenza virus
NAETDPNS

SEQ ID NO: 285014 - protein, 8 aa, Influenza virus
ITGRQEIV

SEQ ID NO: 285015 - protein, 8 aa, Influenza virus
AERQEIVD

SEQ ID NO: 285016 - protein, 8 aa, Influenza virus
GRQEIVDN

SEQ ID NO: 285017 - protein, 8 aa, Influenza virus
RQEIVDNS

SEQ ID NO: 285018 - protein, 8 aa, Influenza virus
NSNWSGYS

SEQ ID NO: 285019 - protein, 8 aa, Influenza virus
SNWSGYSG

SEQ ID NO: 285020 - protein, 8 aa, Influenza virus
NLSGYSGS

SEQ ID NO: 285021 - protein, 8 aa, Influenza virus
GSFIDYWN

SEQ ID NO: 285022 - protein, 8 aa, Influenza virus
SFIDYWDD

SEQ ID NO: 285023 - protein, 8 aa, Influenza virus
NECYNPCF

SEQ ID NO: 285024 - protein, 8 aa, Influenza virus
VCYNPCFY

SEQ ID NO: 285025 - protein, 8 aa, Influenza virus
IRGRPEEV

SEQ ID NO: 285026 - protein, 8 aa, Influenza virus
RGRPEEVK

SEQ ID NO: 285027 - protein, 8 aa, Influenza virus
GRPEEVKY

SEQ ID NO: 285028 - protein, 8 aa, Influenza virus
RPEEVKYV

SEQ ID NO: 285029 - protein, 8 aa, Influenza virus
PEEVKYVW

SEQ ID NO: 285030 - protein, 8 aa, Influenza virus
EEVKYVWW

SEQ ID NO: 285031 - protein, 8 aa, Influenza virus
EVKYVWWT

SEQ ID NO: 285032 - protein, 8 aa, Influenza virus
VKYVWWTS

SEQ ID NO: 285033 - protein, 8 aa, Influenza virus
WWTSNSLI

SEQ ID NO: 285034 - protein, 8 aa, Influenza virus
WTSNSLIA

SEQ ID NO: 285035 - protein, 8 aa, Influenza virus
TSNSLIAL

SEQ ID NO: 285036 - protein, 8 aa, Influenza virus
SNSLIALC

SEQ ID NO: 285037 - protein, 8 aa, Influenza virus
NSLIALCG

SEQ ID NO: 285038 - protein, 8 aa, Influenza virus
SLIALCGS

SEQ ID NO: 285039 - protein, 8 aa, Influenza virus
LIALCGSP

SEQ ID NO: 285040 - protein, 8 aa, Influenza virus
VALCGSPV

SEQ ID NO: 285041 - protein, 8 aa, Influenza virus
ALCGSPVS

SEQ ID NO: 285042 - protein, 8 aa, Influenza virus
LCGSPVSV

SEQ ID NO: 285043 - protein, 8 aa, Influenza virus
CGSPVSVG

SEQ ID NO: 285044 - protein, 8 aa, Influenza virus
GSPVSVGS

SEQ ID NO: 285045 - protein, 8 aa, Influenza virus
SPVSVGSG

SEQ ID NO: 285046 - protein, 8 aa, Influenza virus
PVSVGSGS

SEQ ID NO: 285047 - protein, 8 aa, Influenza virus
VSVGSGSF

SEQ ID NO: 285048 - protein, 8 aa, Influenza virus
PVGSGSFP

SEQ ID NO: 285049 - protein, 8 aa, Influenza virus
GSFPDGAR

SEQ ID NO: 285050 - protein, 8 aa, Influenza virus
SFPDGARI

SEQ ID NO: 285051 - protein, 8 aa, Influenza virus
FPNGAQIQ

SEQ ID NO: 285052 - protein, 8 aa, Influenza virus
PDGAKIQY

SEQ ID NO: 285053 - protein, 8 aa, Influenza virus
DGARIQYF

SEQ ID NO: 285054 - protein, 8 aa, Influenza virus
GARIQYFS

SEQ ID NO: 285055 - protein, 8 aa, Influenza virus
KADEICIG

SEQ ID NO: 285056 - protein, 8 aa, Influenza virus
ADKICIGY

SEQ ID NO: 285057 - protein, 8 aa, Influenza virus
DEICIGYM

SEQ ID NO: 285058 - protein, 8 aa, Influenza virus
EICIGYMS

SEQ ID NO: 285059 - protein, 8 aa, Influenza virus
ICIGYMSN

SEQ ID NO: 285060 - protein, 8 aa, Influenza virus
CIGYMSNN

SEQ ID NO: 285061 - protein, 8 aa, Influenza virus
IGYMSNNS

SEQ ID NO: 285062 - protein, 8 aa, Influenza virus
GYMSNNST

SEQ ID NO: 285063 - protein, 8 aa, Influenza virus
YLSNNSTD

SEQ ID NO: 285064 - protein, 8 aa, Influenza virus
LSNNSTDK

SEQ ID NO: 285065 - protein, 8 aa, Influenza virus
SNNSTDKV

SEQ ID NO: 285066 - protein, 8 aa, Influenza virus
NNSTDKVD

SEQ ID NO: 285067 - protein, 8 aa, Influenza virus
NSTDKVDT

SEQ ID NO: 285068 - protein, 8 aa, Influenza virus
STDKVDTI

SEQ ID NO: 285069 - protein, 8 aa, Influenza virus
TDKVDTII

SEQ ID NO: 285070 - protein, 8 aa, Influenza virus
DKVDTIIE

SEQ ID NO: 285071 - protein, 8 aa, Influenza virus
KVDTIIEN

SEQ ID NO: 285072 - protein, 8 aa, Influenza virus
VDTIIENN

SEQ ID NO: 285073 - protein, 8 aa, Influenza virus
DTIIENNV

SEQ ID NO: 285074 - protein, 8 aa, Influenza virus
TIIENNVT

SEQ ID NO: 285075 - protein, 8 aa, Influenza virus
IIENNVTV

SEQ ID NO: 285076 - protein, 8 aa, Influenza virus
IENNVTVT

SEQ ID NO: 285077 - protein, 8 aa, Influenza virus
ENNVTVTS

SEQ ID NO: 285078 - protein, 8 aa, Influenza virus
NNVTVTSS

SEQ ID NO: 285079 - protein, 8 aa, Influenza virus
NVTVTSSI

SEQ ID NO: 285080 - protein, 8 aa, Influenza virus
VTVTSSIE

SEQ ID NO: 285081 - protein, 8 aa, Influenza virus
TVTSSIEL

SEQ ID NO: 285082 - protein, 8 aa, Influenza virus
VTSSIELV

SEQ ID NO: 285083 - protein, 8 aa, Influenza virus
TSSIELVE

SEQ ID NO: 285084 - protein, 8 aa, Influenza virus
SSVELVET

SEQ ID NO: 285085 - protein, 8 aa, Influenza virus
GHTGSFCS

SEQ ID NO: 285086 - protein, 8 aa, Influenza virus
HTGSFCSL

SEQ ID NO: 285087 - protein, 8 aa, Influenza virus
TGSFCSIN

SEQ ID NO: 285088 - protein, 8 aa, Influenza virus
GSFCSING

SEQ ID NO: 285089 - protein, 8 aa, Influenza virus
SFCSINGK

SEQ ID NO: 285090 - protein, 8 aa, Influenza virus
FCSINGKQ

SEQ ID NO: 285091 - protein, 8 aa, Influenza virus
CSINGKQP

SEQ ID NO: 285092 - protein, 8 aa, Influenza virus
SINGKQPI

SEQ ID NO: 285093 - protein, 8 aa, Influenza virus
INGKQPIS

SEQ ID NO: 285094 - protein, 8 aa, Influenza virus
NGKQPISL

SEQ ID NO: 285095 - protein, 8 aa, Influenza virus
GKQPISLG

SEQ ID NO: 285096 - protein, 8 aa, Influenza virus
KQPISLGD

SEQ ID NO: 285097 - protein, 8 aa, Influenza virus
QPISLGDC

SEQ ID NO: 285098 - protein, 8 aa, Influenza virus
SLGGCSFA

SEQ ID NO: 285099 - protein, 8 aa, Influenza virus
LGDCSFTG

SEQ ID NO: 285100 - protein, 8 aa, Influenza virus
GDCSFTGW

SEQ ID NO: 285101 - protein, 8 aa, Influenza virus
DCSFAGWL

SEQ ID NO: 285102 - protein, 8 aa, Influenza virus
CSFTGWIL

SEQ ID NO: 285103 - protein, 8 aa, Influenza virus
SFTGWILG

SEQ ID NO: 285104 - protein, 8 aa, Influenza virus
FAGWLLGN

SEQ ID NO: 285105 - protein, 8 aa, Influenza virus
TGWILGNP

SEQ ID NO: 285106 - protein, 8 aa, Influenza virus
GWILGNPR

SEQ ID NO: 285107 - protein, 8 aa, Influenza virus
WILGNPRC

SEQ ID NO: 285108 - protein, 8 aa, Influenza virus
ILGNPRCD

SEQ ID NO: 285109 - protein, 8 aa, Influenza virus
LGNPMCDE

SEQ ID NO: 285110 - protein, 8 aa, Influenza virus
GNPMCDEL

SEQ ID NO: 285111 - protein, 8 aa, Influenza virus
NPMCDELI

SEQ ID NO: 285112 - protein, 8 aa, Influenza virus
PMCDELIG

SEQ ID NO: 285113 - protein, 8 aa, Influenza virus
MCDELIGK

SEQ ID NO: 285114 - protein, 8 aa, Influenza virus
CDELIGKT

SEQ ID NO: 285115 - protein, 8 aa, Influenza virus
DELIGKTS

SEQ ID NO: 285116 - protein, 8 aa, Influenza virus
ELIGKTSW

SEQ ID NO: 285117 - protein, 8 aa, Influenza virus
LIGKNSWS

SEQ ID NO: 285118 - protein, 8 aa, Influenza virus
IEKTSWSY

SEQ ID NO: 285119 - protein, 8 aa, Influenza virus
GKNSWSYI

SEQ ID NO: 285120 - protein, 8 aa, Influenza virus
WSYIVEKL

SEQ ID NO: 285121 - protein, 8 aa, Influenza virus
SYIVEKTN

SEQ ID NO: 285122 - protein, 8 aa, Influenza virus
YIVEKSNP

SEQ ID NO: 285123 - protein, 8 aa, Influenza virus
NPANGICY

SEQ ID NO: 285124 - protein, 8 aa, Influenza virus
PANGICYP

SEQ ID NO: 285125 - protein, 8 aa, Influenza virus
ANGICYPG

SEQ ID NO: 285126 - protein, 8 aa, Influenza virus
NGICYPGS

SEQ ID NO: 285127 - protein, 8 aa, Influenza virus
GICYPGSL

SEQ ID NO: 285128 - protein, 8 aa, Influenza virus
ICYPGILE

SEQ ID NO: 285129 - protein, 8 aa, Influenza virus
EEELKLKF

SEQ ID NO: 285130 - protein, 8 aa, Influenza virus
SFFRHMVW

SEQ ID NO: 285131 - protein, 8 aa, Influenza virus
FFRHMVWL

SEQ ID NO: 285132 - protein, 8 aa, Influenza virus
FRHMVWLI

SEQ ID NO: 285133 - protein, 8 aa, Influenza virus
MIWLIHQS

SEQ ID NO: 285134 - protein, 8 aa, Influenza virus
WLVHQSGT

SEQ ID NO: 285135 - protein, 8 aa, Influenza virus
LIHQSETY

SEQ ID NO: 285136 - protein, 8 aa, Influenza virus
IHQSETYP

SEQ ID NO: 285137 - protein, 8 aa, Influenza virus
HQSGTYPI

SEQ ID NO: 285138 - protein, 8 aa, Influenza virus
QSGTYPVV

SEQ ID NO: 285139 - protein, 8 aa, Influenza virus
RTFNNIKG

SEQ ID NO: 285140 - protein, 8 aa, Influenza virus
FKNTKGRD

SEQ ID NO: 285141 - protein, 8 aa, Influenza virus
NNTKGGDV

SEQ ID NO: 285142 - protein, 8 aa, Influenza virus
NTKERDVL

SEQ ID NO: 285143 - protein, 8 aa, Influenza virus
DLYKKDNS

SEQ ID NO: 285144 - protein, 8 aa, Influenza virus
LYKKDNSY

SEQ ID NO: 285145 - protein, 8 aa, Influenza virus
YKKDSSYI

SEQ ID NO: 285146 - protein, 8 aa, Influenza virus
INGQAGRM

SEQ ID NO: 285147 - protein, 8 aa, Influenza virus
GRMTFYWK

SEQ ID NO: 285148 - protein, 8 aa, Influenza virus
RMTFYWKI

SEQ ID NO: 285149 - protein, 8 aa, Influenza virus
MTFYWKIV

SEQ ID NO: 285150 - protein, 8 aa, Influenza virus
ITFESDGA

SEQ ID NO: 285151 - protein, 8 aa, Influenza virus
TFESDGAF

SEQ ID NO: 285152 - protein, 8 aa, Influenza virus
FESNGAFI

SEQ ID NO: 285153 - protein, 8 aa, Influenza virus
ESNGAFIA

SEQ ID NO: 285154 - protein, 8 aa, Influenza virus
SNGAFIAP

SEQ ID NO: 285155 - protein, 8 aa, Influenza virus
NGAFIAPR

SEQ ID NO: 285156 - protein, 8 aa, Influenza virus
GAFIAPRY

SEQ ID NO: 285157 - protein, 8 aa, Influenza virus
AFIAPRYA

SEQ ID NO: 285158 - protein, 8 aa, Influenza virus
FIAPRYAF

SEQ ID NO: 285159 - protein, 8 aa, Influenza virus
IAPRYAFE

SEQ ID NO: 285160 - protein, 8 aa, Influenza virus
APRYAFEI

SEQ ID NO: 285161 - protein, 8 aa, Influenza virus
PRYAFEIV

SEQ ID NO: 285162 - protein, 8 aa, Influenza virus
RYAFEIVS

SEQ ID NO: 285163 - protein, 8 aa, Influenza virus
GNGKLFKS

SEQ ID NO: 285164 - protein, 8 aa, Influenza virus
GKLFRSEL

SEQ ID NO: 285165 - protein, 8 aa, Influenza virus
CSTKCQTE

SEQ ID NO: 285166 - protein, 8 aa, Influenza virus
KCQTEIGG

SEQ ID NO: 285167 - protein, 8 aa, Influenza virus
CQTEIGGI

SEQ ID NO: 285168 - protein, 8 aa, Influenza virus
QTEIGGIN

SEQ ID NO: 285169 - protein, 8 aa, Influenza virus
TEIGGINT

SEQ ID NO: 285170 - protein, 8 aa, Influenza virus
EVGGINTN

SEQ ID NO: 285171 - protein, 8 aa, Influenza virus
IGGINTNK

SEQ ID NO: 285172 - protein, 8 aa, Influenza virus
GGINTNKS

SEQ ID NO: 285173 - protein, 8 aa, Influenza virus
SFHSVHRN

SEQ ID NO: 285174 - protein, 8 aa, Influenza virus
FHSVHRNT

SEQ ID NO: 285175 - protein, 8 aa, Influenza virus
HSVHRNTI

SEQ ID NO: 285176 - protein, 8 aa, Influenza virus
SVHRNTIG

SEQ ID NO: 285177 - protein, 8 aa, Influenza virus
VHRNTIGN

SEQ ID NO: 285178 - protein, 8 aa, Influenza virus
HRNTIGNC

SEQ ID NO: 285179 - protein, 8 aa, Influenza virus
RNAIGDCP

SEQ ID NO: 285180 - protein, 8 aa, Influenza virus
NAIGDCPK

SEQ ID NO: 285181 - protein, 8 aa, Influenza virus
TFGDCPKY

SEQ ID NO: 285182 - protein, 8 aa, Influenza virus
IGDCPKYM

SEQ ID NO: 285183 - protein, 8 aa, Influenza virus
GDCPKYMN

SEQ ID NO: 285184 - protein, 8 aa, Influenza virus
DCPKYMNV

SEQ ID NO: 285185 - protein, 8 aa, Influenza virus
CPKYVNVR

SEQ ID NO: 285186 - protein, 8 aa, Influenza virus
PKYVNVRS

SEQ ID NO: 285187 - protein, 8 aa, Influenza virus
KYVNVRSL

SEQ ID NO: 285188 - protein, 8 aa, Influenza virus
YMNVKSLK

SEQ ID NO: 285189 - protein, 8 aa, Influenza virus
MNVKSLKL

SEQ ID NO: 285190 - protein, 8 aa, Influenza virus
NVRSLKLA

SEQ ID NO: 285191 - protein, 8 aa, Influenza virus
VRSLKLAT

SEQ ID NO: 285192 - protein, 8 aa, Influenza virus
RSLKLATG

SEQ ID NO: 285193 - protein, 8 aa, Influenza virus
SLKLATGP

SEQ ID NO: 285194 - protein, 8 aa, Influenza virus
LKLATGPR

SEQ ID NO: 285195 - protein, 8 aa, Influenza virus
KLATGPRN

SEQ ID NO: 285196 - protein, 8 aa, Influenza virus
LATGLRNI

SEQ ID NO: 285197 - protein, 8 aa, Influenza virus
ATGLRNIP

SEQ ID NO: 285198 - protein, 8 aa, Influenza virus
TGLRNIPA

SEQ ID NO: 285199 - protein, 8 aa, Influenza virus
GLRNIPAI

SEQ ID NO: 285200 - protein, 8 aa, Influenza virus
LRNIPAIA

SEQ ID NO: 285201 - protein, 8 aa, Influenza virus
SRGLFGAI

SEQ ID NO: 285202 - protein, 8 aa, Influenza virus
RGLFGAKA

SEQ ID NO: 285203 - protein, 8 aa, Influenza virus
GLFGAKAG

SEQ ID NO: 285204 - protein, 8 aa, Influenza virus
LFGAKAGF

SEQ ID NO: 285205 - protein, 8 aa, Influenza virus
FGAKAGFI

SEQ ID NO: 285206 - protein, 8 aa, Influenza virus
GAKAGFIE

SEQ ID NO: 285207 - protein, 8 aa, Influenza virus
AKAGFIEG

SEQ ID NO: 285208 - protein, 8 aa, Influenza virus
KAGFIEGG

SEQ ID NO: 285209 - protein, 8 aa, Influenza virus
YGFQHRND

SEQ ID NO: 285210 - protein, 8 aa, Influenza virus
GFQHRNDE

SEQ ID NO: 285211 - protein, 8 aa, Influenza virus
FQHRNDEG

SEQ ID NO: 285212 - protein, 8 aa, Influenza virus
QHRDEEGT

SEQ ID NO: 285213 - protein, 8 aa, Influenza virus
HRDEEGTG

SEQ ID NO: 285214 - protein, 8 aa, Influenza virus
RNEEGTGV

SEQ ID NO: 285215 - protein, 8 aa, Influenza virus
DEEGTGIA

SEQ ID NO: 285216 - protein, 8 aa, Influenza virus
DEGTGIAA

SEQ ID NO: 285217 - protein, 8 aa, Influenza virus
GTGIAADR

SEQ ID NO: 285218 - protein, 8 aa, Influenza virus
TGIAADRE

SEQ ID NO: 285219 - protein, 8 aa, Influenza virus
GIAADRES

SEQ ID NO: 285220 - protein, 8 aa, Influenza virus
IAADREST

SEQ ID NO: 285221 - protein, 8 aa, Influenza virus
AADRESTQ

SEQ ID NO: 285222 - protein, 8 aa, Influenza virus
ADRESTQK

SEQ ID NO: 285223 - protein, 8 aa, Influenza virus
DRESTQKA

SEQ ID NO: 285224 - protein, 8 aa, Influenza virus
NKIVDRMN

SEQ ID NO: 285225 - protein, 8 aa, Influenza virus
IEERINHL

SEQ ID NO: 285226 - protein, 8 aa, Influenza virus
EERINHLS

SEQ ID NO: 285227 - protein, 8 aa, Influenza virus
VDIWSYNA

SEQ ID NO: 285228 - protein, 8 aa, Influenza virus
NIWSYNAQ

SEQ ID NO: 285229 - protein, 8 aa, Influenza virus
IWSYNAKL

SEQ ID NO: 285230 - protein, 8 aa, Influenza virus
WSYNAKLL

SEQ ID NO: 285231 - protein, 8 aa, Influenza virus
SYNARLLV

SEQ ID NO: 285232 - protein, 8 aa, Influenza virus
YNAQLLVW

SEQ ID NO: 285233 - protein, 8 aa, Influenza virus
NAQLLVWL

SEQ ID NO: 285234 - protein, 8 aa, Influenza virus
AQLLVWLE

SEQ ID NO: 285235 - protein, 8 aa, Influenza virus
QLLVWLEN

SEQ ID NO: 285236 - protein, 8 aa, Influenza virus
LLVWLENE

SEQ ID NO: 285237 - protein, 8 aa, Influenza virus
LVWLENEK

SEQ ID NO: 285238 - protein, 8 aa, Influenza virus
VWLENEKT

SEQ ID NO: 285239 - protein, 8 aa, Influenza virus
WLENEKTL

SEQ ID NO: 285240 - protein, 8 aa, Influenza virus
DLHDSNVT

SEQ ID NO: 285241 - protein, 8 aa, Influenza virus
LHDSNVRS

SEQ ID NO: 285242 - protein, 8 aa, Influenza virus
HDSNVRSL

SEQ ID NO: 285243 - protein, 8 aa, Influenza virus
DSNVRSLH

SEQ ID NO: 285244 - protein, 8 aa, Influenza virus
SNVRSLHE

SEQ ID NO: 285245 - protein, 8 aa, Influenza virus
NVRNLHER

SEQ ID NO: 285246 - protein, 8 aa, Influenza virus
NLHERVRR

SEQ ID NO: 285247 - protein, 8 aa, Influenza virus
LHERVRRM

SEQ ID NO: 285248 - protein, 8 aa, Influenza virus
HERVRRML

SEQ ID NO: 285249 - protein, 8 aa, Influenza virus
LRDNAKDE

SEQ ID NO: 285250 - protein, 8 aa, Influenza virus
RDNAKDEG

SEQ ID NO: 285251 - protein, 8 aa, Influenza virus
GNAKDEGN

SEQ ID NO: 285252 - protein, 8 aa, Influenza virus
GCFPFYHK

SEQ ID NO: 285253 - protein, 8 aa, Influenza virus
CFTFYHRC

SEQ ID NO: 285254 - protein, 8 aa, Influenza virus
FTFYHKCN

SEQ ID NO: 285255 - protein, 8 aa, Influenza virus
TFYHKCDD

SEQ ID NO: 285256 - protein, 8 aa, Influenza virus
FYHKCDNK

SEQ ID NO: 285257 - protein, 8 aa, Influenza virus
YHKCDNKC

SEQ ID NO: 285258 - protein, 8 aa, Influenza virus
HKCDNKCI

SEQ ID NO: 285259 - protein, 8 aa, Influenza virus
KCDNKCIE

SEQ ID NO: 285260 - protein, 8 aa, Influenza virus
NECIERVR

SEQ ID NO: 285261 - protein, 8 aa, Influenza virus
ECIERVRN

SEQ ID NO: 285262 - protein, 8 aa, Influenza virus
CIERVRNG

SEQ ID NO: 285263 - protein, 8 aa, Influenza virus
IERVRNGT

SEQ ID NO: 285264 - protein, 8 aa, Influenza virus
ERVRNGTY

SEQ ID NO: 285265 - protein, 8 aa, Influenza virus
RVRNGTYD

SEQ ID NO: 285266 - protein, 8 aa, Influenza virus
IRNGTYDH

SEQ ID NO: 285267 - protein, 8 aa, Influenza virus
TYDHKEFK

SEQ ID NO: 285268 - protein, 8 aa, Influenza virus
YDHKEFEK

SEQ ID NO: 285269 - protein, 8 aa, Influenza virus
DHKEFEKE

SEQ ID NO: 285270 - protein, 8 aa, Influenza virus
HKEFEKES

SEQ ID NO: 285271 - protein, 8 aa, Influenza virus
KEFEEESR

SEQ ID NO: 285272 - protein, 8 aa, Influenza virus
EESKINRQ

SEQ ID NO: 285273 - protein, 8 aa, Influenza virus
ESKINRQE

SEQ ID NO: 285274 - protein, 8 aa, Influenza virus
SKINRQEI

SEQ ID NO: 285275 - protein, 8 aa, Influenza virus
KINRQEIE

SEQ ID NO: 285276 - protein, 8 aa, Influenza virus
INRQEIEG

SEQ ID NO: 285277 - protein, 8 aa, Influenza virus
NRQEIGGV

SEQ ID NO: 285278 - protein, 8 aa, Influenza virus
RQEIEGVR

SEQ ID NO: 285279 - protein, 8 aa, Influenza virus
QEIEGVRL

SEQ ID NO: 285280 - protein, 8 aa, Influenza virus
EIEGVKLN

SEQ ID NO: 285281 - protein, 8 aa, Influenza virus
GNIYKILS

SEQ ID NO: 285282 - protein, 8 aa, Influenza virus
NIYKILSI

SEQ ID NO: 285283 - protein, 8 aa, Influenza virus
IYKILSIY

SEQ ID NO: 285284 - protein, 8 aa, Influenza virus
ILSICSCI

SEQ ID NO: 285285 - protein, 8 aa, Influenza virus
LSIYSCVA

SEQ ID NO: 285286 - protein, 8 aa, Influenza virus
SIYSCVAS

SEQ ID NO: 285287 - protein, 8 aa, Influenza virus
IYSCVASS

SEQ ID NO: 285288 - protein, 8 aa, Influenza virus
CSCIASSL

SEQ ID NO: 285289 - protein, 8 aa, Influenza virus
SCIASSLI

SEQ ID NO: 285290 - protein, 8 aa, Influenza virus
CIASSLIL

SEQ ID NO: 285291 - protein, 8 aa, Influenza virus
IASSLILA

SEQ ID NO: 285292 - protein, 8 aa, Influenza virus
ASSLILAA

SEQ ID NO: 285293 - protein, 8 aa, Influenza virus
SSLVLAAL

SEQ ID NO: 285294 - protein, 8 aa, Influenza virus
SLVLAALI

SEQ ID NO: 285295 - protein, 8 aa, Influenza virus
LVLAALIM

SEQ ID NO: 285296 - protein, 8 aa, Influenza virus
VLAALIMG

SEQ ID NO: 285297 - protein, 8 aa, Influenza virus
LAALIMGF

SEQ ID NO: 285298 - protein, 8 aa, Influenza virus
WTCSNGSC

SEQ ID NO: 285299 - protein, 8 aa, Influenza virus
TCSNGSCR

SEQ ID NO: 285300 - protein, 8 aa, Influenza virus
CNNGSCRC

SEQ ID NO: 285301 - protein, 8 aa, Influenza virus
NNGSCRCT

SEQ ID NO: 285302 - protein, 8 aa, Influenza virus
MEKFIVLS

SEQ ID NO: 285303 - protein, 8 aa, Influenza virus
EKFIVLSI

SEQ ID NO: 285304 - protein, 8 aa, Influenza virus
LAYDKICI

SEQ ID NO: 285305 - protein, 8 aa, Influenza virus
YQTNNSTD

SEQ ID NO: 285306 - protein, 8 aa, Influenza virus
QTNNSTDT

SEQ ID NO: 285307 - protein, 8 aa, Influenza virus
TNNSTDTV

SEQ ID NO: 285308 - protein, 8 aa, Influenza virus
NNSTDTVN

SEQ ID NO: 285309 - protein, 8 aa, Influenza virus
NSTDTVNT

SEQ ID NO: 285310 - protein, 8 aa, Influenza virus
STDTVNTL

SEQ ID NO: 285311 - protein, 8 aa, Influenza virus
TDTVNTLI

SEQ ID NO: 285312 - protein, 8 aa, Influenza virus
DTVNTLIE

SEQ ID NO: 285313 - protein, 8 aa, Influenza virus
TVNTLSEQ

SEQ ID NO: 285314 - protein, 8 aa, Influenza virus
VNTLSEQN

SEQ ID NO: 285315 - protein, 8 aa, Influenza virus
NTLSEQNV

SEQ ID NO: 285316 - protein, 8 aa, Influenza virus
TLSEQNVP

SEQ ID NO: 285317 - protein, 8 aa, Influenza virus
LSEQNVPV

SEQ ID NO: 285318 - protein, 8 aa, Influenza virus
SEQNVPVT

SEQ ID NO: 285319 - protein, 8 aa, Influenza virus
EQNIPVTQ

SEQ ID NO: 285320 - protein, 8 aa, Influenza virus
QNIPVTQV

SEQ ID NO: 285321 - protein, 8 aa, Influenza virus
NIPVTQVE

SEQ ID NO: 285322 - protein, 8 aa, Influenza virus
IPVTQVEE

SEQ ID NO: 285323 - protein, 8 aa, Influenza virus
QVEELVHR

SEQ ID NO: 285324 - protein, 8 aa, Influenza virus
VEELVHGQ

SEQ ID NO: 285325 - protein, 8 aa, Influenza virus
EELVHGQV

SEQ ID NO: 285326 - protein, 8 aa, Influenza virus
ELVHGQVN

SEQ ID NO: 285327 - protein, 8 aa, Influenza virus
LVHGQVNP

SEQ ID NO: 285328 - protein, 8 aa, Influenza virus
TELGAPLV

SEQ ID NO: 285329 - protein, 8 aa, Influenza virus
ELGAPLVL

SEQ ID NO: 285330 - protein, 8 aa, Influenza virus
LGAPLVLD

SEQ ID NO: 285331 - protein, 8 aa, Influenza virus
GAPLVLDD

SEQ ID NO: 285332 - protein, 8 aa, Influenza virus
APLVLDDC

SEQ ID NO: 285333 - protein, 8 aa, Influenza virus
VLDDCSLK

SEQ ID NO: 285334 - protein, 8 aa, Influenza virus
LDDCSLKG

SEQ ID NO: 285335 - protein, 8 aa, Influenza virus
DDCSLEGI

SEQ ID NO: 285336 - protein, 8 aa, Influenza virus
DCSLEGII

SEQ ID NO: 285337 - protein, 8 aa, Influenza virus
CSLEGIIL

SEQ ID NO: 285338 - protein, 8 aa, Influenza virus
SLEGIILG

SEQ ID NO: 285339 - protein, 8 aa, Influenza virus
LEGIILGN

SEQ ID NO: 285340 - protein, 8 aa, Influenza virus
EGIILGNP

SEQ ID NO: 285341 - protein, 8 aa, Influenza virus
GIILGNPK

SEQ ID NO: 285342 - protein, 8 aa, Influenza virus
IILGNPKC

SEQ ID NO: 285343 - protein, 8 aa, Influenza virus
ILSNPKCD

SEQ ID NO: 285344 - protein, 8 aa, Influenza virus
LGNPKCDP

SEQ ID NO: 285345 - protein, 8 aa, Influenza virus
GNPKCDPY

SEQ ID NO: 285346 - protein, 8 aa, Influenza virus
NPKCDPYL

SEQ ID NO: 285347 - protein, 8 aa, Influenza virus
PKCDPYLN

SEQ ID NO: 285348 - protein, 8 aa, Influenza virus
KCDPYLNG

SEQ ID NO: 285349 - protein, 8 aa, Influenza virus
CDPYLNGR

SEQ ID NO: 285350 - protein, 8 aa, Influenza virus
DPYLNGRE

SEQ ID NO: 285351 - protein, 8 aa, Influenza virus
PYLNGREW

SEQ ID NO: 285352 - protein, 8 aa, Influenza virus
YLSGREWS

SEQ ID NO: 285353 - protein, 8 aa, Influenza virus
LSGREWSY

SEQ ID NO: 285354 - protein, 8 aa, Influenza virus
SGREWSYI

SEQ ID NO: 285355 - protein, 8 aa, Influenza virus
WSYIVERT

SEQ ID NO: 285356 - protein, 8 aa, Influenza virus
SYIVERTK

SEQ ID NO: 285357 - protein, 8 aa, Influenza virus
YIVERTKE

SEQ ID NO: 285358 - protein, 8 aa, Influenza virus
IVERTKEM

SEQ ID NO: 285359 - protein, 8 aa, Influenza virus
VERTKEME

SEQ ID NO: 285360 - protein, 8 aa, Influenza virus
ERTKEMEG

SEQ ID NO: 285361 - protein, 8 aa, Influenza virus
RPKEMEGV

SEQ ID NO: 285362 - protein, 8 aa, Influenza virus
PKEMEGVC

SEQ ID NO: 285363 - protein, 8 aa, Influenza virus
KEMEGVCY

SEQ ID NO: 285364 - protein, 8 aa, Influenza virus
EMEGVCYP

SEQ ID NO: 285365 - protein, 8 aa, Influenza virus
MEGVCYPG

SEQ ID NO: 285366 - protein, 8 aa, Influenza virus
EGVCYPGS

SEQ ID NO: 285367 - protein, 8 aa, Influenza virus
GVCYPGSI

SEQ ID NO: 285368 - protein, 8 aa, Influenza virus
VCYPGSIE

SEQ ID NO: 285369 - protein, 8 aa, Influenza virus
CYPGSIKN

SEQ ID NO: 285370 - protein, 8 aa, Influenza virus
YPGSVENQ

SEQ ID NO: 285371 - protein, 8 aa, Influenza virus
PGSVENQE

SEQ ID NO: 285372 - protein, 8 aa, Influenza virus
GSVENQEE

SEQ ID NO: 285373 - protein, 8 aa, Influenza virus
SVENQEEL

SEQ ID NO: 285374 - protein, 8 aa, Influenza virus
IKNQEELR

SEQ ID NO: 285375 - protein, 8 aa, Influenza virus
ENQEELRF

SEQ ID NO: 285376 - protein, 8 aa, Influenza virus
NQEELRFL

SEQ ID NO: 285377 - protein, 8 aa, Influenza virus
QEELRFLF

SEQ ID NO: 285378 - protein, 8 aa, Influenza virus
EELRFLFS

SEQ ID NO: 285379 - protein, 8 aa, Influenza virus
ELRFLFSS

SEQ ID NO: 285380 - protein, 8 aa, Influenza virus
LRFLFSSI

SEQ ID NO: 285381 - protein, 8 aa, Influenza virus
RFLFSSIK

SEQ ID NO: 285382 - protein, 8 aa, Influenza virus
FLFSSIKK

SEQ ID NO: 285383 - protein, 8 aa, Influenza virus
LFSSIKRY

SEQ ID NO: 285384 - protein, 8 aa, Influenza virus
FSSIKRYE

SEQ ID NO: 285385 - protein, 8 aa, Influenza virus
SSIKRYER

SEQ ID NO: 285386 - protein, 8 aa, Influenza virus
SIKRYERV

SEQ ID NO: 285387 - protein, 8 aa, Influenza virus
IKRYERVK

SEQ ID NO: 285388 - protein, 8 aa, Influenza virus
KRYERVKM

SEQ ID NO: 285389 - protein, 8 aa, Influenza virus
RYERVKMF

SEQ ID NO: 285390 - protein, 8 aa, Influenza virus
RVKMFDFS

SEQ ID NO: 285391 - protein, 8 aa, Influenza virus
VKMFDFSK

SEQ ID NO: 285392 - protein, 8 aa, Influenza virus
KMFDFSKW

SEQ ID NO: 285393 - protein, 8 aa, Influenza virus
MFDFSKWN

SEQ ID NO: 285394 - protein, 8 aa, Influenza virus
FDFSKWNV

SEQ ID NO: 285395 - protein, 8 aa, Influenza virus
DFSKWNVT

SEQ ID NO: 285396 - protein, 8 aa, Influenza virus
FSKWNVTY

SEQ ID NO: 285397 - protein, 8 aa, Influenza virus
SKWNVTYT

SEQ ID NO: 285398 - protein, 8 aa, Influenza virus
KWNVTHTG

SEQ ID NO: 285399 - protein, 8 aa, Influenza virus
WNVTYTGI

SEQ ID NO: 285400 - protein, 8 aa, Influenza virus
NVTYTGIS

SEQ ID NO: 285401 - protein, 8 aa, Influenza virus
VTYTGTSR

SEQ ID NO: 285402 - protein, 8 aa, Influenza virus
TYTGTSRA

SEQ ID NO: 285403 - protein, 8 aa, Influenza virus
YTGTSRAC

SEQ ID NO: 285404 - protein, 8 aa, Influenza virus
TGTSRACN

SEQ ID NO: 285405 - protein, 8 aa, Influenza virus
SKACNDTS

SEQ ID NO: 285406 - protein, 8 aa, Influenza virus
KACNDTSN

SEQ ID NO: 285407 - protein, 8 aa, Influenza virus
ACNDTSNQ

SEQ ID NO: 285408 - protein, 8 aa, Influenza virus
ISNQGSFY

SEQ ID NO: 285409 - protein, 8 aa, Influenza virus
SNRGSFYR

SEQ ID NO: 285410 - protein, 8 aa, Influenza virus
NRGSFYRS

SEQ ID NO: 285411 - protein, 8 aa, Influenza virus
QGSFYRSI

SEQ ID NO: 285412 - protein, 8 aa, Influenza virus
GSFYRSIR

SEQ ID NO: 285413 - protein, 8 aa, Influenza virus
SFYRNMRW

SEQ ID NO: 285414 - protein, 8 aa, Influenza virus
FYRSIRWL

SEQ ID NO: 285415 - protein, 8 aa, Influenza virus
YRNMRWLT

SEQ ID NO: 285416 - protein, 8 aa, Influenza virus
RNMRWLTL

SEQ ID NO: 285417 - protein, 8 aa, Influenza virus
NMRWLTLK

SEQ ID NO: 285418 - protein, 8 aa, Influenza virus
IRWLTLKS

SEQ ID NO: 285419 - protein, 8 aa, Influenza virus
RWLTLKSE

SEQ ID NO: 285420 - protein, 8 aa, Influenza virus
WLTLKSEQ

SEQ ID NO: 285421 - protein, 8 aa, Influenza virus
LTLKSEQF

SEQ ID NO: 285422 - protein, 8 aa, Influenza virus
TLKSEQFP

SEQ ID NO: 285423 - protein, 8 aa, Influenza virus
LKSEQFPV

SEQ ID NO: 285424 - protein, 8 aa, Influenza virus
KSEQFPVQ

SEQ ID NO: 285425 - protein, 8 aa, Influenza virus
SEQFPVQT

SEQ ID NO: 285426 - protein, 8 aa, Influenza virus
EQFPVQTD

SEQ ID NO: 285427 - protein, 8 aa, Influenza virus
TDEYKNTG

SEQ ID NO: 285428 - protein, 8 aa, Influenza virus
DEYKNTGD

SEQ ID NO: 285429 - protein, 8 aa, Influenza virus
EYKNTGDS

SEQ ID NO: 285430 - protein, 8 aa, Influenza virus
YKNTRDSN

SEQ ID NO: 285431 - protein, 8 aa, Influenza virus
KNTGDSDI

SEQ ID NO: 285432 - protein, 8 aa, Influenza virus
FMWAIHHP

SEQ ID NO: 285433 - protein, 8 aa, Influenza virus
MWAIHHPP

SEQ ID NO: 285434 - protein, 8 aa, Influenza virus
AIHHPPTT

SEQ ID NO: 285435 - protein, 8 aa, Influenza virus
IHHPPTSN

SEQ ID NO: 285436 - protein, 8 aa, Influenza virus
HHPPTSNE

SEQ ID NO: 285437 - protein, 8 aa, Influenza virus
HPPTSNEQ

SEQ ID NO: 285438 - protein, 8 aa, Influenza virus
PPTSNEQV

SEQ ID NO: 285439 - protein, 8 aa, Influenza virus
EINRSFRP

SEQ ID NO: 285440 - protein, 8 aa, Influenza virus
INRSFRPN

SEQ ID NO: 285441 - protein, 8 aa, Influenza virus
NRSFRPNI

SEQ ID NO: 285442 - protein, 8 aa, Influenza virus
RSFRPNIG

SEQ ID NO: 285443 - protein, 8 aa, Influenza virus
SFRPNIGP

SEQ ID NO: 285444 - protein, 8 aa, Influenza virus
FRPNIGPR

SEQ ID NO: 285445 - protein, 8 aa, Influenza virus
RPNIGPRP

SEQ ID NO: 285446 - protein, 8 aa, Influenza virus
PNIGPRPF

SEQ ID NO: 285447 - protein, 8 aa, Influenza virus
NIGPRPFV

SEQ ID NO: 285448 - protein, 8 aa, Influenza virus
IGPRPFVR

SEQ ID NO: 285449 - protein, 8 aa, Influenza virus
GPRPFVRG

SEQ ID NO: 285450 - protein, 8 aa, Influenza virus
PRPFVRGQ

SEQ ID NO: 285451 - protein, 8 aa, Influenza virus
RPFVRGQQ

SEQ ID NO: 285452 - protein, 8 aa, Influenza virus
PFVRGQQG

SEQ ID NO: 285453 - protein, 8 aa, Influenza virus
FVRGQQGR

SEQ ID NO: 285454 - protein, 8 aa, Influenza virus
VREQQGRM

SEQ ID NO: 285455 - protein, 8 aa, Influenza virus
REQQGRMD

SEQ ID NO: 285456 - protein, 8 aa, Influenza virus
EQQGRMDY

SEQ ID NO: 285457 - protein, 8 aa, Influenza virus
RMDYYWAI

SEQ ID NO: 285458 - protein, 8 aa, Influenza virus
MDYYWAIL

SEQ ID NO: 285459 - protein, 8 aa, Influenza virus
DYYWAILK

SEQ ID NO: 285460 - protein, 8 aa, Influenza virus
YYWAILKP

SEQ ID NO: 285461 - protein, 8 aa, Influenza virus
YWAILKPG

SEQ ID NO: 285462 - protein, 8 aa, Influenza virus
WAILKPGQ

SEQ ID NO: 285463 - protein, 8 aa, Influenza virus
AILKPGQT

SEQ ID NO: 285464 - protein, 8 aa, Influenza virus
ILKPGQTV

SEQ ID NO: 285465 - protein, 8 aa, Influenza virus
PGQTVKIK

SEQ ID NO: 285466 - protein, 8 aa, Influenza virus
GQTVKIKT

SEQ ID NO: 285467 - protein, 8 aa, Influenza virus
QTVKIQTS

SEQ ID NO: 285468 - protein, 8 aa, Influenza virus
TVKIKTNG

SEQ ID NO: 285469 - protein, 8 aa, Influenza virus
VKIKTNGN

SEQ ID NO: 285470 - protein, 8 aa, Influenza virus
KIKTNGNL

SEQ ID NO: 285471 - protein, 8 aa, Influenza virus
IKTNGNLI

SEQ ID NO: 285472 - protein, 8 aa, Influenza virus
QTSGNLIA

SEQ ID NO: 285473 - protein, 8 aa, Influenza virus
TSGNLIAP

SEQ ID NO: 285474 - protein, 8 aa, Influenza virus
SGNLIAPE

SEQ ID NO: 285475 - protein, 8 aa, Influenza virus
LIAPEYGY

SEQ ID NO: 285476 - protein, 8 aa, Influenza virus
IAPEYGYL

SEQ ID NO: 285477 - protein, 8 aa, Influenza virus
APEYGHLV

SEQ ID NO: 285478 - protein, 8 aa, Influenza virus
PEYGHLVT

SEQ ID NO: 285479 - protein, 8 aa, Influenza virus
EYGHLVTG

SEQ ID NO: 285480 - protein, 8 aa, Influenza virus
YGHLVTGK

SEQ ID NO: 285481 - protein, 8 aa, Influenza virus
GHLVTGKS

SEQ ID NO: 285482 - protein, 8 aa, Influenza virus
HLVTGKSH

SEQ ID NO: 285483 - protein, 8 aa, Influenza virus
LVTGKSHG

SEQ ID NO: 285484 - protein, 8 aa, Influenza virus
VTGKSHGR

SEQ ID NO: 285485 - protein, 8 aa, Influenza virus
TGKSHGRV

SEQ ID NO: 285486 - protein, 8 aa, Influenza virus
GKSHGRVL

SEQ ID NO: 285487 - protein, 8 aa, Influenza virus
KSHGRVLK

SEQ ID NO: 285488 - protein, 8 aa, Influenza virus
SHGRVLKN

SEQ ID NO: 285489 - protein, 8 aa, Influenza virus
HGRILKND

SEQ ID NO: 285490 - protein, 8 aa, Influenza virus
GRILKNDL

SEQ ID NO: 285491 - protein, 8 aa, Influenza virus
RILKNDLP

SEQ ID NO: 285492 - protein, 8 aa, Influenza virus
LKNNLPVG

SEQ ID NO: 285493 - protein, 8 aa, Influenza virus
TGCQLNEG

SEQ ID NO: 285494 - protein, 8 aa, Influenza virus
KCQLNEGV

SEQ ID NO: 285495 - protein, 8 aa, Influenza virus
CQLNEGIM

SEQ ID NO: 285496 - protein, 8 aa, Influenza virus
QLNEGVIN

SEQ ID NO: 285497 - protein, 8 aa, Influenza virus
LNEGVINT

SEQ ID NO: 285498 - protein, 8 aa, Influenza virus
NEGVINTS

SEQ ID NO: 285499 - protein, 8 aa, Influenza virus
EGIMNTSK

SEQ ID NO: 285500 - protein, 8 aa, Influenza virus
GVINTSKP

SEQ ID NO: 285501 - protein, 8 aa, Influenza virus
IMNTSKPF

SEQ ID NO: 285502 - protein, 8 aa, Influenza virus
INTSKPFQ

SEQ ID NO: 285503 - protein, 8 aa, Influenza virus
NTSKPLQN

SEQ ID NO: 285504 - protein, 8 aa, Influenza virus
TSKPFQNI

SEQ ID NO: 285505 - protein, 8 aa, Influenza virus
SKPFQNIC

SEQ ID NO: 285506 - protein, 8 aa, Influenza virus
KPFQNICK

SEQ ID NO: 285507 - protein, 8 aa, Influenza virus
PLQNTSKH

SEQ ID NO: 285508 - protein, 8 aa, Influenza virus
FQNICKPY

SEQ ID NO: 285509 - protein, 8 aa, Influenza virus
QNICKPYI

SEQ ID NO: 285510 - protein, 8 aa, Influenza virus
NTSRHYIG

SEQ ID NO: 285511 - protein, 8 aa, Influenza virus
ICKPYIGK

SEQ ID NO: 285512 - protein, 8 aa, Influenza virus
SRHYIGKC

SEQ ID NO: 285513 - protein, 8 aa, Influenza virus
KPYIGKCP

SEQ ID NO: 285514 - protein, 8 aa, Influenza virus
HYIGKCPR

SEQ ID NO: 285515 - protein, 8 aa, Influenza virus
YIGKCPRY

SEQ ID NO: 285516 - protein, 8 aa, Influenza virus
IGKCPRYI

SEQ ID NO: 285517 - protein, 8 aa, Influenza virus
GKCPRYIP

SEQ ID NO: 285518 - protein, 8 aa, Influenza virus
KCPRYIPS

SEQ ID NO: 285519 - protein, 8 aa, Influenza virus
CPKYIPSN

SEQ ID NO: 285520 - protein, 8 aa, Influenza virus
PKYIPSNS

SEQ ID NO: 285521 - protein, 8 aa, Influenza virus
KYIPSNSL

SEQ ID NO: 285522 - protein, 8 aa, Influenza virus
YIPSNSLK

SEQ ID NO: 285523 - protein, 8 aa, Influenza virus
IPSNSLKL

SEQ ID NO: 285524 - protein, 8 aa, Influenza virus
PSNSLKLA

SEQ ID NO: 285525 - protein, 8 aa, Influenza virus
SNSLKLAI

SEQ ID NO: 285526 - protein, 8 aa, Influenza virus
NSLKLAIG

SEQ ID NO: 285527 - protein, 8 aa, Influenza virus
SLKLAIGP

SEQ ID NO: 285528 - protein, 8 aa, Influenza virus
LKLAIGPR

SEQ ID NO: 285529 - protein, 8 aa, Influenza virus
KLAIGPRN

SEQ ID NO: 285530 - protein, 8 aa, Influenza virus
LAIGPRNV

SEQ ID NO: 285531 - protein, 8 aa, Influenza virus
AIGPRNVP

SEQ ID NO: 285532 - protein, 8 aa, Influenza virus
IGPRNVPQ

SEQ ID NO: 285533 - protein, 8 aa, Influenza virus
GLRNVPQV

SEQ ID NO: 285534 - protein, 8 aa, Influenza virus
LRNVPQVQ

SEQ ID NO: 285535 - protein, 8 aa, Influenza virus
RNVPQVQN

SEQ ID NO: 285536 - protein, 8 aa, Influenza virus
NVPQVQNR

SEQ ID NO: 285537 - protein, 8 aa, Influenza virus
VPQVQNRG

SEQ ID NO: 285538 - protein, 8 aa, Influenza virus
PQVQNRGL

SEQ ID NO: 285539 - protein, 8 aa, Influenza virus
QVQNRGLF

SEQ ID NO: 285540 - protein, 8 aa, Influenza virus
VQNRGLFG

SEQ ID NO: 285541 - protein, 8 aa, Influenza virus
QDRGLFGA

SEQ ID NO: 285542 - protein, 8 aa, Influenza virus
DRGLFGAI

SEQ ID NO: 285543 - protein, 8 aa, Influenza virus
RGLFGAKA

SEQ ID NO: 285544 - protein, 8 aa, Influenza virus
GLFGAKAG

SEQ ID NO: 285545 - protein, 8 aa, Influenza virus
LFGAKAGF

SEQ ID NO: 285546 - protein, 8 aa, Influenza virus
FGAKAGFI

SEQ ID NO: 285547 - protein, 8 aa, Influenza virus
GAKAGFIE

SEQ ID NO: 285548 - protein, 8 aa, Influenza virus
AKAGFIEG

SEQ ID NO: 285549 - protein, 8 aa, Influenza virus
KAGFIEGG

SEQ ID NO: 285550 - protein, 8 aa, Influenza virus
AGFIEGRW

SEQ ID NO: 285551 - protein, 8 aa, Influenza virus
GFIEGRWP

SEQ ID NO: 285552 - protein, 8 aa, Influenza virus
FIEGRWPG

SEQ ID NO: 285553 - protein, 8 aa, Influenza virus
IEGRWPGL

SEQ ID NO: 285554 - protein, 8 aa, Influenza virus
EGRWPGLV

SEQ ID NO: 285555 - protein, 8 aa, Influenza virus
GRWPGLVA

SEQ ID NO: 285556 - protein, 8 aa, Influenza virus
RWPGLVAG

SEQ ID NO: 285557 - protein, 8 aa, Influenza virus
YGFQHQNS

SEQ ID NO: 285558 - protein, 8 aa, Influenza virus
GFQHQNSE

SEQ ID NO: 285559 - protein, 8 aa, Influenza virus
FQHQNSEG

SEQ ID NO: 285560 - protein, 8 aa, Influenza virus
QHQNSEGT

SEQ ID NO: 285561 - protein, 8 aa, Influenza virus
HQNSEGTG

SEQ ID NO: 285562 - protein, 8 aa, Influenza virus
QNAEGTGM

SEQ ID NO: 285563 - protein, 8 aa, Influenza virus
NAEGTGMA

SEQ ID NO: 285564 - protein, 8 aa, Influenza virus
AEGTGMAA

SEQ ID NO: 285565 - protein, 8 aa, Influenza virus
EGTGMAAD

SEQ ID NO: 285566 - protein, 8 aa, Influenza virus
GTGMAADR

SEQ ID NO: 285567 - protein, 8 aa, Influenza virus
TGMAADRD

SEQ ID NO: 285568 - protein, 8 aa, Influenza virus
GMAADRDS

SEQ ID NO: 285569 - protein, 8 aa, Influenza virus
MAADRDST

SEQ ID NO: 285570 - protein, 8 aa, Influenza virus
AADRGSTQ

SEQ ID NO: 285571 - protein, 8 aa, Influenza virus
ADRDSTQR

SEQ ID NO: 285572 - protein, 8 aa, Influenza virus
DRDSTQRA

SEQ ID NO: 285573 - protein, 8 aa, Influenza virus
RDSTQRAI

SEQ ID NO: 285574 - protein, 8 aa, Influenza virus
DSTQRAID

SEQ ID NO: 285575 - protein, 8 aa, Influenza virus
STQRAIDN

SEQ ID NO: 285576 - protein, 8 aa, Influenza virus
TQRAIDNM

SEQ ID NO: 285577 - protein, 8 aa, Influenza virus
QRAIDNMQ

SEQ ID NO: 285578 - protein, 8 aa, Influenza virus
RAIDNMQN

SEQ ID NO: 285579 - protein, 8 aa, Influenza virus
AIDNMQNR

SEQ ID NO: 285580 - protein, 8 aa, Influenza virus
IDIMQNKL

SEQ ID NO: 285581 - protein, 8 aa, Influenza virus
DIMQNKLN

SEQ ID NO: 285582 - protein, 8 aa, Influenza virus
IMQNKLNN

SEQ ID NO: 285583 - protein, 8 aa, Influenza virus
MQNRLNNV

SEQ ID NO: 285584 - protein, 8 aa, Influenza virus
QNRLNNVI

SEQ ID NO: 285585 - protein, 8 aa, Influenza virus
NRLNNVID

SEQ ID NO: 285586 - protein, 8 aa, Influenza virus
RLNNVIDK

SEQ ID NO: 285587 - protein, 8 aa, Influenza virus
NNVIDKMY

SEQ ID NO: 285588 - protein, 8 aa, Influenza virus
NVIDKMNN

SEQ ID NO: 285589 - protein, 8 aa, Influenza virus
VIDKMNNQ

SEQ ID NO: 285590 - protein, 8 aa, Influenza virus
IDKMNKQL

SEQ ID NO: 285591 - protein, 8 aa, Influenza virus
EFSKVETR

SEQ ID NO: 285592 - protein, 8 aa, Influenza virus
FSKVETRI

SEQ ID NO: 285593 - protein, 8 aa, Influenza virus
SKVETRIN

SEQ ID NO: 285594 - protein, 8 aa, Influenza virus
VETRINMI

SEQ ID NO: 285595 - protein, 8 aa, Influenza virus
ETRINMIN

SEQ ID NO: 285596 - protein, 8 aa, Influenza virus
TRINMINS

SEQ ID NO: 285597 - protein, 8 aa, Influenza virus
RINMINSQ

SEQ ID NO: 285598 - protein, 8 aa, Influenza virus
INMINSQI

SEQ ID NO: 285599 - protein, 8 aa, Influenza virus
NTINSKID

SEQ ID NO: 285600 - protein, 8 aa, Influenza virus
TINSKIDD

SEQ ID NO: 285601 - protein, 8 aa, Influenza virus
INSQIDDQ

SEQ ID NO: 285602 - protein, 8 aa, Influenza virus
NSKIDDQV

SEQ ID NO: 285603 - protein, 8 aa, Influenza virus
IDDQVTDI

SEQ ID NO: 285604 - protein, 8 aa, Influenza virus
DDQVTDIW

SEQ ID NO: 285605 - protein, 8 aa, Influenza virus
DQVTDIWA

SEQ ID NO: 285606 - protein, 8 aa, Influenza virus
QVTDIWAY

SEQ ID NO: 285607 - protein, 8 aa, Influenza virus
VTDIWAYN

SEQ ID NO: 285608 - protein, 8 aa, Influenza virus
IDIWAYNA

SEQ ID NO: 285609 - protein, 8 aa, Influenza virus
WAYNAELI

SEQ ID NO: 285610 - protein, 8 aa, Influenza virus
AYNAELIV

SEQ ID NO: 285611 - protein, 8 aa, Influenza virus
YNAELIVL

SEQ ID NO: 285612 - protein, 8 aa, Influenza virus
NAELIVLL

SEQ ID NO: 285613 - protein, 8 aa, Influenza virus
AELIVLLE

SEQ ID NO: 285614 - protein, 8 aa, Influenza virus
ELIVLLEN

SEQ ID NO: 285615 - protein, 8 aa, Influenza virus
LIVLLENQ

SEQ ID NO: 285616 - protein, 8 aa, Influenza virus
IVLLENQK

SEQ ID NO: 285617 - protein, 8 aa, Influenza virus
ANVRNLHE

SEQ ID NO: 285618 - protein, 8 aa, Influenza virus
NVRNLHER

SEQ ID NO: 285619 - protein, 8 aa, Influenza virus
VRNLHDRI

SEQ ID NO: 285620 - protein, 8 aa, Influenza virus
RNLHDRIR

SEQ ID NO: 285621 - protein, 8 aa, Influenza virus
NLHDRIRR

SEQ ID NO: 285622 - protein, 8 aa, Influenza virus
KRILKENA

SEQ ID NO: 285623 - protein, 8 aa, Influenza virus
RILKENAI

SEQ ID NO: 285624 - protein, 8 aa, Influenza virus
ILKENAID

SEQ ID NO: 285625 - protein, 8 aa, Influenza virus
ENALDTGD

SEQ ID NO: 285626 - protein, 8 aa, Influenza virus
NAVDTGDG

SEQ ID NO: 285627 - protein, 8 aa, Influenza virus
ALDTGDGC

SEQ ID NO: 285628 - protein, 8 aa, Influenza virus
IDAGDGCF

SEQ ID NO: 285629 - protein, 8 aa, Influenza virus
DAGDGCFE

SEQ ID NO: 285630 - protein, 8 aa, Influenza virus
AGDGCFEI

SEQ ID NO: 285631 - protein, 8 aa, Influenza virus
GCFEILHR

SEQ ID NO: 285632 - protein, 8 aa, Influenza virus
CFEILHRC

SEQ ID NO: 285633 - protein, 8 aa, Influenza virus
FEILHRCD

SEQ ID NO: 285634 - protein, 8 aa, Influenza virus
EILHKCDD

SEQ ID NO: 285635 - protein, 8 aa, Influenza virus
TIKNGTYN

SEQ ID NO: 285636 - protein, 8 aa, Influenza virus
IKNGTYNH

SEQ ID NO: 285637 - protein, 8 aa, Influenza virus
RNGTYNHR

SEQ ID NO: 285638 - protein, 8 aa, Influenza virus
GTYNHREY

SEQ ID NO: 285639 - protein, 8 aa, Influenza virus
TYNHREYE

SEQ ID NO: 285640 - protein, 8 aa, Influenza virus
YEEESKLE

SEQ ID NO: 285641 - protein, 8 aa, Influenza virus
EEESKLER

SEQ ID NO: 285642 - protein, 8 aa, Influenza virus
EESKLERQ

SEQ ID NO: 285643 - protein, 8 aa, Influenza virus
ESKLERQK

SEQ ID NO: 285644 - protein, 8 aa, Influenza virus
SKLERQKI

SEQ ID NO: 285645 - protein, 8 aa, Influenza virus
ERQRINGV

SEQ ID NO: 285646 - protein, 8 aa, Influenza virus
RQRINGVK

SEQ ID NO: 285647 - protein, 8 aa, Influenza virus
QKVNGVKL

SEQ ID NO: 285648 - protein, 8 aa, Influenza virus
RINGVKLE

SEQ ID NO: 285649 - protein, 8 aa, Influenza virus
VNGVKLEE

SEQ ID NO: 285650 - protein, 8 aa, Influenza virus
SGVKLEEN

SEQ ID NO: 285651 - protein, 8 aa, Influenza virus
ASSLVLLF

SEQ ID NO: 285652 - protein, 8 aa, Influenza virus
SSLVLLFM

SEQ ID NO: 285653 - protein, 8 aa, Influenza virus
SLVLLFMI

SEQ ID NO: 285654 - protein, 8 aa, Influenza virus
LVLLFMII

SEQ ID NO: 285655 - protein, 8 aa, Influenza virus
VLLFMIIG

SEQ ID NO: 285656 - protein, 8 aa, Influenza virus
LLFMIIGG

SEQ ID NO: 285657 - protein, 8 aa, Influenza virus
LFMIIGGF

SEQ ID NO: 285658 - protein, 8 aa, Influenza virus
FMIIGGFI

SEQ ID NO: 285659 - protein, 8 aa, Influenza virus
FGCQNGNI

SEQ ID NO: 285660 - protein, 8 aa, Influenza virus
GCQNGNIR

SEQ ID NO: 285661 - protein, 8 aa, Influenza virus
CQNGNIRC

SEQ ID NO: 285662 - protein, 8 aa, Influenza virus
QNGNIRCT

SEQ ID NO: 285663 - protein, 8 aa, Influenza virus
NGNIRCTF

SEQ ID NO: 285664 - protein, 8 aa, Influenza virus
GNIRCTFC

SEQ ID NO: 285665 - protein, 8 aa, Influenza virus
NIRCTFCI

SEQ ID NO: 285666 - protein, 8 aa, Influenza virus
ADRICIGY

SEQ ID NO: 285667 - protein, 8 aa, Influenza virus
DKICVGYL

SEQ ID NO: 285668 - protein, 8 aa, Influenza virus
KICVGYLS

SEQ ID NO: 285669 - protein, 8 aa, Influenza virus
ICIGYLST

SEQ ID NO: 285670 - protein, 8 aa, Influenza virus
CIGYLSTN

SEQ ID NO: 285671 - protein, 8 aa, Influenza virus
IGYLSTNS

SEQ ID NO: 285672 - protein, 8 aa, Influenza virus
GYLSTNST

SEQ ID NO: 285673 - protein, 8 aa, Influenza virus
YLSTNSTE

SEQ ID NO: 285674 - protein, 8 aa, Influenza virus
LSTNSSEK

SEQ ID NO: 285675 - protein, 8 aa, Influenza virus
STNSSEKV

SEQ ID NO: 285676 - protein, 8 aa, Influenza virus
TNSSEKVD

SEQ ID NO: 285677 - protein, 8 aa, Influenza virus
NSSEKVDT

SEQ ID NO: 285678 - protein, 8 aa, Influenza virus
SSEKVDTL

SEQ ID NO: 285679 - protein, 8 aa, Influenza virus
SEKVDTLL

SEQ ID NO: 285680 - protein, 8 aa, Influenza virus
ERVDTLLE

SEQ ID NO: 285681 - protein, 8 aa, Influenza virus
RVDTLLEN

SEQ ID NO: 285682 - protein, 8 aa, Influenza virus
VDTLLEND

SEQ ID NO: 285683 - protein, 8 aa, Influenza virus
DTLLENDV

SEQ ID NO: 285684 - protein, 8 aa, Influenza virus
TLLENDVP

SEQ ID NO: 285685 - protein, 8 aa, Influenza virus
LLENDVPV

SEQ ID NO: 285686 - protein, 8 aa, Influenza virus
LENDVPVT

SEQ ID NO: 285687 - protein, 8 aa, Influenza virus
ENDVPVTS

SEQ ID NO: 285688 - protein, 8 aa, Influenza virus
NDVPVTSS

SEQ ID NO: 285689 - protein, 8 aa, Influenza virus
VPVTSSID

SEQ ID NO: 285690 - protein, 8 aa, Influenza virus
PVTSSIDL

SEQ ID NO: 285691 - protein, 8 aa, Influenza virus
VTSSVDLI

SEQ ID NO: 285692 - protein, 8 aa, Influenza virus
TSSVDLIE

SEQ ID NO: 285693 - protein, 8 aa, Influenza virus
SSVDLIET

SEQ ID NO: 285694 - protein, 8 aa, Influenza virus
DLIETNHT

SEQ ID NO: 285695 - protein, 8 aa, Influenza virus
LIETNHTG

SEQ ID NO: 285696 - protein, 8 aa, Influenza virus
IETNHTGT

SEQ ID NO: 285697 - protein, 8 aa, Influenza virus
ETSHTGTY

SEQ ID NO: 285698 - protein, 8 aa, Influenza virus
TSHTGTYC

SEQ ID NO: 285699 - protein, 8 aa, Influenza virus
SHTGTYCS

SEQ ID NO: 285700 - protein, 8 aa, Influenza virus
TGTYCSLD

SEQ ID NO: 285701 - protein, 8 aa, Influenza virus
GTYCSLDG

SEQ ID NO: 285702 - protein, 8 aa, Influenza virus
GVSPVHLG

SEQ ID NO: 285703 - protein, 8 aa, Influenza virus
VSPVHLGD

SEQ ID NO: 285704 - protein, 8 aa, Influenza virus
PVHLGDCR

SEQ ID NO: 285705 - protein, 8 aa, Influenza virus
VHLGDCRF

SEQ ID NO: 285706 - protein, 8 aa, Influenza virus
HLGDCRFE

SEQ ID NO: 285707 - protein, 8 aa, Influenza virus
LGDCRFEG

SEQ ID NO: 285708 - protein, 8 aa, Influenza virus
GDCRFEGW

SEQ ID NO: 285709 - protein, 8 aa, Influenza virus
DCRFEGWI

SEQ ID NO: 285710 - protein, 8 aa, Influenza virus
CRFEGWIV

SEQ ID NO: 285711 - protein, 8 aa, Influenza virus
RFEGWIVG

SEQ ID NO: 285712 - protein, 8 aa, Influenza virus
FEGWIGGN

SEQ ID NO: 285713 - protein, 8 aa, Influenza virus
EGWIGGNP

SEQ ID NO: 285714 - protein, 8 aa, Influenza virus
GWIVGNPS

SEQ ID NO: 285715 - protein, 8 aa, Influenza virus
WIVGNPSC

SEQ ID NO: 285716 - protein, 8 aa, Influenza virus
GTREWSYL

SEQ ID NO: 285717 - protein, 8 aa, Influenza virus
VREWSYLI

SEQ ID NO: 285718 - protein, 8 aa, Influenza virus
SYLIEDPG

SEQ ID NO: 285719 - protein, 8 aa, Influenza virus
YLIEDPGA

SEQ ID NO: 285720 - protein, 8 aa, Influenza virus
LIEDPGAP

SEQ ID NO: 285721 - protein, 8 aa, Influenza virus
IEDPGAPH

SEQ ID NO: 285722 - protein, 8 aa, Influenza virus
EDPGAPHG

SEQ ID NO: 285723 - protein, 8 aa, Influenza virus
DPGAPHGL

SEQ ID NO: 285724 - protein, 8 aa, Influenza virus
PGAPHGLC

SEQ ID NO: 285725 - protein, 8 aa, Influenza virus
GAPHGLCY

SEQ ID NO: 285726 - protein, 8 aa, Influenza virus
APHRLCYP

SEQ ID NO: 285727 - protein, 8 aa, Influenza virus
PHRLCYPG

SEQ ID NO: 285728 - protein, 8 aa, Influenza virus
HRLCYPGE

SEQ ID NO: 285729 - protein, 8 aa, Influenza virus
RLCYPGEL

SEQ ID NO: 285730 - protein, 8 aa, Influenza virus
LCYPGELN

SEQ ID NO: 285731 - protein, 8 aa, Influenza virus
CYPGELNN

SEQ ID NO: 285732 - protein, 8 aa, Influenza virus
YPGELNNN

SEQ ID NO: 285733 - protein, 8 aa, Influenza virus
PGELNNNG

SEQ ID NO: 285734 - protein, 8 aa, Influenza virus
GELNNNGE

SEQ ID NO: 285735 - protein, 8 aa, Influenza virus
ELNNNGEL

SEQ ID NO: 285736 - protein, 8 aa, Influenza virus
LNNNGELR

SEQ ID NO: 285737 - protein, 8 aa, Influenza virus
NNNGELRH

SEQ ID NO: 285738 - protein, 8 aa, Influenza virus
RHLFSGIK

SEQ ID NO: 285739 - protein, 8 aa, Influenza virus
HLFSGIKS

SEQ ID NO: 285740 - protein, 8 aa, Influenza virus
LFSGIKSF

SEQ ID NO: 285741 - protein, 8 aa, Influenza virus
FSGIKSFS

SEQ ID NO: 285742 - protein, 8 aa, Influenza virus
SGIKSFSR

SEQ ID NO: 285743 - protein, 8 aa, Influenza virus
GIKSFSRT

SEQ ID NO: 285744 - protein, 8 aa, Influenza virus
IKSFSRTE

SEQ ID NO: 285745 - protein, 8 aa, Influenza virus
KSFSRTEL

SEQ ID NO: 285746 - protein, 8 aa, Influenza virus
SFSRTQLI

SEQ ID NO: 285747 - protein, 8 aa, Influenza virus
FSRTELIP

SEQ ID NO: 285748 - protein, 8 aa, Influenza virus
SRTELIPP

SEQ ID NO: 285749 - protein, 8 aa, Influenza virus
LIPPTSWG

SEQ ID NO: 285750 - protein, 8 aa, Influenza virus
SWGAVNDG

SEQ ID NO: 285751 - protein, 8 aa, Influenza virus
TGTSSFYR

SEQ ID NO: 285752 - protein, 8 aa, Influenza virus
SFYRNLIW

SEQ ID NO: 285753 - protein, 8 aa, Influenza virus
FYRNLIWF

SEQ ID NO: 285754 - protein, 8 aa, Influenza virus
YRNLIWFV

SEQ ID NO: 285755 - protein, 8 aa, Influenza virus
GTYNNTTG

SEQ ID NO: 285756 - protein, 8 aa, Influenza virus
AYNNTTGR

SEQ ID NO: 285757 - protein, 8 aa, Influenza virus
TGRDVLVM

SEQ ID NO: 285758 - protein, 8 aa, Influenza virus
GRDVLVMW

SEQ ID NO: 285759 - protein, 8 aa, Influenza virus
RDVLVMWG

SEQ ID NO: 285760 - protein, 8 aa, Influenza virus
DVLVMWGI

SEQ ID NO: 285761 - protein, 8 aa, Influenza virus
VLVMWGIH

SEQ ID NO: 285762 - protein, 8 aa, Influenza virus
LVMWGIHH

SEQ ID NO: 285763 - protein, 8 aa, Influenza virus
VMWGIHHP

SEQ ID NO: 285764 - protein, 8 aa, Influenza virus
WGIHHPLS

SEQ ID NO: 285765 - protein, 8 aa, Influenza virus
NPYTLVST

SEQ ID NO: 285766 - protein, 8 aa, Influenza virus
PYTLVSTK

SEQ ID NO: 285767 - protein, 8 aa, Influenza virus
YTLVSTKS

SEQ ID NO: 285768 - protein, 8 aa, Influenza virus
TLVSTKSW

SEQ ID NO: 285769 - protein, 8 aa, Influenza virus
LVSTKSWS

SEQ ID NO: 285770 - protein, 8 aa, Influenza virus
GIRPGYNG

SEQ ID NO: 285771 - protein, 8 aa, Influenza virus
IRPGYNGQ

SEQ ID NO: 285772 - protein, 8 aa, Influenza virus
RPGYNGQR

SEQ ID NO: 285773 - protein, 8 aa, Influenza virus
PGYNGQKS

SEQ ID NO: 285774 - protein, 8 aa, Influenza virus
GYNGQRSW

SEQ ID NO: 285775 - protein, 8 aa, Influenza virus
YNGQKSWM

SEQ ID NO: 285776 - protein, 8 aa, Influenza virus
NGQKSWMK

SEQ ID NO: 285777 - protein, 8 aa, Influenza virus
GQKSWMKI

SEQ ID NO: 285778 - protein, 8 aa, Influenza virus
QKSWMKIY

SEQ ID NO: 285779 - protein, 8 aa, Influenza virus
KSWMKIYW

SEQ ID NO: 285780 - protein, 8 aa, Influenza virus
SWMKIYWY

SEQ ID NO: 285781 - protein, 8 aa, Influenza virus
WMKIYWYL

SEQ ID NO: 285782 - protein, 8 aa, Influenza virus
ISFESNGG

SEQ ID NO: 285783 - protein, 8 aa, Influenza virus
TFESNGGL

SEQ ID NO: 285784 - protein, 8 aa, Influenza virus
FESNGGFL

SEQ ID NO: 285785 - protein, 8 aa, Influenza virus
ESNGGFLA

SEQ ID NO: 285786 - protein, 8 aa, Influenza virus
SNGGFLAP

SEQ ID NO: 285787 - protein, 8 aa, Influenza virus
NGGLLAPK

SEQ ID NO: 285788 - protein, 8 aa, Influenza virus
GGLLAPKY

SEQ ID NO: 285789 - protein, 8 aa, Influenza virus
GLLAPKYG

SEQ ID NO: 285790 - protein, 8 aa, Influenza virus
LLAPKYGY

SEQ ID NO: 285791 - protein, 8 aa, Influenza virus
LAPKYGYI

SEQ ID NO: 285792 - protein, 8 aa, Influenza virus
APKYGYII

SEQ ID NO: 285793 - protein, 8 aa, Influenza virus
PKYGYIIE

SEQ ID NO: 285794 - protein, 8 aa, Influenza virus
KYGYIIEE

SEQ ID NO: 285795 - protein, 8 aa, Influenza virus
YIIEEYGR

SEQ ID NO: 285796 - protein, 8 aa, Influenza virus
IIEEYGRG

SEQ ID NO: 285797 - protein, 8 aa, Influenza virus
IEEYGRGR

SEQ ID NO: 285798 - protein, 8 aa, Influenza virus
EEYGRGRI

SEQ ID NO: 285799 - protein, 8 aa, Influenza virus
EYGRGRIF

SEQ ID NO: 285800 - protein, 8 aa, Influenza virus
YGRGRIFQ

SEQ ID NO: 285801 - protein, 8 aa, Influenza virus
GRGRIFQS

SEQ ID NO: 285802 - protein, 8 aa, Influenza virus
KGRIFQSP

SEQ ID NO: 285803 - protein, 8 aa, Influenza virus
GRIFQSPI

SEQ ID NO: 285804 - protein, 8 aa, Influenza virus
RIFQSPIR

SEQ ID NO: 285805 - protein, 8 aa, Influenza virus
RCNTKCQT

SEQ ID NO: 285806 - protein, 8 aa, Influenza virus
CNTRCQTS

SEQ ID NO: 285807 - protein, 8 aa, Influenza virus
NTRCQTSV

SEQ ID NO: 285808 - protein, 8 aa, Influenza virus
TRCQTSVG

SEQ ID NO: 285809 - protein, 8 aa, Influenza virus
RCQTSVGG

SEQ ID NO: 285810 - protein, 8 aa, Influenza virus
QTSVGGID

SEQ ID NO: 285811 - protein, 8 aa, Influenza virus
TSVGGIDT

SEQ ID NO: 285812 - protein, 8 aa, Influenza virus
SVGGIDTN

SEQ ID NO: 285813 - protein, 8 aa, Influenza virus
VGGINTNR

SEQ ID NO: 285814 - protein, 8 aa, Influenza virus
GGINTNRT

SEQ ID NO: 285815 - protein, 8 aa, Influenza virus
GINTNRTF

SEQ ID NO: 285816 - protein, 8 aa, Influenza virus
INTNRTFQ

SEQ ID NO: 285817 - protein, 8 aa, Influenza virus
NTNRTFQN

SEQ ID NO: 285818 - protein, 8 aa, Influenza virus
TNRTFQNI

SEQ ID NO: 285819 - protein, 8 aa, Influenza virus
NRTFQNID

SEQ ID NO: 285820 - protein, 8 aa, Influenza virus
RTFQNIDK

SEQ ID NO: 285821 - protein, 8 aa, Influenza virus
TFQNIDKN

SEQ ID NO: 285822 - protein, 8 aa, Influenza virus
FQNIDKNA

SEQ ID NO: 285823 - protein, 8 aa, Influenza virus
QNIDKNAL

SEQ ID NO: 285824 - protein, 8 aa, Influenza virus
NIDKNALG

SEQ ID NO: 285825 - protein, 8 aa, Influenza virus
IDKNALGD

SEQ ID NO: 285826 - protein, 8 aa, Influenza virus
DKNALGDC

SEQ ID NO: 285827 - protein, 8 aa, Influenza virus
KNALGDCP

SEQ ID NO: 285828 - protein, 8 aa, Influenza virus
NALGNCPK

SEQ ID NO: 285829 - protein, 8 aa, Influenza virus
ALGNCPKY

SEQ ID NO: 285830 - protein, 8 aa, Influenza virus
LGNCPKYI

SEQ ID NO: 285831 - protein, 8 aa, Influenza virus
GNCPKYIK

SEQ ID NO: 285832 - protein, 8 aa, Influenza virus
NCPKYIKS

SEQ ID NO: 285833 - protein, 8 aa, Influenza virus
CPKYIKSD

SEQ ID NO: 285834 - protein, 8 aa, Influenza virus
PKYIKSDQ

SEQ ID NO: 285835 - protein, 8 aa, Influenza virus
KYIKSDQL

SEQ ID NO: 285836 - protein, 8 aa, Influenza virus
YIKSDQLK

SEQ ID NO: 285837 - protein, 8 aa, Influenza virus
IKSDQLKL

SEQ ID NO: 285838 - protein, 8 aa, Influenza virus
KSDQLKLA

SEQ ID NO: 285839 - protein, 8 aa, Influenza virus
SDQLKLAT

SEQ ID NO: 285840 - protein, 8 aa, Influenza virus
DQLKLATG

SEQ ID NO: 285841 - protein, 8 aa, Influenza virus
LKLATGLK

SEQ ID NO: 285842 - protein, 8 aa, Influenza virus
KLATGLKN

SEQ ID NO: 285843 - protein, 8 aa, Influenza virus
LATGLRNI

SEQ ID NO: 285844 - protein, 8 aa, Influenza virus
ATGLRNIP

SEQ ID NO: 285845 - protein, 8 aa, Influenza virus
TGLRNVPT

SEQ ID NO: 285846 - protein, 8 aa, Influenza virus
RGLLGAIA

SEQ ID NO: 285847 - protein, 8 aa, Influenza virus
GFFGAIAG

SEQ ID NO: 285848 - protein, 8 aa, Influenza virus
LLGAIAGF

SEQ ID NO: 285849 - protein, 8 aa, Influenza virus
LGAIAGFI

SEQ ID NO: 285850 - protein, 8 aa, Influenza virus
GTIAGFIE

SEQ ID NO: 285851 - protein, 8 aa, Influenza virus
TIAGFIEG

SEQ ID NO: 285852 - protein, 8 aa, Influenza virus
QHQNEQGT

SEQ ID NO: 285853 - protein, 8 aa, Influenza virus
HQNEQGTG

SEQ ID NO: 285854 - protein, 8 aa, Influenza virus
QNEQGVGM

SEQ ID NO: 285855 - protein, 8 aa, Influenza virus
NEQGVGMA

SEQ ID NO: 285856 - protein, 8 aa, Influenza virus
EQGVGMAA

SEQ ID NO: 285857 - protein, 8 aa, Influenza virus
QGVGMAAD

SEQ ID NO: 285858 - protein, 8 aa, Influenza virus
GVGMAADK

SEQ ID NO: 285859 - protein, 8 aa, Influenza virus
VGMAADKE

SEQ ID NO: 285860 - protein, 8 aa, Influenza virus
GMAADKES

SEQ ID NO: 285861 - protein, 8 aa, Influenza virus
MAADKEST

SEQ ID NO: 285862 - protein, 8 aa, Influenza virus
AAEKESTQ

SEQ ID NO: 285863 - protein, 8 aa, Influenza virus
AEKESTQK

SEQ ID NO: 285864 - protein, 8 aa, Influenza virus
EKESTQKA

SEQ ID NO: 285865 - protein, 8 aa, Influenza virus
STQKAIDR

SEQ ID NO: 285866 - protein, 8 aa, Influenza virus
TQKAIDRI

SEQ ID NO: 285867 - protein, 8 aa, Influenza virus
QKAIDRIT

SEQ ID NO: 285868 - protein, 8 aa, Influenza virus
KAIDRITT

SEQ ID NO: 285869 - protein, 8 aa, Influenza virus
AIDRITTK

SEQ ID NO: 285870 - protein, 8 aa, Influenza virus
IDRITTKI

SEQ ID NO: 285871 - protein, 8 aa, Influenza virus
DRITTKIN

SEQ ID NO: 285872 - protein, 8 aa, Influenza virus
RITTKINN

SEQ ID NO: 285873 - protein, 8 aa, Influenza virus
TKINNIIE

SEQ ID NO: 285874 - protein, 8 aa, Influenza virus
KINNIIEK

SEQ ID NO: 285875 - protein, 8 aa, Influenza virus
INNIIEKM

SEQ ID NO: 285876 - protein, 8 aa, Influenza virus
NNIIEKMN

SEQ ID NO: 285877 - protein, 8 aa, Influenza virus
NIIEKMNG

SEQ ID NO: 285878 - protein, 8 aa, Influenza virus
IIEKMNGN

SEQ ID NO: 285879 - protein, 8 aa, Influenza virus
IEKMNGNY

SEQ ID NO: 285880 - protein, 8 aa, Influenza virus
EKMNGNYD

SEQ ID NO: 285881 - protein, 8 aa, Influenza virus
DSIRGEFS

SEQ ID NO: 285882 - protein, 8 aa, Influenza virus
SIRGEFSQ

SEQ ID NO: 285883 - protein, 8 aa, Influenza virus
IRGEFSQV

SEQ ID NO: 285884 - protein, 8 aa, Influenza virus
RGEFSQVE

SEQ ID NO: 285885 - protein, 8 aa, Influenza virus
GEFSQVEQ

SEQ ID NO: 285886 - protein, 8 aa, Influenza virus
EFSQVEQR

SEQ ID NO: 285887 - protein, 8 aa, Influenza virus
FSQVEQRI

SEQ ID NO: 285888 - protein, 8 aa, Influenza virus
SQVEQRIN

SEQ ID NO: 285889 - protein, 8 aa, Influenza virus
QVEKRINM

SEQ ID NO: 285890 - protein, 8 aa, Influenza virus
VEKRINML

SEQ ID NO: 285891 - protein, 8 aa, Influenza virus
EKRINMLA

SEQ ID NO: 285892 - protein, 8 aa, Influenza virus
KRINMLAD

SEQ ID NO: 285893 - protein, 8 aa, Influenza virus
IDDAVTDI

SEQ ID NO: 285894 - protein, 8 aa, Influenza virus
DDAVTDIW

SEQ ID NO: 285895 - protein, 8 aa, Influenza virus
DAVTDIWS

SEQ ID NO: 285896 - protein, 8 aa, Influenza virus
AVTDIWSY

SEQ ID NO: 285897 - protein, 8 aa, Influenza virus
VTDIWSYN

SEQ ID NO: 285898 - protein, 8 aa, Influenza virus
TDIWSYNA

SEQ ID NO: 285899 - protein, 8 aa, Influenza virus
DIWSYNAK

SEQ ID NO: 285900 - protein, 8 aa, Influenza virus
IWSYNAKL

SEQ ID NO: 285901 - protein, 8 aa, Influenza virus
WSYNARLL

SEQ ID NO: 285902 - protein, 8 aa, Influenza virus
SYNARLLV

SEQ ID NO: 285903 - protein, 8 aa, Influenza virus
YNARLLVL

SEQ ID NO: 285904 - protein, 8 aa, Influenza virus
NARLLVLL

SEQ ID NO: 285905 - protein, 8 aa, Influenza virus
ARLLVLLE

SEQ ID NO: 285906 - protein, 8 aa, Influenza virus
RLLVLLEN

SEQ ID NO: 285907 - protein, 8 aa, Influenza virus
LENDKTLN

SEQ ID NO: 285908 - protein, 8 aa, Influenza virus
ENDKTLDL

SEQ ID NO: 285909 - protein, 8 aa, Influenza virus
NDKTLNMH

SEQ ID NO: 285910 - protein, 8 aa, Influenza virus
DKTLDLHD

SEQ ID NO: 285911 - protein, 8 aa, Influenza virus
KTLNMHDA

SEQ ID NO: 285912 - protein, 8 aa, Influenza virus
TLNMHDAN

SEQ ID NO: 285913 - protein, 8 aa, Influenza virus
LDLHDANV

SEQ ID NO: 285914 - protein, 8 aa, Influenza virus
DMHDANVK

SEQ ID NO: 285915 - protein, 8 aa, Influenza virus
MHDANVKN

SEQ ID NO: 285916 - protein, 8 aa, Influenza virus
HDANVKNL

SEQ ID NO: 285917 - protein, 8 aa, Influenza virus
DANVKNLH

SEQ ID NO: 285918 - protein, 8 aa, Influenza virus
ANVRNLHE

SEQ ID NO: 285919 - protein, 8 aa, Influenza virus
NVRNLHEQ

SEQ ID NO: 285920 - protein, 8 aa, Influenza virus
VRNLHEQV

SEQ ID NO: 285921 - protein, 8 aa, Influenza virus
RNLHEQVR

SEQ ID NO: 285922 - protein, 8 aa, Influenza virus
NLHDQVRR

SEQ ID NO: 285923 - protein, 8 aa, Influenza virus
NAVDEGNG

SEQ ID NO: 285924 - protein, 8 aa, Influenza virus
AVDEGNGC

SEQ ID NO: 285925 - protein, 8 aa, Influenza virus
VDEGNGCF

SEQ ID NO: 285926 - protein, 8 aa, Influenza virus
NEGNGCFE

SEQ ID NO: 285927 - protein, 8 aa, Influenza virus
ELLHKCNN

SEQ ID NO: 285928 - protein, 8 aa, Influenza virus
LLHKCNNS

SEQ ID NO: 285929 - protein, 8 aa, Influenza virus
LHKCNNSC

SEQ ID NO: 285930 - protein, 8 aa, Influenza virus
HKCNNSCM

SEQ ID NO: 285931 - protein, 8 aa, Influenza virus
KCNNSCME

SEQ ID NO: 285932 - protein, 8 aa, Influenza virus
CNNSCMET

SEQ ID NO: 285933 - protein, 8 aa, Influenza virus
NNSCMETI

SEQ ID NO: 285934 - protein, 8 aa, Influenza virus
NSCMETIR

SEQ ID NO: 285935 - protein, 8 aa, Influenza virus
SCMDTIRN

SEQ ID NO: 285936 - protein, 8 aa, Influenza virus
CMDTIRNG

SEQ ID NO: 285937 - protein, 8 aa, Influenza virus
MDTIRNGT

SEQ ID NO: 285938 - protein, 8 aa, Influenza virus
DTIRNGTY

SEQ ID NO: 285939 - protein, 8 aa, Influenza virus
TIRNGTYD

SEQ ID NO: 285940 - protein, 8 aa, Influenza virus
IRNGTYDH

SEQ ID NO: 285941 - protein, 8 aa, Influenza virus
RNGTYDHT

SEQ ID NO: 285942 - protein, 8 aa, Influenza virus
EYEEESKL

SEQ ID NO: 285943 - protein, 8 aa, Influenza virus
YEEESKLK

SEQ ID NO: 285944 - protein, 8 aa, Influenza virus
EEESKLKR

SEQ ID NO: 285945 - protein, 8 aa, Influenza virus
KLKRQEIN

SEQ ID NO: 285946 - protein, 8 aa, Influenza virus
LKRQEING

SEQ ID NO: 285947 - protein, 8 aa, Influenza virus
KRQEINGI

SEQ ID NO: 285948 - protein, 8 aa, Influenza virus
RQEINGIK

SEQ ID NO: 285949 - protein, 8 aa, Influenza virus
QEINGIKL

SEQ ID NO: 285950 - protein, 8 aa, Influenza virus
EINGIKLK

SEQ ID NO: 285951 - protein, 8 aa, Influenza virus
INGIKLKS

SEQ ID NO: 285952 - protein, 8 aa, Influenza virus
GIKLKSDD

SEQ ID NO: 285953 - protein, 8 aa, Influenza virus
LKSDDSVY

SEQ ID NO: 285954 - protein, 8 aa, Influenza virus
SDDSVYKA

SEQ ID NO: 285955 - protein, 8 aa, Influenza virus
DDSVYKAL

SEQ ID NO: 285956 - protein, 8 aa, Influenza virus
DSVYKALS

SEQ ID NO: 285957 - protein, 8 aa, Influenza virus
SVYKALSI

SEQ ID NO: 285958 - protein, 8 aa, Influenza virus
VYRALSIY

SEQ ID NO: 285959 - protein, 8 aa, Influenza virus
YRALSIYS

SEQ ID NO: 285960 - protein, 8 aa, Influenza virus
RALSIYSC

SEQ ID NO: 285961 - protein, 8 aa, Influenza virus
YSCIASSI

SEQ ID NO: 285962 - protein, 8 aa, Influenza virus
SCIASSIV

SEQ ID NO: 285963 - protein, 8 aa, Influenza virus
CIASSIVL

SEQ ID NO: 285964 - protein, 8 aa, Influenza virus
IASSIVLV

SEQ ID NO: 285965 - protein, 8 aa, Influenza virus
ASSIVLVG

SEQ ID NO: 285966 - protein, 8 aa, Influenza virus
SSIVLVGL

SEQ ID NO: 285967 - protein, 8 aa, Influenza virus
SIVLVGLI

SEQ ID NO: 285968 - protein, 8 aa, Influenza virus
IVLVGLIL

SEQ ID NO: 285969 - protein, 8 aa, Influenza virus
VLVGLILS

SEQ ID NO: 285970 - protein, 8 aa, Influenza virus
LVGLILSF

SEQ ID NO: 285971 - protein, 8 aa, Influenza virus
VGLILSFI

SEQ ID NO: 285972 - protein, 8 aa, Influenza virus
GLILSFIM

SEQ ID NO: 285973 - protein, 8 aa, Influenza virus
LILSFIMW

SEQ ID NO: 285974 - protein, 8 aa, Influenza virus
ILSFIMWA

SEQ ID NO: 285975 - protein, 8 aa, Influenza virus
LSFIMWAC

SEQ ID NO: 285976 - protein, 8 aa, Influenza virus
FIMWACSN

SEQ ID NO: 285977 - protein, 8 aa, Influenza virus
IMWACSNG

SEQ ID NO: 285978 - protein, 8 aa, Influenza virus
MWACSNGS

SEQ ID NO: 285979 - protein, 8 aa, Influenza virus
WACSNGSC

SEQ ID NO: 285980 - protein, 8 aa, Influenza virus
ACSNGSCR

SEQ ID NO: 285981 - protein, 8 aa, Influenza virus
CNSGNCRF

SEQ ID NO: 285982 - protein, 8 aa, Influenza virus
NSGNCRFN

SEQ ID NO: 285983 - protein, 8 aa, Influenza virus
GSEHTAYS

SEQ ID NO: 285984 - protein, 8 aa, Influenza virus
SEHTAYSQ

SEQ ID NO: 285985 - protein, 8 aa, Influenza virus
EHTAYSQI

SEQ ID NO: 285986 - protein, 8 aa, Influenza virus
RLNWLTKE

SEQ ID NO: 285987 - protein, 8 aa, Influenza virus
LNWLTKET

SEQ ID NO: 285988 - protein, 8 aa, Influenza virus
NWLTKETN

SEQ ID NO: 285989 - protein, 8 aa, Influenza virus
WLTKETNG

SEQ ID NO: 285990 - protein, 8 aa, Influenza virus
LTKETNGN

SEQ ID NO: 285991 - protein, 8 aa, Influenza virus
TKETNGNY

SEQ ID NO: 285992 - protein, 8 aa, Influenza virus
KETNGNYG

SEQ ID NO: 285993 - protein, 8 aa, Influenza virus
ETNGNYGP

SEQ ID NO: 285994 - protein, 8 aa, Influenza virus
VLGLSMVR

SEQ ID NO: 285995 - protein, 8 aa, Influenza virus
LGLSMVRS

SEQ ID NO: 285996 - protein, 8 aa, Influenza virus
GLSMVRSD

SEQ ID NO: 285997 - protein, 8 aa, Influenza virus
LSMVRSDK

SEQ ID NO: 285998 - protein, 8 aa, Influenza virus
SMVRSDKI

SEQ ID NO: 285999 - protein, 8 aa, Influenza virus
MVRSDKIC

SEQ ID NO: 286000 - protein, 8 aa, Influenza virus
VRSDKICL

SEQ ID NO: 286001 - protein, 8 aa, Influenza virus
RSDKICLG

SEQ ID NO: 286002 - protein, 8 aa, Influenza virus
CLGHHAVP

SEQ ID NO: 286003 - protein, 8 aa, Influenza virus
LGHHAVPN

SEQ ID NO: 286004 - protein, 8 aa, Influenza virus
GHHAVPNG

SEQ ID NO: 286005 - protein, 8 aa, Influenza virus
HHAVPNGT

SEQ ID NO: 286006 - protein, 8 aa, Influenza virus
HAVPNGTK

SEQ ID NO: 286007 - protein, 8 aa, Influenza virus
AVPNGTKV

SEQ ID NO: 286008 - protein, 8 aa, Influenza virus
VPNGTKVN

SEQ ID NO: 286009 - protein, 8 aa, Influenza virus
PNGTKVNT

SEQ ID NO: 286010 - protein, 8 aa, Influenza virus
KVNTLTEK

SEQ ID NO: 286011 - protein, 8 aa, Influenza virus
VNTLTEKG

SEQ ID NO: 286012 - protein, 8 aa, Influenza virus
NTLTEKGV

SEQ ID NO: 286013 - protein, 8 aa, Influenza virus
TLTEKGVE

SEQ ID NO: 286014 - protein, 8 aa, Influenza virus
LTEKGVEV

SEQ ID NO: 286015 - protein, 8 aa, Influenza virus
TEKGVEVV

SEQ ID NO: 286016 - protein, 8 aa, Influenza virus
EKGVEVVN

SEQ ID NO: 286017 - protein, 8 aa, Influenza virus
KGVEVVNA

SEQ ID NO: 286018 - protein, 8 aa, Influenza virus
TVEITGIN

SEQ ID NO: 286019 - protein, 8 aa, Influenza virus
VEITGINK

SEQ ID NO: 286020 - protein, 8 aa, Influenza virus
EITGINKV

SEQ ID NO: 286021 - protein, 8 aa, Influenza virus
ITGINKVC

SEQ ID NO: 286022 - protein, 8 aa, Influenza virus
TGINKVCT

SEQ ID NO: 286023 - protein, 8 aa, Influenza virus
GINKVCTK

SEQ ID NO: 286024 - protein, 8 aa, Influenza virus
INKVCTKG

SEQ ID NO: 286025 - protein, 8 aa, Influenza virus
NKVCTKGK

SEQ ID NO: 286026 - protein, 8 aa, Influenza virus
IGPPQCDS

SEQ ID NO: 286027 - protein, 8 aa, Influenza virus
GPPQCDSH

SEQ ID NO: 286028 - protein, 8 aa, Influenza virus
PPQCDSHL

SEQ ID NO: 286029 - protein, 8 aa, Influenza virus
PQCDSHLK

SEQ ID NO: 286030 - protein, 8 aa, Influenza virus
QCDSHLKF

SEQ ID NO: 286031 - protein, 8 aa, Influenza virus
CDSHLKFK

SEQ ID NO: 286032 - protein, 8 aa, Influenza virus
DSHLKFKA

SEQ ID NO: 286033 - protein, 8 aa, Influenza virus
SHLKFKAD

SEQ ID NO: 286034 - protein, 8 aa, Influenza virus
HLKFKADL

SEQ ID NO: 286035 - protein, 8 aa, Influenza virus
LKFKADLI

SEQ ID NO: 286036 - protein, 8 aa, Influenza virus
KFKADLII

SEQ ID NO: 286037 - protein, 8 aa, Influenza virus
SDICYPGK

SEQ ID NO: 286038 - protein, 8 aa, Influenza virus
DICYPGKF

SEQ ID NO: 286039 - protein, 8 aa, Influenza virus
ICYPGKFT

SEQ ID NO: 286040 - protein, 8 aa, Influenza virus
CYPGKFTN

SEQ ID NO: 286041 - protein, 8 aa, Influenza virus
YPGKFTNE

SEQ ID NO: 286042 - protein, 8 aa, Influenza virus
PGKFTNEE

SEQ ID NO: 286043 - protein, 8 aa, Influenza virus
GKFTNEEA

SEQ ID NO: 286044 - protein, 8 aa, Influenza virus
KFTNEEAL

SEQ ID NO: 286045 - protein, 8 aa, Influenza virus
SGGIDKEP

SEQ ID NO: 286046 - protein, 8 aa, Influenza virus
GGIDKEPM

SEQ ID NO: 286047 - protein, 8 aa, Influenza virus
GIDKEPMG

SEQ ID NO: 286048 - protein, 8 aa, Influenza virus
IDKEPMGF

SEQ ID NO: 286049 - protein, 8 aa, Influenza virus
DKEPMGFR

SEQ ID NO: 286050 - protein, 8 aa, Influenza virus
KEPMGFRY

SEQ ID NO: 286051 - protein, 8 aa, Influenza virus
EPMGFRYS

SEQ ID NO: 286052 - protein, 8 aa, Influenza virus
PMGFRYSG

SEQ ID NO: 286053 - protein, 8 aa, Influenza virus
GFRYSGIK

SEQ ID NO: 286054 - protein, 8 aa, Influenza virus
FRYSGIKT

SEQ ID NO: 286055 - protein, 8 aa, Influenza virus
RYSGIKTD

SEQ ID NO: 286056 - protein, 8 aa, Influenza virus
YSGIKTDG

SEQ ID NO: 286057 - protein, 8 aa, Influenza virus
SGIKTDGA

SEQ ID NO: 286058 - protein, 8 aa, Influenza virus
GIKTDGAT

SEQ ID NO: 286059 - protein, 8 aa, Influenza virus
IKTDGATS

SEQ ID NO: 286060 - protein, 8 aa, Influenza virus
KTDGATSA

SEQ ID NO: 286061 - protein, 8 aa, Influenza virus
YSEMKWLL

SEQ ID NO: 286062 - protein, 8 aa, Influenza virus
SEMKWLLS

SEQ ID NO: 286063 - protein, 8 aa, Influenza virus
EMKWLLSS

SEQ ID NO: 286064 - protein, 8 aa, Influenza virus
MKWLLSSK

SEQ ID NO: 286065 - protein, 8 aa, Influenza virus
KWLLSSKA

SEQ ID NO: 286066 - protein, 8 aa, Influenza virus
WLLSSKAN

SEQ ID NO: 286067 - protein, 8 aa, Influenza virus
LLSSKANQ

SEQ ID NO: 286068 - protein, 8 aa, Influenza virus
LSSKANQV

SEQ ID NO: 286069 - protein, 8 aa, Influenza virus
SSKANQVF

SEQ ID NO: 286070 - protein, 8 aa, Influenza virus
SKANQVFP

SEQ ID NO: 286071 - protein, 8 aa, Influenza virus
KANQVFPQ

SEQ ID NO: 286072 - protein, 8 aa, Influenza virus
ANQVFPQL

SEQ ID NO: 286073 - protein, 8 aa, Influenza virus
LNQTYRNN

SEQ ID NO: 286074 - protein, 8 aa, Influenza virus
NQTYRNNR

SEQ ID NO: 286075 - protein, 8 aa, Influenza virus
QTYRNNRK

SEQ ID NO: 286076 - protein, 8 aa, Influenza virus
TYRNNRKE

SEQ ID NO: 286077 - protein, 8 aa, Influenza virus
YRNNRKEP

SEQ ID NO: 286078 - protein, 8 aa, Influenza virus
RNNRKEPA

SEQ ID NO: 286079 - protein, 8 aa, Influenza virus
NNRKEPAL

SEQ ID NO: 286080 - protein, 8 aa, Influenza virus
NRKEPALI

SEQ ID NO: 286081 - protein, 8 aa, Influenza virus
EQNKLYGA

SEQ ID NO: 286082 - protein, 8 aa, Influenza virus
QNKLYGAG

SEQ ID NO: 286083 - protein, 8 aa, Influenza virus
NKLYGAGN

SEQ ID NO: 286084 - protein, 8 aa, Influenza virus
KLYGAGNK

SEQ ID NO: 286085 - protein, 8 aa, Influenza virus
LYGAGNKL

SEQ ID NO: 286086 - protein, 8 aa, Influenza virus
YGAGNKLI

SEQ ID NO: 286087 - protein, 8 aa, Influenza virus
GAGNKLIT

SEQ ID NO: 286088 - protein, 8 aa, Influenza virus
AGNKLITV

SEQ ID NO: 286089 - protein, 8 aa, Influenza virus
TVGSSKYR

SEQ ID NO: 286090 - protein, 8 aa, Influenza virus
VGSSKYRQ

SEQ ID NO: 286091 - protein, 8 aa, Influenza virus
GSSKYRQS

SEQ ID NO: 286092 - protein, 8 aa, Influenza virus
SSKYRQSF

SEQ ID NO: 286093 - protein, 8 aa, Influenza virus
SKYRQSFS

SEQ ID NO: 286094 - protein, 8 aa, Influenza virus
KYRQSFSP

SEQ ID NO: 286095 - protein, 8 aa, Influenza virus
YRQSFSPS

SEQ ID NO: 286096 - protein, 8 aa, Influenza virus
RQSFSPSP

SEQ ID NO: 286097 - protein, 8 aa, Influenza virus
SFSPSPGD

SEQ ID NO: 286098 - protein, 8 aa, Influenza virus
FSPSPGDR

SEQ ID NO: 286099 - protein, 8 aa, Influenza virus
SPSPGDRP

SEQ ID NO: 286100 - protein, 8 aa, Influenza virus
PSPGDRPK

SEQ ID NO: 286101 - protein, 8 aa, Influenza virus
SPGDRPKV

SEQ ID NO: 286102 - protein, 8 aa, Influenza virus
PGDRPKVN

SEQ ID NO: 286103 - protein, 8 aa, Influenza virus
GDRPKVNG

SEQ ID NO: 286104 - protein, 8 aa, Influenza virus
DRPKVNGQ

SEQ ID NO: 286105 - protein, 8 aa, Influenza virus
RSNAPSGV

SEQ ID NO: 286106 - protein, 8 aa, Influenza virus
SNAPSGVE

SEQ ID NO: 286107 - protein, 8 aa, Influenza virus
NAPSGVEY

SEQ ID NO: 286108 - protein, 8 aa, Influenza virus
APSGVEYN

SEQ ID NO: 286109 - protein, 8 aa, Influenza virus
PSGVEYNG

SEQ ID NO: 286110 - protein, 8 aa, Influenza virus
SGVEYNGK

SEQ ID NO: 286111 - protein, 8 aa, Influenza virus
GVEYNGKS

SEQ ID NO: 286112 - protein, 8 aa, Influenza virus
VEYNGKSL

SEQ ID NO: 286113 - protein, 8 aa, Influenza virus
PFQNIDSW

SEQ ID NO: 286114 - protein, 8 aa, Influenza virus
FQNIDSWA

SEQ ID NO: 286115 - protein, 8 aa, Influenza virus
QNIDSWAV

SEQ ID NO: 286116 - protein, 8 aa, Influenza virus
NIDSWAVG

SEQ ID NO: 286117 - protein, 8 aa, Influenza virus
IDSWAVGR

SEQ ID NO: 286118 - protein, 8 aa, Influenza virus
DSWAVGRC

SEQ ID NO: 286119 - protein, 8 aa, Influenza virus
SWAVGRCP

SEQ ID NO: 286120 - protein, 8 aa, Influenza virus
WAVGRCPR

SEQ ID NO: 286121 - protein, 8 aa, Influenza virus
AVGRCPRY

SEQ ID NO: 286122 - protein, 8 aa, Influenza virus
VGRCPRYV

SEQ ID NO: 286123 - protein, 8 aa, Influenza virus
GRCPRYVK

SEQ ID NO: 286124 - protein, 8 aa, Influenza virus
RCPRYVKQ

SEQ ID NO: 286125 - protein, 8 aa, Influenza virus
KNVPEKIH

SEQ ID NO: 286126 - protein, 8 aa, Influenza virus
NVPEKIHT

SEQ ID NO: 286127 - protein, 8 aa, Influenza virus
VPEKIHTR

SEQ ID NO: 286128 - protein, 8 aa, Influenza virus
PEKIHTRG

SEQ ID NO: 286129 - protein, 8 aa, Influenza virus
EKIHTRGL

SEQ ID NO: 286130 - protein, 8 aa, Influenza virus
KIHTRGLF

SEQ ID NO: 286131 - protein, 8 aa, Influenza virus
IHTRGLFG

SEQ ID NO: 286132 - protein, 8 aa, Influenza virus
HTRGLFGA

SEQ ID NO: 286133 - protein, 8 aa, Influenza virus
VKRRPVAK

SEQ ID NO: 286134 - protein, 8 aa, Influenza virus
KRRPVAKA

SEQ ID NO: 286135 - protein, 8 aa, Influenza virus
RRPVAKAG

SEQ ID NO: 286136 - protein, 8 aa, Influenza virus
RPVAKAGF

SEQ ID NO: 286137 - protein, 8 aa, Influenza virus
PVAKAGFI

SEQ ID NO: 286138 - protein, 8 aa, Influenza virus
VAKAGFIE

SEQ ID NO: 286139 - protein, 8 aa, Influenza virus
AKAGFIEN

SEQ ID NO: 286140 - protein, 8 aa, Influenza virus
KAGFIENG

SEQ ID NO: 286141 - protein, 8 aa, Influenza virus
RLIEKTNT

SEQ ID NO: 286142 - protein, 8 aa, Influenza virus
LIEKTNTQ

SEQ ID NO: 286143 - protein, 8 aa, Influenza virus
IEKTNTQF

SEQ ID NO: 286144 - protein, 8 aa, Influenza virus
EKTNTQFE

SEQ ID NO: 286145 - protein, 8 aa, Influenza virus
KTNTQFEL

SEQ ID NO: 286146 - protein, 8 aa, Influenza virus
TNTQFELI

SEQ ID NO: 286147 - protein, 8 aa, Influenza virus
NTQFELID

SEQ ID NO: 286148 - protein, 8 aa, Influenza virus
TQFELIDN

SEQ ID NO: 286149 - protein, 8 aa, Influenza virus
INPVKLSG

SEQ ID NO: 286150 - protein, 8 aa, Influenza virus
NPVKLSGG

SEQ ID NO: 286151 - protein, 8 aa, Influenza virus
PVKLSGGY

SEQ ID NO: 286152 - protein, 8 aa, Influenza virus
VKLSGGYK

SEQ ID NO: 286153 - protein, 8 aa, Influenza virus
KLSGGYKD

SEQ ID NO: 286154 - protein, 8 aa, Influenza virus
LSGGYKDV

SEQ ID NO: 286155 - protein, 8 aa, Influenza virus
SGGYKDVI

SEQ ID NO: 286156 - protein, 8 aa, Influenza virus
GGYKDVIL

SEQ ID NO: 286157 - protein, 8 aa, Influenza virus
VKYSRADK

SEQ ID NO: 286158 - protein, 8 aa, Influenza virus
KYSRADKI

SEQ ID NO: 286159 - protein, 8 aa, Influenza virus
YSRADKIC

SEQ ID NO: 286160 - protein, 8 aa, Influenza virus
SRADKICI

SEQ ID NO: 286161 - protein, 8 aa, Influenza virus
RADKICIG

SEQ ID NO: 286162 - protein, 8 aa, Influenza virus
IGYLSNNA

SEQ ID NO: 286163 - protein, 8 aa, Influenza virus
GYLSNNST

SEQ ID NO: 286164 - protein, 8 aa, Influenza virus
YLSNNSTD

SEQ ID NO: 286165 - protein, 8 aa, Influenza virus
LSNNSTDK

SEQ ID NO: 286166 - protein, 8 aa, Influenza virus
SNNSTDKV

SEQ ID NO: 286167 - protein, 8 aa, Influenza virus
NNSTDKVD

SEQ ID NO: 286168 - protein, 8 aa, Influenza virus
NSTDKVDT

SEQ ID NO: 286169 - protein, 8 aa, Influenza virus
STDKVDTL

SEQ ID NO: 286170 - protein, 8 aa, Influenza virus
TDTVDTLT

SEQ ID NO: 286171 - protein, 8 aa, Influenza virus
DKVDTLTE

SEQ ID NO: 286172 - protein, 8 aa, Influenza virus
KVDTLTEN

SEQ ID NO: 286173 - protein, 8 aa, Influenza virus
IDTLTETG

SEQ ID NO: 286174 - protein, 8 aa, Influenza virus
DTLTETGV

SEQ ID NO: 286175 - protein, 8 aa, Influenza virus
TLTETGVP

SEQ ID NO: 286176 - protein, 8 aa, Influenza virus
LTETGVPV

SEQ ID NO: 286177 - protein, 8 aa, Influenza virus
TETGVPVT

SEQ ID NO: 286178 - protein, 8 aa, Influenza virus
ETGVPVTS

SEQ ID NO: 286179 - protein, 8 aa, Influenza virus
TGVPVTSS

SEQ ID NO: 286180 - protein, 8 aa, Influenza virus
GVPVTSSI

SEQ ID NO: 286181 - protein, 8 aa, Influenza virus
VPVTSSID

SEQ ID NO: 286182 - protein, 8 aa, Influenza virus
PVTSSIDL

SEQ ID NO: 286183 - protein, 8 aa, Influenza virus
VTSSIDLV

SEQ ID NO: 286184 - protein, 8 aa, Influenza virus
TSSIDLVE

SEQ ID NO: 286185 - protein, 8 aa, Influenza virus
SSIDLVET

SEQ ID NO: 286186 - protein, 8 aa, Influenza virus
SIDLVETN

SEQ ID NO: 286187 - protein, 8 aa, Influenza virus
IDLVETNH

SEQ ID NO: 286188 - protein, 8 aa, Influenza virus
TYCSLNGI

SEQ ID NO: 286189 - protein, 8 aa, Influenza virus
YCSLNGIS

SEQ ID NO: 286190 - protein, 8 aa, Influenza virus
CSLNGISP

SEQ ID NO: 286191 - protein, 8 aa, Influenza virus
SLNGISPI

SEQ ID NO: 286192 - protein, 8 aa, Influenza virus
LNGISPIH

SEQ ID NO: 286193 - protein, 8 aa, Influenza virus
NGISPIHL

SEQ ID NO: 286194 - protein, 8 aa, Influenza virus
GISPIHLG

SEQ ID NO: 286195 - protein, 8 aa, Influenza virus
ISPIHLGD

SEQ ID NO: 286196 - protein, 8 aa, Influenza virus
SPVHLGDC

SEQ ID NO: 286197 - protein, 8 aa, Influenza virus
PVHLGDCS

SEQ ID NO: 286198 - protein, 8 aa, Influenza virus
VHLGDCSF

SEQ ID NO: 286199 - protein, 8 aa, Influenza virus
VGNPSCAS

SEQ ID NO: 286200 - protein, 8 aa, Influenza virus
GNPSCASN

SEQ ID NO: 286201 - protein, 8 aa, Influenza virus
NPSCASNI

SEQ ID NO: 286202 - protein, 8 aa, Influenza virus
PSCASNIN

SEQ ID NO: 286203 - protein, 8 aa, Influenza virus
SCASNINI

SEQ ID NO: 286204 - protein, 8 aa, Influenza virus
CASNINIR

SEQ ID NO: 286205 - protein, 8 aa, Influenza virus
ASNINIRE

SEQ ID NO: 286206 - protein, 8 aa, Influenza virus
SNINIREW

SEQ ID NO: 286207 - protein, 8 aa, Influenza virus
IEDPNAPH

SEQ ID NO: 286208 - protein, 8 aa, Influenza virus
EDPNAPHK

SEQ ID NO: 286209 - protein, 8 aa, Influenza virus
DPNAPHKL

SEQ ID NO: 286210 - protein, 8 aa, Influenza virus
PNAPHKLC

SEQ ID NO: 286211 - protein, 8 aa, Influenza virus
NAPNKLCF

SEQ ID NO: 286212 - protein, 8 aa, Influenza virus
APHKLCFP

SEQ ID NO: 286213 - protein, 8 aa, Influenza virus
PNKLCFPG

SEQ ID NO: 286214 - protein, 8 aa, Influenza virus
HKLCFPGE

SEQ ID NO: 286215 - protein, 8 aa, Influenza virus
KLCYPGEL

SEQ ID NO: 286216 - protein, 8 aa, Influenza virus
LCYPGELD

SEQ ID NO: 286217 - protein, 8 aa, Influenza virus
CYPGELDN

SEQ ID NO: 286218 - protein, 8 aa, Influenza virus
YPGELDNN

SEQ ID NO: 286219 - protein, 8 aa, Influenza virus
PGEVDNNG

SEQ ID NO: 286220 - protein, 8 aa, Influenza virus
GEVDNNGE

SEQ ID NO: 286221 - protein, 8 aa, Influenza virus
EVDNNGEL

SEQ ID NO: 286222 - protein, 8 aa, Influenza virus
VDNNGELR

SEQ ID NO: 286223 - protein, 8 aa, Influenza virus
FSRTELIN

SEQ ID NO: 286224 - protein, 8 aa, Influenza virus
SRTELINP

SEQ ID NO: 286225 - protein, 8 aa, Influenza virus
RTELIPPS

SEQ ID NO: 286226 - protein, 8 aa, Influenza virus
TELINPSK

SEQ ID NO: 286227 - protein, 8 aa, Influenza virus
ELIPPSKW

SEQ ID NO: 286228 - protein, 8 aa, Influenza virus
LIPPSKWG

SEQ ID NO: 286229 - protein, 8 aa, Influenza virus
PSKWGDIL

SEQ ID NO: 286230 - protein, 8 aa, Influenza virus
SKWGDILE

SEQ ID NO: 286231 - protein, 8 aa, Influenza virus
KWGDILEG

SEQ ID NO: 286232 - protein, 8 aa, Influenza virus
WGDILEGT

SEQ ID NO: 286233 - protein, 8 aa, Influenza virus
GDILEGTT

SEQ ID NO: 286234 - protein, 8 aa, Influenza virus
DILEGTTA

SEQ ID NO: 286235 - protein, 8 aa, Influenza virus
ILEGTTAS

SEQ ID NO: 286236 - protein, 8 aa, Influenza virus
LEGTTASC

SEQ ID NO: 286237 - protein, 8 aa, Influenza virus
EGTTASCQ

SEQ ID NO: 286238 - protein, 8 aa, Influenza virus
GTTASCQN

SEQ ID NO: 286239 - protein, 8 aa, Influenza virus
TTASCQNR

SEQ ID NO: 286240 - protein, 8 aa, Influenza virus
TASCQNRG

SEQ ID NO: 286241 - protein, 8 aa, Influenza virus
ASCQNRGA

SEQ ID NO: 286242 - protein, 8 aa, Influenza virus
GANSFYRN

SEQ ID NO: 286243 - protein, 8 aa, Influenza virus
ANSFYRNL

SEQ ID NO: 286244 - protein, 8 aa, Influenza virus
NSFYRNLI

SEQ ID NO: 286245 - protein, 8 aa, Influenza virus
SFYRNLIW

SEQ ID NO: 286246 - protein, 8 aa, Influenza virus
FYRNLIWL

SEQ ID NO: 286247 - protein, 8 aa, Influenza virus
YRNLIWLV

SEQ ID NO: 286248 - protein, 8 aa, Influenza virus
RNLIWLVN

SEQ ID NO: 286249 - protein, 8 aa, Influenza virus
NGKYPVIK

SEQ ID NO: 286250 - protein, 8 aa, Influenza virus
VKGEYNNT

SEQ ID NO: 286251 - protein, 8 aa, Influenza virus
KGEYNNTT

SEQ ID NO: 286252 - protein, 8 aa, Influenza virus
GEYNNTTG

SEQ ID NO: 286253 - protein, 8 aa, Influenza virus
EYNNTTGR

SEQ ID NO: 286254 - protein, 8 aa, Influenza virus
WGIHHPDS

SEQ ID NO: 286255 - protein, 8 aa, Influenza virus
GIHHPDSE

SEQ ID NO: 286256 - protein, 8 aa, Influenza virus
IHHPDTET

SEQ ID NO: 286257 - protein, 8 aa, Influenza virus
HHPDSETT

SEQ ID NO: 286258 - protein, 8 aa, Influenza virus
HPDTEATA

SEQ ID NO: 286259 - protein, 8 aa, Influenza virus
ATKLYVNK

SEQ ID NO: 286260 - protein, 8 aa, Influenza virus
TKLYVNKN

SEQ ID NO: 286261 - protein, 8 aa, Influenza virus
NLYVNKNP

SEQ ID NO: 286262 - protein, 8 aa, Influenza virus
LYASKNPY

SEQ ID NO: 286263 - protein, 8 aa, Influenza virus
YASKNPYT

SEQ ID NO: 286264 - protein, 8 aa, Influenza virus
ASKNPYTL

SEQ ID NO: 286265 - protein, 8 aa, Influenza virus
SKNPYTLV

SEQ ID NO: 286266 - protein, 8 aa, Influenza virus
VSTKEWSR

SEQ ID NO: 286267 - protein, 8 aa, Influenza virus
STKEWSRR

SEQ ID NO: 286268 - protein, 8 aa, Influenza virus
TKEWSRRY

SEQ ID NO: 286269 - protein, 8 aa, Influenza virus
KEWSRRYE

SEQ ID NO: 286270 - protein, 8 aa, Influenza virus
EWSRRYEL

SEQ ID NO: 286271 - protein, 8 aa, Influenza virus
WSRRYELE

SEQ ID NO: 286272 - protein, 8 aa, Influenza virus
SRRYELEI

SEQ ID NO: 286273 - protein, 8 aa, Influenza virus
RRYELEIG

SEQ ID NO: 286274 - protein, 8 aa, Influenza virus
RYELEIGA

SEQ ID NO: 286275 - protein, 8 aa, Influenza virus
YELEIGAR

SEQ ID NO: 286276 - protein, 8 aa, Influenza virus
ELEIGARI

SEQ ID NO: 286277 - protein, 8 aa, Influenza virus
LEIGARIG

SEQ ID NO: 286278 - protein, 8 aa, Influenza virus
EIGARIGE

SEQ ID NO: 286279 - protein, 8 aa, Influenza virus
IGARIGEG

SEQ ID NO: 286280 - protein, 8 aa, Influenza virus
GARIGEGQ

SEQ ID NO: 286281 - protein, 8 aa, Influenza virus
ARIGEGQR

SEQ ID NO: 286282 - protein, 8 aa, Influenza virus
RIGEGQRS

SEQ ID NO: 286283 - protein, 8 aa, Influenza virus
IGEGQRSW

SEQ ID NO: 286284 - protein, 8 aa, Influenza virus
GEGQRSWM

SEQ ID NO: 286285 - protein, 8 aa, Influenza virus
EGQRSWMK

SEQ ID NO: 286286 - protein, 8 aa, Influenza virus
GQRSWMKI

SEQ ID NO: 286287 - protein, 8 aa, Influenza virus
QRSWMKIY

SEQ ID NO: 286288 - protein, 8 aa, Influenza virus
RSWMKIYW

SEQ ID NO: 286289 - protein, 8 aa, Influenza virus
SWMKIYWH

SEQ ID NO: 286290 - protein, 8 aa, Influenza virus
WMKIYWHL

SEQ ID NO: 286291 - protein, 8 aa, Influenza virus
MKIYWHLM

SEQ ID NO: 286292 - protein, 8 aa, Influenza virus
KLYWHLMR

SEQ ID NO: 286293 - protein, 8 aa, Influenza virus
LYWHLMRP

SEQ ID NO: 286294 - protein, 8 aa, Influenza virus
YWHLMRPG

SEQ ID NO: 286295 - protein, 8 aa, Influenza virus
WHLMRPGE

SEQ ID NO: 286296 - protein, 8 aa, Influenza virus
HLMRPGER

SEQ ID NO: 286297 - protein, 8 aa, Influenza virus
LMRPGERI

SEQ ID NO: 286298 - protein, 8 aa, Influenza virus
PGERIMFE

SEQ ID NO: 286299 - protein, 8 aa, Influenza virus
GERIMFES

SEQ ID NO: 286300 - protein, 8 aa, Influenza virus
ERIMFESN

SEQ ID NO: 286301 - protein, 8 aa, Influenza virus
RIMFESNG

SEQ ID NO: 286302 - protein, 8 aa, Influenza virus
IMFESNGG

SEQ ID NO: 286303 - protein, 8 aa, Influenza virus
MFESNGGL

SEQ ID NO: 286304 - protein, 8 aa, Influenza virus
FESNGGLI

SEQ ID NO: 286305 - protein, 8 aa, Influenza virus
ESNGGLIA

SEQ ID NO: 286306 - protein, 8 aa, Influenza virus
SNGGLIAP

SEQ ID NO: 286307 - protein, 8 aa, Influenza virus
NGGLIAPR

SEQ ID NO: 286308 - protein, 8 aa, Influenza virus
GGLIAPRY

SEQ ID NO: 286309 - protein, 8 aa, Influenza virus
GLIAPRYG

SEQ ID NO: 286310 - protein, 8 aa, Influenza virus
LIAPRYGY

SEQ ID NO: 286311 - protein, 8 aa, Influenza virus
IAPRYGYI

SEQ ID NO: 286312 - protein, 8 aa, Influenza virus
YIIEKYGS

SEQ ID NO: 286313 - protein, 8 aa, Influenza virus
IIEKYGSG

SEQ ID NO: 286314 - protein, 8 aa, Influenza virus
IEKYGSGR

SEQ ID NO: 286315 - protein, 8 aa, Influenza virus
EKYGSGRI

SEQ ID NO: 286316 - protein, 8 aa, Influenza virus
KYGSGRIF

SEQ ID NO: 286317 - protein, 8 aa, Influenza virus
YGSGRIFQ

SEQ ID NO: 286318 - protein, 8 aa, Influenza virus
GSGRIFQS

SEQ ID NO: 286319 - protein, 8 aa, Influenza virus
SGRIFQSG

SEQ ID NO: 286320 - protein, 8 aa, Influenza virus
GRIFQSGI

SEQ ID NO: 286321 - protein, 8 aa, Influenza virus
RIFQSGIR

SEQ ID NO: 286322 - protein, 8 aa, Influenza virus
IFQSGVRL

SEQ ID NO: 286323 - protein, 8 aa, Influenza virus
FQSGVRLA

SEQ ID NO: 286324 - protein, 8 aa, Influenza virus
RLAKCNTK

SEQ ID NO: 286325 - protein, 8 aa, Influenza virus
LAKCNTKC

SEQ ID NO: 286326 - protein, 8 aa, Influenza virus
ARCNTKCQ

SEQ ID NO: 286327 - protein, 8 aa, Influenza virus
RCNTKCQT

SEQ ID NO: 286328 - protein, 8 aa, Influenza virus
NTKCQTSV

SEQ ID NO: 286329 - protein, 8 aa, Influenza virus
TKCQTSLG

SEQ ID NO: 286330 - protein, 8 aa, Influenza virus
KCQTSVGG

SEQ ID NO: 286331 - protein, 8 aa, Influenza virus
CQTSMGGI

SEQ ID NO: 286332 - protein, 8 aa, Influenza virus
GGVNTNKT

SEQ ID NO: 286333 - protein, 8 aa, Influenza virus
GVNTNKTF

SEQ ID NO: 286334 - protein, 8 aa, Influenza virus
VNTNKTFQ

SEQ ID NO: 286335 - protein, 8 aa, Influenza virus
DTNKTFQN

SEQ ID NO: 286336 - protein, 8 aa, Influenza virus
NKTFQNID

SEQ ID NO: 286337 - protein, 8 aa, Influenza virus
KTFQNIDR

SEQ ID NO: 286338 - protein, 8 aa, Influenza virus
TFQNIDRN

SEQ ID NO: 286339 - protein, 8 aa, Influenza virus
FQNIDRNA

SEQ ID NO: 286340 - protein, 8 aa, Influenza virus
QNIDRNAI

SEQ ID NO: 286341 - protein, 8 aa, Influenza virus
NIDRNAIG

SEQ ID NO: 286342 - protein, 8 aa, Influenza virus
IDRNAIGD

SEQ ID NO: 286343 - protein, 8 aa, Influenza virus
DRNAIGDC

SEQ ID NO: 286344 - protein, 8 aa, Influenza virus
RNAIGDCP

SEQ ID NO: 286345 - protein, 8 aa, Influenza virus
NAIGDCPK

SEQ ID NO: 286346 - protein, 8 aa, Influenza virus
AIGDCPKY

SEQ ID NO: 286347 - protein, 8 aa, Influenza virus
IGDCPKYI

SEQ ID NO: 286348 - protein, 8 aa, Influenza virus
TGLRNVPI

SEQ ID NO: 286349 - protein, 8 aa, Influenza virus
GLRNVPIP

SEQ ID NO: 286350 - protein, 8 aa, Influenza virus
NERGLFGA

SEQ ID NO: 286351 - protein, 8 aa, Influenza virus
TGIAADKT

SEQ ID NO: 286352 - protein, 8 aa, Influenza virus
GIAADKTS

SEQ ID NO: 286353 - protein, 8 aa, Influenza virus
IAADKTST

SEQ ID NO: 286354 - protein, 8 aa, Influenza virus
AADKTSTQ

SEQ ID NO: 286355 - protein, 8 aa, Influenza virus
ADKTSTQK

SEQ ID NO: 286356 - protein, 8 aa, Influenza virus
DKTSTQKA

SEQ ID NO: 286357 - protein, 8 aa, Influenza virus
KTSTQKAI

SEQ ID NO: 286358 - protein, 8 aa, Influenza virus
ASTQKAIN

SEQ ID NO: 286359 - protein, 8 aa, Influenza virus
STQKAIDE

SEQ ID NO: 286360 - protein, 8 aa, Influenza virus
TQKAIDEI

SEQ ID NO: 286361 - protein, 8 aa, Influenza virus
QKAIDEIT

SEQ ID NO: 286362 - protein, 8 aa, Influenza virus
KAIDEITT

SEQ ID NO: 286363 - protein, 8 aa, Influenza virus
AIDEITTK

SEQ ID NO: 286364 - protein, 8 aa, Influenza virus
IDEITTKI

SEQ ID NO: 286365 - protein, 8 aa, Influenza virus
DEITTKIN

SEQ ID NO: 286366 - protein, 8 aa, Influenza virus
VEKRINMI

SEQ ID NO: 286367 - protein, 8 aa, Influenza virus
EKRINMIA

SEQ ID NO: 286368 - protein, 8 aa, Influenza virus
KRINMIAD

SEQ ID NO: 286369 - protein, 8 aa, Influenza virus
RINMIADR

SEQ ID NO: 286370 - protein, 8 aa, Influenza virus
INMIADRV

SEQ ID NO: 286371 - protein, 8 aa, Influenza virus
NMIADRVD

SEQ ID NO: 286372 - protein, 8 aa, Influenza virus
MIADRVDD

SEQ ID NO: 286373 - protein, 8 aa, Influenza virus
IADRVDDA

SEQ ID NO: 286374 - protein, 8 aa, Influenza virus
ADWVDDAV

SEQ ID NO: 286375 - protein, 8 aa, Influenza virus
DWVDDAVT

SEQ ID NO: 286376 - protein, 8 aa, Influenza virus
WVDDAVTD

SEQ ID NO: 286377 - protein, 8 aa, Influenza virus
VDDAVTDV

SEQ ID NO: 286378 - protein, 8 aa, Influenza virus
DDAVTDVW

SEQ ID NO: 286379 - protein, 8 aa, Influenza virus
DAVTDVWS

SEQ ID NO: 286380 - protein, 8 aa, Influenza virus
AVTDVWSY

SEQ ID NO: 286381 - protein, 8 aa, Influenza virus
VTDVWSYN

SEQ ID NO: 286382 - protein, 8 aa, Influenza virus
TDVWSYNA

SEQ ID NO: 286383 - protein, 8 aa, Influenza virus
DVWSYNAK

SEQ ID NO: 286384 - protein, 8 aa, Influenza virus
VWSYNAKL

SEQ ID NO: 286385 - protein, 8 aa, Influenza virus
NAKLLVLL

SEQ ID NO: 286386 - protein, 8 aa, Influenza virus
AKLLVLLE

SEQ ID NO: 286387 - protein, 8 aa, Influenza virus
KLLVLLEN

SEQ ID NO: 286388 - protein, 8 aa, Influenza virus
LLVLLENG

SEQ ID NO: 286389 - protein, 8 aa, Influenza virus
LVLLENGR

SEQ ID NO: 286390 - protein, 8 aa, Influenza virus
VLLENGRT

SEQ ID NO: 286391 - protein, 8 aa, Influenza virus
LLENGRTL

SEQ ID NO: 286392 - protein, 8 aa, Influenza virus
LENGRTLD

SEQ ID NO: 286393 - protein, 8 aa, Influenza virus
ENGRTLDL

SEQ ID NO: 286394 - protein, 8 aa, Influenza virus
NGRTLDLH

SEQ ID NO: 286395 - protein, 8 aa, Influenza virus
GRTLDLHD

SEQ ID NO: 286396 - protein, 8 aa, Influenza virus
RTLGLHDA

SEQ ID NO: 286397 - protein, 8 aa, Influenza virus
TLGLHDAN

SEQ ID NO: 286398 - protein, 8 aa, Influenza virus
LGLHDANV

SEQ ID NO: 286399 - protein, 8 aa, Influenza virus
DLHDANVK

SEQ ID NO: 286400 - protein, 8 aa, Influenza virus
LHDANVKN

SEQ ID NO: 286401 - protein, 8 aa, Influenza virus
HDANVKNL

SEQ ID NO: 286402 - protein, 8 aa, Influenza virus
DANVKNLH

SEQ ID NO: 286403 - protein, 8 aa, Influenza virus
ANVRNLHE

SEQ ID NO: 286404 - protein, 8 aa, Influenza virus
NVRNLHEQ

SEQ ID NO: 286405 - protein, 8 aa, Influenza virus
VRNLHEQI

SEQ ID NO: 286406 - protein, 8 aa, Influenza virus
RNLHEQIK

SEQ ID NO: 286407 - protein, 8 aa, Influenza virus
NLHDQIKR

SEQ ID NO: 286408 - protein, 8 aa, Influenza virus
LKSNAIDE

SEQ ID NO: 286409 - protein, 8 aa, Influenza virus
KDNAIDEG

SEQ ID NO: 286410 - protein, 8 aa, Influenza virus
SNAIDEGD

SEQ ID NO: 286411 - protein, 8 aa, Influenza virus
DEGDGCFS

SEQ ID NO: 286412 - protein, 8 aa, Influenza virus
EGDGCFSI

SEQ ID NO: 286413 - protein, 8 aa, Influenza virus
GDGCFSIL

SEQ ID NO: 286414 - protein, 8 aa, Influenza virus
DGCFSILH

SEQ ID NO: 286415 - protein, 8 aa, Influenza virus
GCFSILHK

SEQ ID NO: 286416 - protein, 8 aa, Influenza virus
CFSILHKC

SEQ ID NO: 286417 - protein, 8 aa, Influenza virus
FSILHKCN

SEQ ID NO: 286418 - protein, 8 aa, Influenza virus
SILHKCND

SEQ ID NO: 286419 - protein, 8 aa, Influenza virus
ILHKCNDS

SEQ ID NO: 286420 - protein, 8 aa, Influenza virus
FHKCNDSC

SEQ ID NO: 286421 - protein, 8 aa, Influenza virus
CNDSCMEA

SEQ ID NO: 286422 - protein, 8 aa, Influenza virus
NDSCMEAI

SEQ ID NO: 286423 - protein, 8 aa, Influenza virus
DSCMEAIR

SEQ ID NO: 286424 - protein, 8 aa, Influenza virus
SCMEAIRN

SEQ ID NO: 286425 - protein, 8 aa, Influenza virus
CMEAIRNG

SEQ ID NO: 286426 - protein, 8 aa, Influenza virus
MEAIRNGT

SEQ ID NO: 286427 - protein, 8 aa, Influenza virus
EAIRNGTY

SEQ ID NO: 286428 - protein, 8 aa, Influenza virus
AIRNGTYN

SEQ ID NO: 286429 - protein, 8 aa, Influenza virus
TYNHEDYR

SEQ ID NO: 286430 - protein, 8 aa, Influenza virus
YNHEDYRE

SEQ ID NO: 286431 - protein, 8 aa, Influenza virus
NHEDYREE

SEQ ID NO: 286432 - protein, 8 aa, Influenza virus
HEDYREES

SEQ ID NO: 286433 - protein, 8 aa, Influenza virus
EDYREESQ

SEQ ID NO: 286434 - protein, 8 aa, Influenza virus
DYREESQL

SEQ ID NO: 286435 - protein, 8 aa, Influenza virus
YREESQLK

SEQ ID NO: 286436 - protein, 8 aa, Influenza virus
REESQLKR

SEQ ID NO: 286437 - protein, 8 aa, Influenza virus
EESQLKKQ

SEQ ID NO: 286438 - protein, 8 aa, Influenza virus
ESQLKKQE

SEQ ID NO: 286439 - protein, 8 aa, Influenza virus
SQLKKQEI

SEQ ID NO: 286440 - protein, 8 aa, Influenza virus
QLKKQEIE

SEQ ID NO: 286441 - protein, 8 aa, Influenza virus
LKKQEIEG

SEQ ID NO: 286442 - protein, 8 aa, Influenza virus
KKQEIEGI

SEQ ID NO: 286443 - protein, 8 aa, Influenza virus
KQEIEGIK

SEQ ID NO: 286444 - protein, 8 aa, Influenza virus
IEGIKLKS

SEQ ID NO: 286445 - protein, 8 aa, Influenza virus
EGIKLKSE

SEQ ID NO: 286446 - protein, 8 aa, Influenza virus
GIKLKSED

SEQ ID NO: 286447 - protein, 8 aa, Influenza virus
IKLKSEDN

SEQ ID NO: 286448 - protein, 8 aa, Influenza virus
KLKTEDNI

SEQ ID NO: 286449 - protein, 8 aa, Influenza virus
LKTEDNIY

SEQ ID NO: 286450 - protein, 8 aa, Influenza virus
KTEDNIYK

SEQ ID NO: 286451 - protein, 8 aa, Influenza virus
TEDNVYKI

SEQ ID NO: 286452 - protein, 8 aa, Influenza virus
EDNVYKIL

SEQ ID NO: 286453 - protein, 8 aa, Influenza virus
DNVYKILS

SEQ ID NO: 286454 - protein, 8 aa, Influenza virus
NVYKILSI

SEQ ID NO: 286455 - protein, 8 aa, Influenza virus
VYKILSIY

SEQ ID NO: 286456 - protein, 8 aa, Influenza virus
YKVLSIYS

SEQ ID NO: 286457 - protein, 8 aa, Influenza virus
KVLSIYSC

SEQ ID NO: 286458 - protein, 8 aa, Influenza virus
VLSIYSCI

SEQ ID NO: 286459 - protein, 8 aa, Influenza virus
LAIYSCIA

SEQ ID NO: 286460 - protein, 8 aa, Influenza virus
AIYSCIAS

SEQ ID NO: 286461 - protein, 8 aa, Influenza virus
YSCIASST

SEQ ID NO: 286462 - protein, 8 aa, Influenza virus
SCIASSTV

SEQ ID NO: 286463 - protein, 8 aa, Influenza virus
CIASSIVL

SEQ ID NO: 286464 - protein, 8 aa, Influenza virus
IASSVVLV

SEQ ID NO: 286465 - protein, 8 aa, Influenza virus
ASSIVMVG

SEQ ID NO: 286466 - protein, 8 aa, Influenza virus
SSVVLVGL

SEQ ID NO: 286467 - protein, 8 aa, Influenza virus
SIVLVGLI

SEQ ID NO: 286468 - protein, 8 aa, Influenza virus
IVLVGLIL

SEQ ID NO: 286469 - protein, 8 aa, Influenza virus
VMVGLILA

SEQ ID NO: 286470 - protein, 8 aa, Influenza virus
MVGLILAF

SEQ ID NO: 286471 - protein, 8 aa, Influenza virus
GLILAFIL

SEQ ID NO: 286472 - protein, 8 aa, Influenza virus
LILAFILW

SEQ ID NO: 286473 - protein, 8 aa, Influenza virus
ILAFILWA

SEQ ID NO: 286474 - protein, 8 aa, Influenza virus
LAFILWAC

SEQ ID NO: 286475 - protein, 8 aa, Influenza virus
AFILWACS

SEQ ID NO: 286476 - protein, 8 aa, Influenza virus
FIMWACSN

SEQ ID NO: 286477 - protein, 8 aa, Influenza virus
IMWACSNG

SEQ ID NO: 286478 - protein, 8 aa, Influenza virus
MWACSNGS

SEQ ID NO: 286479 - protein, 8 aa, Influenza virus
WACSNGSC

SEQ ID NO: 286480 - protein, 8 aa, Influenza virus
ACSNGSCR

SEQ ID NO: 286481 - protein, 8 aa, Influenza virus
CSNGSCRF

SEQ ID NO: 286482 - protein, 8 aa, Influenza virus
SNGSCRFN

SEQ ID NO: 286483 - protein, 8 aa, Influenza virus
NGSCRFNV

SEQ ID NO: 286484 - protein, 8 aa, Influenza virus
GSCRFNVC

SEQ ID NO: 286485 - protein, 8 aa, Influenza virus
SCRFNVCI

SEQ ID NO: 286486 - protein, 8 aa, Influenza virus
KTKATKME

SEQ ID NO: 286487 - protein, 8 aa, Influenza virus
TKATKMEA

SEQ ID NO: 286488 - protein, 8 aa, Influenza virus
KATKMEAI

SEQ ID NO: 286489 - protein, 8 aa, Influenza virus
ATKMKAII

SEQ ID NO: 286490 - protein, 8 aa, Influenza virus
PNDGQVLY

SEQ ID NO: 286491 - protein, 8 aa, Influenza virus
SNAPSGVE

SEQ ID NO: 286492 - protein, 8 aa, Influenza virus
NAPSGVEY

SEQ ID NO: 286493 - protein, 8 aa, Influenza virus
APSGVEYN

SEQ ID NO: 286494 - protein, 8 aa, Influenza virus
PSGVEYNG

SEQ ID NO: 286495 - protein, 8 aa, Influenza virus
SGVEYNGK

SEQ ID NO: 286496 - protein, 8 aa, Influenza virus
GVEYNGKS

SEQ ID NO: 286497 - protein, 8 aa, Influenza virus
VEYNGKSL

SEQ ID NO: 286498 - protein, 8 aa, Influenza virus
AIAGFIEN

SEQ ID NO: 286499 - protein, 8 aa, Influenza virus
IAGFIENG

SEQ ID NO: 286500 - protein, 8 aa, Influenza virus
AGFIENGW

SEQ ID NO: 286501 - protein, 8 aa, Influenza virus
GFIEGGWP

SEQ ID NO: 286502 - protein, 8 aa, Influenza virus
FIEGGWPG

SEQ ID NO: 286503 - protein, 8 aa, Influenza virus
IEGGWPGL

SEQ ID NO: 286504 - protein, 8 aa, Influenza virus
EGGWTGMI

SEQ ID NO: 286505 - protein, 8 aa, Influenza virus
GGWTGMID

SEQ ID NO: 286506 - protein, 8 aa, Influenza virus
GWTGMIDG

SEQ ID NO: 286507 - protein, 8 aa, Influenza virus
WTGMIDGW

SEQ ID NO: 286508 - protein, 8 aa, Influenza virus
TGMIDGWY

SEQ ID NO: 286509 - protein, 8 aa, Influenza virus
GMIDGWYG

SEQ ID NO: 286510 - protein, 8 aa, Influenza virus
MIDGWYGY

SEQ ID NO: 286511 - protein, 8 aa, Influenza virus
IDGWYGYH

SEQ ID NO: 286512 - protein, 8 aa, Influenza virus
NGWYGFQH

SEQ ID NO: 286513 - protein, 8 aa, Influenza virus
GWYGFRHQ

SEQ ID NO: 286514 - protein, 8 aa, Influenza virus
WYGFRHQN

SEQ ID NO: 286515 - protein, 8 aa, Influenza virus
EGTGIAAD

SEQ ID NO: 286516 - protein, 8 aa, Influenza virus
WTYQAELL

SEQ ID NO: 286517 - protein, 8 aa, Influenza virus
YQAELLVA

SEQ ID NO: 286518 - protein, 8 aa, Influenza virus
QAELLVAM

SEQ ID NO: 286519 - protein, 8 aa, Influenza virus
AELLVAME

SEQ ID NO: 286520 - protein, 8 aa, Influenza virus
ELLVAMEN

SEQ ID NO: 286521 - protein, 8 aa, Influenza virus
LLVAMENQ

SEQ ID NO: 286522 - protein, 8 aa, Influenza virus
AMENQHTI

SEQ ID NO: 286523 - protein, 8 aa, Influenza virus
MENQHTID

SEQ ID NO: 286524 - protein, 8 aa, Influenza virus
GKGCFEIY

SEQ ID NO: 286525 - protein, 8 aa, Influenza virus
KGCFEIYH

SEQ ID NO: 286526 - protein, 8 aa, Influenza virus
LSIYSCIA

SEQ ID NO: 286527 - protein, 8 aa, Influenza virus
SIYSCIAS

SEQ ID NO: 286528 - protein, 8 aa, Influenza virus
IYSCIASS

SEQ ID NO: 286529 - protein, 8 aa, Influenza virus
CRICILDQ

SEQ ID NO: 286530 - protein, 8 aa, Influenza virus
RICIDFRD

SEQ ID NO: 286531 - protein, 8 aa, Influenza virus
ISLVKTTL

SEQ ID NO: 286532 - protein, 8 aa, Influenza virus
CILDQNFR

SEQ ID NO: 286533 - protein, 8 aa, Influenza virus
LVKTTLFL

SEQ ID NO: 286534 - protein, 8 aa, Influenza virus
LDQNFRNI

SEQ ID NO: 286535 - protein, 8 aa, Influenza virus
DQNFRNIR

SEQ ID NO: 286536 - protein, 8 aa, Influenza virus
QNFRNIRK

SEQ ID NO: 286537 - protein, 8 aa, Influenza virus
KTKATKME

SEQ ID NO: 286538 - protein, 8 aa, Influenza virus
TKATKMEA

SEQ ID NO: 286539 - protein, 8 aa, Influenza virus
KATKMEAI

SEQ ID NO: 286540 - protein, 8 aa, Influenza virus
ATKMKAII

SEQ ID NO: 286541 - protein, 8 aa, Influenza virus
TKMEAILV

SEQ ID NO: 286542 - protein, 8 aa, Influenza virus
KMEAILVV

SEQ ID NO: 286543 - protein, 8 aa, Influenza virus
ADTICIGY

SEQ ID NO: 286544 - protein, 8 aa, Influenza virus
DTICIGYH

SEQ ID NO: 286545 - protein, 8 aa, Influenza virus
TICIGYHA

SEQ ID NO: 286546 - protein, 8 aa, Influenza virus
ICIGYHAN

SEQ ID NO: 286547 - protein, 8 aa, Influenza virus
CVGYHANN

SEQ ID NO: 286548 - protein, 8 aa, Influenza virus
VGYHANNS

SEQ ID NO: 286549 - protein, 8 aa, Influenza virus
STDTVDTI

SEQ ID NO: 286550 - protein, 8 aa, Influenza virus
TDTVDTIL

SEQ ID NO: 286551 - protein, 8 aa, Influenza virus
DTVDTILE

SEQ ID NO: 286552 - protein, 8 aa, Influenza virus
TVDTILEK

SEQ ID NO: 286553 - protein, 8 aa, Influenza virus
VDTILEKN

SEQ ID NO: 286554 - protein, 8 aa, Influenza virus
DTILEKNV

SEQ ID NO: 286555 - protein, 8 aa, Influenza virus
TILEKNVT

SEQ ID NO: 286556 - protein, 8 aa, Influenza virus
ILEKNVTV

SEQ ID NO: 286557 - protein, 8 aa, Influenza virus
LERNVTVT

SEQ ID NO: 286558 - protein, 8 aa, Influenza virus
ERNVTVTH

SEQ ID NO: 286559 - protein, 8 aa, Influenza virus
RNVTVTHS

SEQ ID NO: 286560 - protein, 8 aa, Influenza virus
VTVTHSVD

SEQ ID NO: 286561 - protein, 8 aa, Influenza virus
TVTHSVNI

SEQ ID NO: 286562 - protein, 8 aa, Influenza virus
VTHSVNIL

SEQ ID NO: 286563 - protein, 8 aa, Influenza virus
THSVNILE

SEQ ID NO: 286564 - protein, 8 aa, Influenza virus
VAGWILGN

SEQ ID NO: 286565 - protein, 8 aa, Influenza virus
AGWLLGNP

SEQ ID NO: 286566 - protein, 8 aa, Influenza virus
GWLLGNPE

SEQ ID NO: 286567 - protein, 8 aa, Influenza virus
WLLGNPEC

SEQ ID NO: 286568 - protein, 8 aa, Influenza virus
LGNPECEL

SEQ ID NO: 286569 - protein, 8 aa, Influenza virus
SWSYIVEK

SEQ ID NO: 286570 - protein, 8 aa, Influenza virus
NYEELREQ

SEQ ID NO: 286571 - protein, 8 aa, Influenza virus
YEELKEQL

SEQ ID NO: 286572 - protein, 8 aa, Influenza virus
EELKEQLS

SEQ ID NO: 286573 - protein, 8 aa, Influenza virus
ELKEQLST

SEQ ID NO: 286574 - protein, 8 aa, Influenza virus
LKEQLSTV

SEQ ID NO: 286575 - protein, 8 aa, Influenza virus
KEQLSTVS

SEQ ID NO: 286576 - protein, 8 aa, Influenza virus
EQLSTVSS

SEQ ID NO: 286577 - protein, 8 aa, Influenza virus
QLSTVSSF

SEQ ID NO: 286578 - protein, 8 aa, Influenza virus
LSTVSSFE

SEQ ID NO: 286579 - protein, 8 aa, Influenza virus
SSVSSFEK

SEQ ID NO: 286580 - protein, 8 aa, Influenza virus
SVSSFEKF

SEQ ID NO: 286581 - protein, 8 aa, Influenza virus
VSSFEKFE

SEQ ID NO: 286582 - protein, 8 aa, Influenza virus
SSFEKFEI

SEQ ID NO: 286583 - protein, 8 aa, Influenza virus
SFEKFEIF

SEQ ID NO: 286584 - protein, 8 aa, Influenza virus
FEKFEIFP

SEQ ID NO: 286585 - protein, 8 aa, Influenza virus
EKFEIFPK

SEQ ID NO: 286586 - protein, 8 aa, Influenza virus
SFYRNLLW

SEQ ID NO: 286587 - protein, 8 aa, Influenza virus
FYRNLLWL

SEQ ID NO: 286588 - protein, 8 aa, Influenza virus
EKENSYPK

SEQ ID NO: 286589 - protein, 8 aa, Influenza virus
VLVLWGVH

SEQ ID NO: 286590 - protein, 8 aa, Influenza virus
LVLWGVHH

SEQ ID NO: 286591 - protein, 8 aa, Influenza virus
VLWGVHHP

SEQ ID NO: 286592 - protein, 8 aa, Influenza virus
GRINYYWT

SEQ ID NO: 286593 - protein, 8 aa, Influenza virus
RINYYWTL

SEQ ID NO: 286594 - protein, 8 aa, Influenza virus
PGDTIIFE

SEQ ID NO: 286595 - protein, 8 aa, Influenza virus
GDTIIFEA

SEQ ID NO: 286596 - protein, 8 aa, Influenza virus
DTIIFEAN

SEQ ID NO: 286597 - protein, 8 aa, Influenza virus
TIIFEANG

SEQ ID NO: 286598 - protein, 8 aa, Influenza virus
IIFEANGN

SEQ ID NO: 286599 - protein, 8 aa, Influenza virus
IFEANGNL

SEQ ID NO: 286600 - protein, 8 aa, Influenza virus
FEANGNLI

SEQ ID NO: 286601 - protein, 8 aa, Influenza virus
EANGNLIA

SEQ ID NO: 286602 - protein, 8 aa, Influenza virus
ANGNLIAP

SEQ ID NO: 286603 - protein, 8 aa, Influenza virus
GAINSSLP

SEQ ID NO: 286604 - protein, 8 aa, Influenza virus
NSSLPFQN

SEQ ID NO: 286605 - protein, 8 aa, Influenza virus
SLPFQNVH

SEQ ID NO: 286606 - protein, 8 aa, Influenza virus
LPFQNVHP

SEQ ID NO: 286607 - protein, 8 aa, Influenza virus
NVHPVTIG

SEQ ID NO: 286608 - protein, 8 aa, Influenza virus
HPVTIGEC

SEQ ID NO: 286609 - protein, 8 aa, Influenza virus
PVTIGECP

SEQ ID NO: 286610 - protein, 8 aa, Influenza virus
VTIGECPK

SEQ ID NO: 286611 - protein, 8 aa, Influenza virus
TIGECPKY

SEQ ID NO: 286612 - protein, 8 aa, Influenza virus
IGECPKYV

SEQ ID NO: 286613 - protein, 8 aa, Influenza virus
GECPKYVR

SEQ ID NO: 286614 - protein, 8 aa, Influenza virus
ECPKYVRS

SEQ ID NO: 286615 - protein, 8 aa, Influenza virus
CPKYVRSA

SEQ ID NO: 286616 - protein, 8 aa, Influenza virus
KLRMVTGL

SEQ ID NO: 286617 - protein, 8 aa, Influenza virus
LRMVTGLR

SEQ ID NO: 286618 - protein, 8 aa, Influenza virus
RMVTGLRN

SEQ ID NO: 286619 - protein, 8 aa, Influenza virus
MVTGLRNI

SEQ ID NO: 286620 - protein, 8 aa, Influenza virus
VTGLRNIP

SEQ ID NO: 286621 - protein, 8 aa, Influenza virus
TGLRNIPS

SEQ ID NO: 286622 - protein, 8 aa, Influenza virus
GLRNIPSI

SEQ ID NO: 286623 - protein, 8 aa, Influenza virus
LRNIPSIQ

SEQ ID NO: 286624 - protein, 8 aa, Influenza virus
RNIPSIQS

SEQ ID NO: 286625 - protein, 8 aa, Influenza virus
NIPSIQSR

SEQ ID NO: 286626 - protein, 8 aa, Influenza virus
IPSIQSRG

SEQ ID NO: 286627 - protein, 8 aa, Influenza virus
PSVQSRGL

SEQ ID NO: 286628 - protein, 8 aa, Influenza virus
SVQSRGLF

SEQ ID NO: 286629 - protein, 8 aa, Influenza virus
VQSRGLFG

SEQ ID NO: 286630 - protein, 8 aa, Influenza virus
EGGWTGMI

SEQ ID NO: 286631 - protein, 8 aa, Influenza virus
GGWTGMID

SEQ ID NO: 286632 - protein, 8 aa, Influenza virus
GWTGMIDG

SEQ ID NO: 286633 - protein, 8 aa, Influenza virus
WTGMIDGW

SEQ ID NO: 286634 - protein, 8 aa, Influenza virus
TGMIDGWY

SEQ ID NO: 286635 - protein, 8 aa, Influenza virus
GMIDGWYG

SEQ ID NO: 286636 - protein, 8 aa, Influenza virus
MIDGWYGY

SEQ ID NO: 286637 - protein, 8 aa, Influenza virus
IDGWYGYH

SEQ ID NO: 286638 - protein, 8 aa, Influenza virus
YGYHHQNG

SEQ ID NO: 286639 - protein, 8 aa, Influenza virus
GYHHQNGQ

SEQ ID NO: 286640 - protein, 8 aa, Influenza virus
YHHQNGQG

SEQ ID NO: 286641 - protein, 8 aa, Influenza virus
HHQNGQGS

SEQ ID NO: 286642 - protein, 8 aa, Influenza virus
HQNGQGSG

SEQ ID NO: 286643 - protein, 8 aa, Influenza virus
QNGQGSGY

SEQ ID NO: 286644 - protein, 8 aa, Influenza virus
NGQGSGYA

SEQ ID NO: 286645 - protein, 8 aa, Influenza virus
GQGSGYAA

SEQ ID NO: 286646 - protein, 8 aa, Influenza virus
GSGYAADQ

SEQ ID NO: 286647 - protein, 8 aa, Influenza virus
SGYAADQK

SEQ ID NO: 286648 - protein, 8 aa, Influenza virus
GYAADQKS

SEQ ID NO: 286649 - protein, 8 aa, Influenza virus
YAADQKST

SEQ ID NO: 286650 - protein, 8 aa, Influenza virus
AADQKSTQ

SEQ ID NO: 286651 - protein, 8 aa, Influenza virus
KSTQNAIN

SEQ ID NO: 286652 - protein, 8 aa, Influenza virus
NGITNKVN

SEQ ID NO: 286653 - protein, 8 aa, Influenza virus
GITNKVNS

SEQ ID NO: 286654 - protein, 8 aa, Influenza virus
ISNKVNSV

SEQ ID NO: 286655 - protein, 8 aa, Influenza virus
SNKVNSVI

SEQ ID NO: 286656 - protein, 8 aa, Influenza virus
NKVNSIIE

SEQ ID NO: 286657 - protein, 8 aa, Influenza virus
KVNSIIEK

SEQ ID NO: 286658 - protein, 8 aa, Influenza virus
VNSIIEKM

SEQ ID NO: 286659 - protein, 8 aa, Influenza virus
NSIIEKMN

SEQ ID NO: 286660 - protein, 8 aa, Influenza virus
SVIEKMNI

SEQ ID NO: 286661 - protein, 8 aa, Influenza virus
VIEKMNIQ

SEQ ID NO: 286662 - protein, 8 aa, Influenza virus
IEKMNIQF

SEQ ID NO: 286663 - protein, 8 aa, Influenza virus
EKMNIQFT

SEQ ID NO: 286664 - protein, 8 aa, Influenza virus
KMNIQFTS

SEQ ID NO: 286665 - protein, 8 aa, Influenza virus
MNIQFTSV

SEQ ID NO: 286666 - protein, 8 aa, Influenza virus
NIQFTSVG

SEQ ID NO: 286667 - protein, 8 aa, Influenza virus
IQFTSVGK

SEQ ID NO: 286668 - protein, 8 aa, Influenza virus
QFTSVGKE

SEQ ID NO: 286669 - protein, 8 aa, Influenza virus
FTSVGKEF

SEQ ID NO: 286670 - protein, 8 aa, Influenza virus
TAVGKEFS

SEQ ID NO: 286671 - protein, 8 aa, Influenza virus
LERRMENL

SEQ ID NO: 286672 - protein, 8 aa, Influenza virus
ERRMENLN

SEQ ID NO: 286673 - protein, 8 aa, Influenza virus
RMENLNKK

SEQ ID NO: 286674 - protein, 8 aa, Influenza virus
MENLNKKV

SEQ ID NO: 286675 - protein, 8 aa, Influenza virus
ENLNKKID

SEQ ID NO: 286676 - protein, 8 aa, Influenza virus
NLNKKIDD

SEQ ID NO: 286677 - protein, 8 aa, Influenza virus
LNKKIDDG

SEQ ID NO: 286678 - protein, 8 aa, Influenza virus
NKKIDDGF

SEQ ID NO: 286679 - protein, 8 aa, Influenza virus
KKVDDGFI

SEQ ID NO: 286680 - protein, 8 aa, Influenza virus
KVDDGFID

SEQ ID NO: 286681 - protein, 8 aa, Influenza virus
DDGFIDIW

SEQ ID NO: 286682 - protein, 8 aa, Influenza virus
DGFIDIWT

SEQ ID NO: 286683 - protein, 8 aa, Influenza virus
GFIDIWTY

SEQ ID NO: 286684 - protein, 8 aa, Influenza virus
FIDIWTYN

SEQ ID NO: 286685 - protein, 8 aa, Influenza virus
IDIWTYNA

SEQ ID NO: 286686 - protein, 8 aa, Influenza virus
DVWTYNAE

SEQ ID NO: 286687 - protein, 8 aa, Influenza virus
VWTYNAEL

SEQ ID NO: 286688 - protein, 8 aa, Influenza virus
TYNAELLI

SEQ ID NO: 286689 - protein, 8 aa, Influenza virus
YNAELLIL

SEQ ID NO: 286690 - protein, 8 aa, Influenza virus
NAELLILL

SEQ ID NO: 286691 - protein, 8 aa, Influenza virus
AELLILLE

SEQ ID NO: 286692 - protein, 8 aa, Influenza virus
ELLILLEN

SEQ ID NO: 286693 - protein, 8 aa, Influenza virus
LLILLENE

SEQ ID NO: 286694 - protein, 8 aa, Influenza virus
LILLENER

SEQ ID NO: 286695 - protein, 8 aa, Influenza virus
ILLENERT

SEQ ID NO: 286696 - protein, 8 aa, Influenza virus
ENERTLDF

SEQ ID NO: 286697 - protein, 8 aa, Influenza virus
NERTLDFH

SEQ ID NO: 286698 - protein, 8 aa, Influenza virus
ERTLDFHD

SEQ ID NO: 286699 - protein, 8 aa, Influenza virus
RTLDFHDS

SEQ ID NO: 286700 - protein, 8 aa, Influenza virus
QLRNNAKE

SEQ ID NO: 286701 - protein, 8 aa, Influenza virus
NNAKELGN

SEQ ID NO: 286702 - protein, 8 aa, Influenza virus
NAKELGNG

SEQ ID NO: 286703 - protein, 8 aa, Influenza virus
AKELGNGC

SEQ ID NO: 286704 - protein, 8 aa, Influenza virus
KELGNGCF

SEQ ID NO: 286705 - protein, 8 aa, Influenza virus
ELGNGCFE

SEQ ID NO: 286706 - protein, 8 aa, Influenza virus
LGNGCFEF

SEQ ID NO: 286707 - protein, 8 aa, Influenza virus
FEFYHKCN

SEQ ID NO: 286708 - protein, 8 aa, Influenza virus
EFYHKCND

SEQ ID NO: 286709 - protein, 8 aa, Influenza virus
CMESVRNG

SEQ ID NO: 286710 - protein, 8 aa, Influenza virus
MESVRNGT

SEQ ID NO: 286711 - protein, 8 aa, Influenza virus
ESVRNGTY

SEQ ID NO: 286712 - protein, 8 aa, Influenza virus
SVKNGTYN

SEQ ID NO: 286713 - protein, 8 aa, Influenza virus
VKNGTYNY

SEQ ID NO: 286714 - protein, 8 aa, Influenza virus
KNGTYNYP

SEQ ID NO: 286715 - protein, 8 aa, Influenza virus
NGTYNYPK

SEQ ID NO: 286716 - protein, 8 aa, Influenza virus
GTYNYPKY

SEQ ID NO: 286717 - protein, 8 aa, Influenza virus
TYNYPKYS

SEQ ID NO: 286718 - protein, 8 aa, Influenza virus
YNYPKYSE

SEQ ID NO: 286719 - protein, 8 aa, Influenza virus
NYPKYSEE

SEQ ID NO: 286720 - protein, 8 aa, Influenza virus
YPKYSEES

SEQ ID NO: 286721 - protein, 8 aa, Influenza virus
PKYSEESK

SEQ ID NO: 286722 - protein, 8 aa, Influenza virus
KYSEESKL

SEQ ID NO: 286723 - protein, 8 aa, Influenza virus
INGVKLDS

SEQ ID NO: 286724 - protein, 8 aa, Influenza virus
VYQILAIY

SEQ ID NO: 286725 - protein, 8 aa, Influenza virus
HQILAIYS

SEQ ID NO: 286726 - protein, 8 aa, Influenza virus
ILAIYSTA

SEQ ID NO: 286727 - protein, 8 aa, Influenza virus
LAIYSTAA

SEQ ID NO: 286728 - protein, 8 aa, Influenza virus
AIYSTAAS

SEQ ID NO: 286729 - protein, 8 aa, Influenza virus
IYSTAASS

SEQ ID NO: 286730 - protein, 8 aa, Influenza virus
YSTAASSL

SEQ ID NO: 286731 - protein, 8 aa, Influenza virus
STAASSLV

SEQ ID NO: 286732 - protein, 8 aa, Influenza virus
TAASSLVL

SEQ ID NO: 286733 - protein, 8 aa, Influenza virus
ASSLVLLV

SEQ ID NO: 286734 - protein, 8 aa, Influenza virus
SSLVLLVS

SEQ ID NO: 286735 - protein, 8 aa, Influenza virus
SLVLLVSL

SEQ ID NO: 286736 - protein, 8 aa, Influenza virus
LVLLVSLG

SEQ ID NO: 286737 - protein, 8 aa, Influenza virus
VLLVSLGA

SEQ ID NO: 286738 - protein, 8 aa, Influenza virus
LLVSLGAI

SEQ ID NO: 286739 - protein, 8 aa, Influenza virus
LVSLGAIS

SEQ ID NO: 286740 - protein, 8 aa, Influenza virus
VSLGAVSF

SEQ ID NO: 286741 - protein, 8 aa, Influenza virus
SLGAVSFW

SEQ ID NO: 286742 - protein, 8 aa, Influenza virus
ISFWMCSG

SEQ ID NO: 286743 - protein, 8 aa, Influenza virus
SFWMCSGH

SEQ ID NO: 286744 - protein, 8 aa, Influenza virus
FWMCSGHS

SEQ ID NO: 286745 - protein, 8 aa, Influenza virus
MCSNGSLR

SEQ ID NO: 286746 - protein, 8 aa, Influenza virus
CSNGSLRC

SEQ ID NO: 286747 - protein, 8 aa, Influenza virus
SNGSLRCR

SEQ ID NO: 286748 - protein, 8 aa, Influenza virus
NGSLQCRV

SEQ ID NO: 286749 - protein, 8 aa, Influenza virus
GSLQCRVC

SEQ ID NO: 286750 - protein, 8 aa, Influenza virus
SLQCRVCI

SEQ ID NO: 286751 - protein, 8 aa, Influenza virus
CRICILDQ

SEQ ID NO: 286752 - protein, 8 aa, Influenza virus
RICIDFRD

SEQ ID NO: 286753 - protein, 8 aa, Influenza virus
ICILDQNF

SEQ ID NO: 286754 - protein, 8 aa, Influenza virus
CIDFRDMR

SEQ ID NO: 286755 - protein, 8 aa, Influenza virus
ILDQNFRN

SEQ ID NO: 286756 - protein, 8 aa, Influenza virus
LDQNFRNI

SEQ ID NO: 286757 - protein, 8 aa, Influenza virus
DQNFRNIR

SEQ ID NO: 286758 - protein, 8 aa, Influenza virus
QNFRNIRK

SEQ ID NO: 286759 - protein, 8 aa, Influenza virus
GWAIYTKD

SEQ ID NO: 286760 - protein, 8 aa, Influenza virus
WAIYTKDN

SEQ ID NO: 286761 - protein, 8 aa, Influenza virus
AIYTKDNS

SEQ ID NO: 286762 - protein, 8 aa, Influenza virus
YTKDNSIR

SEQ ID NO: 286763 - protein, 8 aa, Influenza virus
TKDNSIRI

SEQ ID NO: 286764 - protein, 8 aa, Influenza virus
KDNSVRIG

SEQ ID NO: 286765 - protein, 8 aa, Influenza virus
DNSVRIGS

SEQ ID NO: 286766 - protein, 8 aa, Influenza virus
NSVRIGSK

SEQ ID NO: 286767 - protein, 8 aa, Influenza virus
SVRIGSKG

SEQ ID NO: 286768 - protein, 8 aa, Influenza virus
VRIGSKGD

SEQ ID NO: 286769 - protein, 8 aa, Influenza virus
RIGSKGDI

SEQ ID NO: 286770 - protein, 8 aa, Influenza virus
IGSKGDIF

SEQ ID NO: 286771 - protein, 8 aa, Influenza virus
GSKGDIFV

SEQ ID NO: 286772 - protein, 8 aa, Influenza virus
SKGDIFVI

SEQ ID NO: 286773 - protein, 8 aa, Influenza virus
KGDIFVIR

SEQ ID NO: 286774 - protein, 8 aa, Influenza virus
GDIFVIRE

SEQ ID NO: 286775 - protein, 8 aa, Influenza virus
DIFVIREP

SEQ ID NO: 286776 - protein, 8 aa, Influenza virus
IFVIREPF

SEQ ID NO: 286777 - protein, 8 aa, Influenza virus
FVMREPFI

SEQ ID NO: 286778 - protein, 8 aa, Influenza virus
VMREPFIS

SEQ ID NO: 286779 - protein, 8 aa, Influenza virus
MREPFISC

SEQ ID NO: 286780 - protein, 8 aa, Influenza virus
EPFISCSH

SEQ ID NO: 286781 - protein, 8 aa, Influenza virus
PFISCSHL

SEQ ID NO: 286782 - protein, 8 aa, Influenza virus
FISCSHLE

SEQ ID NO: 286783 - protein, 8 aa, Influenza virus
ISCSHLEC

SEQ ID NO: 286784 - protein, 8 aa, Influenza virus
SCSHLECR

SEQ ID NO: 286785 - protein, 8 aa, Influenza virus
HLECRTFF

SEQ ID NO: 286786 - protein, 8 aa, Influenza virus
LECKTFFL

SEQ ID NO: 286787 - protein, 8 aa, Influenza virus
ECKTFFLT

SEQ ID NO: 286788 - protein, 8 aa, Influenza virus
CKTFFLTQ

SEQ ID NO: 286789 - protein, 8 aa, Influenza virus
KTFFLTQG

SEQ ID NO: 286790 - protein, 8 aa, Influenza virus
QGALLNDR

SEQ ID NO: 286791 - protein, 8 aa, Influenza virus
GALLNDRH

SEQ ID NO: 286792 - protein, 8 aa, Influenza virus
ALLNDRHS

SEQ ID NO: 286793 - protein, 8 aa, Influenza virus
LLNDRHSN

SEQ ID NO: 286794 - protein, 8 aa, Influenza virus
LNDRHSNG

SEQ ID NO: 286795 - protein, 8 aa, Influenza virus
NDRHSNGT

SEQ ID NO: 286796 - protein, 8 aa, Influenza virus
DKHSNGTV

SEQ ID NO: 286797 - protein, 8 aa, Influenza virus
KHSNGTVK

SEQ ID NO: 286798 - protein, 8 aa, Influenza virus
HSNGTVKD

SEQ ID NO: 286799 - protein, 8 aa, Influenza virus
SNGTVKDR

SEQ ID NO: 286800 - protein, 8 aa, Influenza virus
NGTVKDRS

SEQ ID NO: 286801 - protein, 8 aa, Influenza virus
GTVKDRSP

SEQ ID NO: 286802 - protein, 8 aa, Influenza virus
KDRSPYRA

SEQ ID NO: 286803 - protein, 8 aa, Influenza virus
DRSPYRAL

SEQ ID NO: 286804 - protein, 8 aa, Influenza virus
RSPYRALM

SEQ ID NO: 286805 - protein, 8 aa, Influenza virus
SPYRALMS

SEQ ID NO: 286806 - protein, 8 aa, Influenza virus
PYRALMSC

SEQ ID NO: 286807 - protein, 8 aa, Influenza virus
YRALMSCP

SEQ ID NO: 286808 - protein, 8 aa, Influenza virus
RALMSCPL

SEQ ID NO: 286809 - protein, 8 aa, Influenza virus
ALMSCPLG

SEQ ID NO: 286810 - protein, 8 aa, Influenza virus
LMSCPLGE

SEQ ID NO: 286811 - protein, 8 aa, Influenza virus
MSCPLGEA

SEQ ID NO: 286812 - protein, 8 aa, Influenza virus
SCPLGEAP

SEQ ID NO: 286813 - protein, 8 aa, Influenza virus
CPLGEAPS

SEQ ID NO: 286814 - protein, 8 aa, Influenza virus
PLGEAPSP

SEQ ID NO: 286815 - protein, 8 aa, Influenza virus
LGEAPSPY

SEQ ID NO: 286816 - protein, 8 aa, Influenza virus
GEAPSPYN

SEQ ID NO: 286817 - protein, 8 aa, Influenza virus
EAPSPYNS

SEQ ID NO: 286818 - protein, 8 aa, Influenza virus
APSPYNSK

SEQ ID NO: 286819 - protein, 8 aa, Influenza virus
PSPYNSKF

SEQ ID NO: 286820 - protein, 8 aa, Influenza virus
SPYNSKFE

SEQ ID NO: 286821 - protein, 8 aa, Influenza virus
PYNSKFES

SEQ ID NO: 286822 - protein, 8 aa, Influenza virus
YNSKFESV

SEQ ID NO: 286823 - protein, 8 aa, Influenza virus
NSKFESVA

SEQ ID NO: 286824 - protein, 8 aa, Influenza virus
SKFESVAW

SEQ ID NO: 286825 - protein, 8 aa, Influenza virus
KFESVAWS

SEQ ID NO: 286826 - protein, 8 aa, Influenza virus
ASACHDGM

SEQ ID NO: 286827 - protein, 8 aa, Influenza virus
GWLTIGIS

SEQ ID NO: 286828 - protein, 8 aa, Influenza virus
WITIGISG

SEQ ID NO: 286829 - protein, 8 aa, Influenza virus
ITIGISGP

SEQ ID NO: 286830 - protein, 8 aa, Influenza virus
IGISGPDD

SEQ ID NO: 286831 - protein, 8 aa, Influenza virus
GISGPDDG

SEQ ID NO: 286832 - protein, 8 aa, Influenza virus
ISGPDDGA

SEQ ID NO: 286833 - protein, 8 aa, Influenza virus
SGPDDGAV

SEQ ID NO: 286834 - protein, 8 aa, Influenza virus
GPDDGAVA

SEQ ID NO: 286835 - protein, 8 aa, Influenza virus
PDDGAVAV

SEQ ID NO: 286836 - protein, 8 aa, Influenza virus
DDGAVAVL

SEQ ID NO: 286837 - protein, 8 aa, Influenza virus
DGAVAVLK

SEQ ID NO: 286838 - protein, 8 aa, Influenza virus
VAVLKYKG

SEQ ID NO: 286839 - protein, 8 aa, Influenza virus
AVLKYKGI

SEQ ID NO: 286840 - protein, 8 aa, Influenza virus
VLKYKGII

SEQ ID NO: 286841 - protein, 8 aa, Influenza virus
LKYKGIIT

SEQ ID NO: 286842 - protein, 8 aa, Influenza virus
KYNGIITG

SEQ ID NO: 286843 - protein, 8 aa, Influenza virus
YNGIITGT

SEQ ID NO: 286844 - protein, 8 aa, Influenza virus
GIITGTIK

SEQ ID NO: 286845 - protein, 8 aa, Influenza virus
IITGTIKS

SEQ ID NO: 286846 - protein, 8 aa, Influenza virus
ITGTIKSW

SEQ ID NO: 286847 - protein, 8 aa, Influenza virus
QILRTQES

SEQ ID NO: 286848 - protein, 8 aa, Influenza virus
RTQESECV

SEQ ID NO: 286849 - protein, 8 aa, Influenza virus
TQESECVC

SEQ ID NO: 286850 - protein, 8 aa, Influenza virus
QESECVCM

SEQ ID NO: 286851 - protein, 8 aa, Influenza virus
ESECVCMN

SEQ ID NO: 286852 - protein, 8 aa, Influenza virus
SECVCMNG

SEQ ID NO: 286853 - protein, 8 aa, Influenza virus
ECVCMNGS

SEQ ID NO: 286854 - protein, 8 aa, Influenza virus
CVCMNGSC

SEQ ID NO: 286855 - protein, 8 aa, Influenza virus
CMNGSCFT

SEQ ID NO: 286856 - protein, 8 aa, Influenza virus
NGSCFTIM

SEQ ID NO: 286857 - protein, 8 aa, Influenza virus
GSCFTIMT

SEQ ID NO: 286858 - protein, 8 aa, Influenza virus
SCFTIMTD

SEQ ID NO: 286859 - protein, 8 aa, Influenza virus
CFTIMTDG

SEQ ID NO: 286860 - protein, 8 aa, Influenza virus
FTIMTDGP

SEQ ID NO: 286861 - protein, 8 aa, Influenza virus
TIMTDGPS

SEQ ID NO: 286862 - protein, 8 aa, Influenza virus
APNFHYEE

SEQ ID NO: 286863 - protein, 8 aa, Influenza virus
PNFHYEEC

SEQ ID NO: 286864 - protein, 8 aa, Influenza virus
NFHYEECS

SEQ ID NO: 286865 - protein, 8 aa, Influenza virus
FHYEECSC

SEQ ID NO: 286866 - protein, 8 aa, Influenza virus
YYEECSCY

SEQ ID NO: 286867 - protein, 8 aa, Influenza virus
EECSCYPE

SEQ ID NO: 286868 - protein, 8 aa, Influenza virus
ECSCYPDT

SEQ ID NO: 286869 - protein, 8 aa, Influenza virus
VMCVCRDN

SEQ ID NO: 286870 - protein, 8 aa, Influenza virus
MCVCRDNW

SEQ ID NO: 286871 - protein, 8 aa, Influenza virus
VCRDNWHA

SEQ ID NO: 286872 - protein, 8 aa, Influenza virus
CRDNWHAS

SEQ ID NO: 286873 - protein, 8 aa, Influenza virus
RDNWHASN

SEQ ID NO: 286874 - protein, 8 aa, Influenza virus
DNWHASNR

SEQ ID NO: 286875 - protein, 8 aa, Influenza virus
NWHASNRP

SEQ ID NO: 286876 - protein, 8 aa, Influenza virus
WHASNRPW

SEQ ID NO: 286877 - protein, 8 aa, Influenza virus
HASNRPWV

SEQ ID NO: 286878 - protein, 8 aa, Influenza virus
ASNRPWVS

SEQ ID NO: 286879 - protein, 8 aa, Influenza virus
SNRPWISF

SEQ ID NO: 286880 - protein, 8 aa, Influenza virus
NRPWVSFD

SEQ ID NO: 286881 - protein, 8 aa, Influenza virus
RPWVSFDQ

SEQ ID NO: 286882 - protein, 8 aa, Influenza virus
PWVSFDQN

SEQ ID NO: 286883 - protein, 8 aa, Influenza virus
WVSFDQNL

SEQ ID NO: 286884 - protein, 8 aa, Influenza virus
YQMGYICS

SEQ ID NO: 286885 - protein, 8 aa, Influenza virus
QMGYICSG

SEQ ID NO: 286886 - protein, 8 aa, Influenza virus
IGYICSGV

SEQ ID NO: 286887 - protein, 8 aa, Influenza virus
GYICSGVF

SEQ ID NO: 286888 - protein, 8 aa, Influenza virus
YICSGVFG

SEQ ID NO: 286889 - protein, 8 aa, Influenza virus
ICSGVFGD

SEQ ID NO: 286890 - protein, 8 aa, Influenza virus
CSGVFGDN

SEQ ID NO: 286891 - protein, 8 aa, Influenza virus
SGVFGDNP

SEQ ID NO: 286892 - protein, 8 aa, Influenza virus
GVFGDNPR

SEQ ID NO: 286893 - protein, 8 aa, Influenza virus
VFGDNPRP

SEQ ID NO: 286894 - protein, 8 aa, Influenza virus
GDNPRPKD

SEQ ID NO: 286895 - protein, 8 aa, Influenza virus
GADGVKGF

SEQ ID NO: 286896 - protein, 8 aa, Influenza virus
ADGVKGFS

SEQ ID NO: 286897 - protein, 8 aa, Influenza virus
NGVKGFSY

SEQ ID NO: 286898 - protein, 8 aa, Influenza virus
GVKGFSYK

SEQ ID NO: 286899 - protein, 8 aa, Influenza virus
VKGFSYKY

SEQ ID NO: 286900 - protein, 8 aa, Influenza virus
KGFSYKYG

SEQ ID NO: 286901 - protein, 8 aa, Influenza virus
GFSYKYGN

SEQ ID NO: 286902 - protein, 8 aa, Influenza virus
FSYKYGNG

SEQ ID NO: 286903 - protein, 8 aa, Influenza virus
SYKYGNGV

SEQ ID NO: 286904 - protein, 8 aa, Influenza virus
YKYGNGVW

SEQ ID NO: 286905 - protein, 8 aa, Influenza virus
RYGNGVWI

SEQ ID NO: 286906 - protein, 8 aa, Influenza virus
YDNGVWIG

SEQ ID NO: 286907 - protein, 8 aa, Influenza virus
DNGVWIGR

SEQ ID NO: 286908 - protein, 8 aa, Influenza virus
NGVWMGRT

SEQ ID NO: 286909 - protein, 8 aa, Influenza virus
WIGRTKSN

SEQ ID NO: 286910 - protein, 8 aa, Influenza virus
FEMIWDPD

SEQ ID NO: 286911 - protein, 8 aa, Influenza virus
EMIWDPDG

SEQ ID NO: 286912 - protein, 8 aa, Influenza virus
MIWDPDGW

SEQ ID NO: 286913 - protein, 8 aa, Influenza virus
IWDPDGWT

SEQ ID NO: 286914 - protein, 8 aa, Influenza virus
TDWSGYSG

SEQ ID NO: 286915 - protein, 8 aa, Influenza virus
DWSGYSGS

SEQ ID NO: 286916 - protein, 8 aa, Influenza virus
QHPELTGM

SEQ ID NO: 286917 - protein, 8 aa, Influenza virus
HPELTGMN

SEQ ID NO: 286918 - protein, 8 aa, Influenza virus
PELTGMNC

SEQ ID NO: 286919 - protein, 8 aa, Influenza virus
ELTGLDCM

SEQ ID NO: 286920 - protein, 8 aa, Influenza virus
DCMRPCFW

SEQ ID NO: 286921 - protein, 8 aa, Influenza virus
CMRPCFWV

SEQ ID NO: 286922 - protein, 8 aa, Influenza virus
MRPCFWVE

SEQ ID NO: 286923 - protein, 8 aa, Influenza virus
KPCFWVEL

SEQ ID NO: 286924 - protein, 8 aa, Influenza virus
PCFWVELV

SEQ ID NO: 286925 - protein, 8 aa, Influenza virus
CFWVELVR

SEQ ID NO: 286926 - protein, 8 aa, Influenza virus
FWVELVRG

SEQ ID NO: 286927 - protein, 8 aa, Influenza virus
WVELVRGL

SEQ ID NO: 286928 - protein, 8 aa, Influenza virus
VELVRGLP

SEQ ID NO: 286929 - protein, 8 aa, Influenza virus
ATIWTSGS

SEQ ID NO: 286930 - protein, 8 aa, Influenza virus
TIWASGSS

SEQ ID NO: 286931 - protein, 8 aa, Influenza virus
IWASGSSI

SEQ ID NO: 286932 - protein, 8 aa, Influenza virus
WASGSSIS

SEQ ID NO: 286933 - protein, 8 aa, Influenza virus
ASGSSISF

SEQ ID NO: 286934 - protein, 8 aa, Influenza virus
SGSIISFC

SEQ ID NO: 286935 - protein, 8 aa, Influenza virus
ASSISFCG

SEQ ID NO: 286936 - protein, 8 aa, Influenza virus
SISFCGVD

SEQ ID NO: 286937 - protein, 8 aa, Influenza virus
ISFCGVDS

SEQ ID NO: 286938 - protein, 8 aa, Influenza virus
NWSWPDGA

SEQ ID NO: 286939 - protein, 8 aa, Influenza virus
WSWPDGAD

SEQ ID NO: 286940 - protein, 8 aa, Influenza virus
SWPDGADL

SEQ ID NO: 286941 - protein, 8 aa, Influenza virus
WPDGADLP

SEQ ID NO: 286942 - protein, 8 aa, Influenza virus
PDGADLPF

SEQ ID NO: 286943 - protein, 8 aa, Influenza virus
DGADLPFT

SEQ ID NO: 286944 - protein, 8 aa, Influenza virus
GADLPFTI

SEQ ID NO: 286945 - protein, 8 aa, Influenza virus
DTLCIGYH

SEQ ID NO: 286946 - protein, 8 aa, Influenza virus
TLCIGYHA

SEQ ID NO: 286947 - protein, 8 aa, Influenza virus
LCIGYHAN

SEQ ID NO: 286948 - protein, 8 aa, Influenza virus
CVGYHANN

SEQ ID NO: 286949 - protein, 8 aa, Influenza virus
VGYHANNS

SEQ ID NO: 286950 - protein, 8 aa, Influenza virus
YHANNSTE

SEQ ID NO: 286951 - protein, 8 aa, Influenza virus
HANNSTET

SEQ ID NO: 286952 - protein, 8 aa, Influenza virus
ANNSTETV

SEQ ID NO: 286953 - protein, 8 aa, Influenza virus
NNSTETVD

SEQ ID NO: 286954 - protein, 8 aa, Influenza virus
NSTETVDT

SEQ ID NO: 286955 - protein, 8 aa, Influenza virus
KKNVTVTH

SEQ ID NO: 286956 - protein, 8 aa, Influenza virus
KNITVTHS

SEQ ID NO: 286957 - protein, 8 aa, Influenza virus
NITVTHSV

SEQ ID NO: 286958 - protein, 8 aa, Influenza virus
ITVTHSVN

SEQ ID NO: 286959 - protein, 8 aa, Influenza virus
TVTHSINL

SEQ ID NO: 286960 - protein, 8 aa, Influenza virus
VTHSINLL

SEQ ID NO: 286961 - protein, 8 aa, Influenza virus
THSINLLE

SEQ ID NO: 286962 - protein, 8 aa, Influenza virus
HNGKLCKL

SEQ ID NO: 286963 - protein, 8 aa, Influenza virus
IAGWLLGN

SEQ ID NO: 286964 - protein, 8 aa, Influenza virus
AGWLLGNP

SEQ ID NO: 286965 - protein, 8 aa, Influenza virus
GWLLGNPE

SEQ ID NO: 286966 - protein, 8 aa, Influenza virus
WLLGNPEC

SEQ ID NO: 286967 - protein, 8 aa, Influenza virus
NYEELREQ

SEQ ID NO: 286968 - protein, 8 aa, Influenza virus
YEELREHL

SEQ ID NO: 286969 - protein, 8 aa, Influenza virus
EELREHLS

SEQ ID NO: 286970 - protein, 8 aa, Influenza virus
GRMNYYWT

SEQ ID NO: 286971 - protein, 8 aa, Influenza virus
LPFQNIHP

SEQ ID NO: 286972 - protein, 8 aa, Influenza virus
PFQNIHPV

SEQ ID NO: 286973 - protein, 8 aa, Influenza virus
FQNIHPVT

SEQ ID NO: 286974 - protein, 8 aa, Influenza virus
QNIHPVTI

SEQ ID NO: 286975 - protein, 8 aa, Influenza virus
NIHPVTIG

SEQ ID NO: 286976 - protein, 8 aa, Influenza virus
HPITIGEC

SEQ ID NO: 286977 - protein, 8 aa, Influenza virus
PITIGECP

SEQ ID NO: 286978 - protein, 8 aa, Influenza virus
ITIGECPK

SEQ ID NO: 286979 - protein, 8 aa, Influenza virus
TIGKCPKY

SEQ ID NO: 286980 - protein, 8 aa, Influenza virus
IGKCPKYV

SEQ ID NO: 286981 - protein, 8 aa, Influenza virus
GECPKYVR

SEQ ID NO: 286982 - protein, 8 aa, Influenza virus
ECPKYVRS

SEQ ID NO: 286983 - protein, 8 aa, Influenza virus
LRMATGLR

SEQ ID NO: 286984 - protein, 8 aa, Influenza virus
RMATGLRN

SEQ ID NO: 286985 - protein, 8 aa, Influenza virus
TGLRNVPS

SEQ ID NO: 286986 - protein, 8 aa, Influenza virus
GLRNVPSI

SEQ ID NO: 286987 - protein, 8 aa, Influenza virus
PSIHSRGL

SEQ ID NO: 286988 - protein, 8 aa, Influenza virus
SVQSRGLF

SEQ ID NO: 286989 - protein, 8 aa, Influenza virus
IQTRGLFG

SEQ ID NO: 286990 - protein, 8 aa, Influenza virus
QTRGLFGA

SEQ ID NO: 286991 - protein, 8 aa, Influenza virus
TRGLFGAI

SEQ ID NO: 286992 - protein, 8 aa, Influenza virus
EGGWTGMV

SEQ ID NO: 286993 - protein, 8 aa, Influenza virus
GGWTGMVD

SEQ ID NO: 286994 - protein, 8 aa, Influenza virus
GWTGMVDG

SEQ ID NO: 286995 - protein, 8 aa, Influenza virus
WTGMVDGW

SEQ ID NO: 286996 - protein, 8 aa, Influenza virus
TGMVDGWY

SEQ ID NO: 286997 - protein, 8 aa, Influenza virus
GMVDGWYG

SEQ ID NO: 286998 - protein, 8 aa, Influenza virus
MVDGWYGY

SEQ ID NO: 286999 - protein, 8 aa, Influenza virus
NEQGSGFA

SEQ ID NO: 287000 - protein, 8 aa, Influenza virus
EQGSGFAA

SEQ ID NO: 287001 - protein, 8 aa, Influenza virus
QGSGFAAD

SEQ ID NO: 287002 - protein, 8 aa, Influenza virus
TNKVNSII

SEQ ID NO: 287003 - protein, 8 aa, Influenza virus
ENLNKKID

SEQ ID NO: 287004 - protein, 8 aa, Influenza virus
NLNKKIDD

SEQ ID NO: 287005 - protein, 8 aa, Influenza virus
LNNKVDDG

SEQ ID NO: 287006 - protein, 8 aa, Influenza virus
NKKVDDGL

SEQ ID NO: 287007 - protein, 8 aa, Influenza virus
KVDDGLLD

SEQ ID NO: 287008 - protein, 8 aa, Influenza virus
DVWTYNAE

SEQ ID NO: 287009 - protein, 8 aa, Influenza virus
VWTYNAEL

SEQ ID NO: 287010 - protein, 8 aa, Influenza virus
TYNAELLI

SEQ ID NO: 287011 - protein, 8 aa, Influenza virus
YNAELLIL

SEQ ID NO: 287012 - protein, 8 aa, Influenza virus
NAELLILL

SEQ ID NO: 287013 - protein, 8 aa, Influenza virus
AELLILLE

SEQ ID NO: 287014 - protein, 8 aa, Influenza virus
ELLILLEN

SEQ ID NO: 287015 - protein, 8 aa, Influenza virus
LLILLENE

SEQ ID NO: 287016 - protein, 8 aa, Influenza virus
LILLENER

SEQ ID NO: 287017 - protein, 8 aa, Influenza virus
ILLENERT

SEQ ID NO: 287018 - protein, 8 aa, Influenza virus
ENERTLDY

SEQ ID NO: 287019 - protein, 8 aa, Influenza virus
NERTLDYH

SEQ ID NO: 287020 - protein, 8 aa, Influenza virus
ERTLDYHD

SEQ ID NO: 287021 - protein, 8 aa, Influenza virus
RTLDYHDS

SEQ ID NO: 287022 - protein, 8 aa, Influenza virus
TLDYHDSN

SEQ ID NO: 287023 - protein, 8 aa, Influenza virus
LDYHDSNV

SEQ ID NO: 287024 - protein, 8 aa, Influenza virus
QLRNNAKE

SEQ ID NO: 287025 - protein, 8 aa, Influenza virus
NNAKELGN

SEQ ID NO: 287026 - protein, 8 aa, Influenza virus
NAKELGNG

SEQ ID NO: 287027 - protein, 8 aa, Influenza virus
AKELGNGC

SEQ ID NO: 287028 - protein, 8 aa, Influenza virus
KELGNGCF

SEQ ID NO: 287029 - protein, 8 aa, Influenza virus
ELGNGCFE

SEQ ID NO: 287030 - protein, 8 aa, Influenza virus
LGNGCFEF

SEQ ID NO: 287031 - protein, 8 aa, Influenza virus
GCFEFYHR

SEQ ID NO: 287032 - protein, 8 aa, Influenza virus
CFEFYHRC

SEQ ID NO: 287033 - protein, 8 aa, Influenza virus
FEFYHKCD

SEQ ID NO: 287034 - protein, 8 aa, Influenza virus
EFYHKCDD

SEQ ID NO: 287035 - protein, 8 aa, Influenza virus
CMDSVKNG

SEQ ID NO: 287036 - protein, 8 aa, Influenza virus
MDSVKNGT

SEQ ID NO: 287037 - protein, 8 aa, Influenza virus
DSVKNGTY

SEQ ID NO: 287038 - protein, 8 aa, Influenza virus
SVRNGTYD

SEQ ID NO: 287039 - protein, 8 aa, Influenza virus
VRNGTYDY

SEQ ID NO: 287040 - protein, 8 aa, Influenza virus
YRILAIYS

SEQ ID NO: 287041 - protein, 8 aa, Influenza virus
RILAIYST

SEQ ID NO: 287042 - protein, 8 aa, Influenza virus
ILAIYSTA

SEQ ID NO: 287043 - protein, 8 aa, Influenza virus
CFWMCSNG

SEQ ID NO: 287044 - protein, 8 aa, Influenza virus
FWMCPNGS

SEQ ID NO: 287045 - protein, 8 aa, Influenza virus
MCPNGSLQ

SEQ ID NO: 287046 - protein, 8 aa, Influenza virus
CSNGSLHG

SEQ ID NO: 287047 - protein, 8 aa, Influenza virus
SNGSLQCK

SEQ ID NO: 287048 - protein, 8 aa, Influenza virus
NGSLQCKI

SEQ ID NO: 287049 - protein, 8 aa, Influenza virus
GSLQCKIC

SEQ ID NO: 287050 - protein, 8 aa, Influenza virus
SLQCKICI

SEQ ID NO: 287051 - protein, 8 aa, Influenza virus
YRNWSMPQ

SEQ ID NO: 287052 - protein, 8 aa, Influenza virus
RNWSMPQC

SEQ ID NO: 287053 - protein, 8 aa, Influenza virus
IKGFAPFS

SEQ ID NO: 287054 - protein, 8 aa, Influenza virus
KGFAPFSK

SEQ ID NO: 287055 - protein, 8 aa, Influenza virus
NSIRLSAS

SEQ ID NO: 287056 - protein, 8 aa, Influenza virus
SIRLSASG

SEQ ID NO: 287057 - protein, 8 aa, Influenza virus
IRLSAGGA

SEQ ID NO: 287058 - protein, 8 aa, Influenza virus
RLSAGGAI

SEQ ID NO: 287059 - protein, 8 aa, Influenza virus
LSAGGAIW

SEQ ID NO: 287060 - protein, 8 aa, Influenza virus
SAGGAIWV

SEQ ID NO: 287061 - protein, 8 aa, Influenza virus
AGGAIWVT

SEQ ID NO: 287062 - protein, 8 aa, Influenza virus
GGAIWVTR

SEQ ID NO: 287063 - protein, 8 aa, Influenza virus
GAIWVTRE

SEQ ID NO: 287064 - protein, 8 aa, Influenza virus
AIWVTREP

SEQ ID NO: 287065 - protein, 8 aa, Influenza virus
VWVTREPY

SEQ ID NO: 287066 - protein, 8 aa, Influenza virus
WITREPYV

SEQ ID NO: 287067 - protein, 8 aa, Influenza virus
ITREPYVS

SEQ ID NO: 287068 - protein, 8 aa, Influenza virus
REPYVSCE

SEQ ID NO: 287069 - protein, 8 aa, Influenza virus
RCYQFALG

SEQ ID NO: 287070 - protein, 8 aa, Influenza virus
LGQGTTLD

SEQ ID NO: 287071 - protein, 8 aa, Influenza virus
GQGTTLDN

SEQ ID NO: 287072 - protein, 8 aa, Influenza virus
DRTPHRTL

SEQ ID NO: 287073 - protein, 8 aa, Influenza virus
RTPHRTLL

SEQ ID NO: 287074 - protein, 8 aa, Influenza virus
TPHRTLLM

SEQ ID NO: 287075 - protein, 8 aa, Influenza virus
PHRTLLMN

SEQ ID NO: 287076 - protein, 8 aa, Influenza virus
HRTLLMNE

SEQ ID NO: 287077 - protein, 8 aa, Influenza virus
RTLLMSEL

SEQ ID NO: 287078 - protein, 8 aa, Influenza virus
LLMNELGI

SEQ ID NO: 287079 - protein, 8 aa, Influenza virus
LMNELGIP

SEQ ID NO: 287080 - protein, 8 aa, Influenza virus
MNELGIPF

SEQ ID NO: 287081 - protein, 8 aa, Influenza virus
NELGIPFH

SEQ ID NO: 287082 - protein, 8 aa, Influenza virus
ELGIPFHL

SEQ ID NO: 287083 - protein, 8 aa, Influenza virus
LGIPFHLG

SEQ ID NO: 287084 - protein, 8 aa, Influenza virus
GIPFHLGT

SEQ ID NO: 287085 - protein, 8 aa, Influenza virus
VPFHLGTR

SEQ ID NO: 287086 - protein, 8 aa, Influenza virus
PFHLGTRQ

SEQ ID NO: 287087 - protein, 8 aa, Influenza virus
FHLGTRQV

SEQ ID NO: 287088 - protein, 8 aa, Influenza virus
HLGTRQVC

SEQ ID NO: 287089 - protein, 8 aa, Influenza virus
LGTRQVCI

SEQ ID NO: 287090 - protein, 8 aa, Influenza virus
GTRQVCIA

SEQ ID NO: 287091 - protein, 8 aa, Influenza virus
TRQVCIAW

SEQ ID NO: 287092 - protein, 8 aa, Influenza virus
RQVCIAWS

SEQ ID NO: 287093 - protein, 8 aa, Influenza virus
QVCMAWSS

SEQ ID NO: 287094 - protein, 8 aa, Influenza virus
VCMAWSSS

SEQ ID NO: 287095 - protein, 8 aa, Influenza virus
CMAWSSSS

SEQ ID NO: 287096 - protein, 8 aa, Influenza virus
MAWSSSSC

SEQ ID NO: 287097 - protein, 8 aa, Influenza virus
AWSSSSCY

SEQ ID NO: 287098 - protein, 8 aa, Influenza virus
WSSSSCYD

SEQ ID NO: 287099 - protein, 8 aa, Influenza virus
SSSSCYDG

SEQ ID NO: 287100 - protein, 8 aa, Influenza virus
SSSCYDGK

SEQ ID NO: 287101 - protein, 8 aa, Influenza virus
SSCYDGKA

SEQ ID NO: 287102 - protein, 8 aa, Influenza virus
SCYDGKAW

SEQ ID NO: 287103 - protein, 8 aa, Influenza virus
CYDGKAWL

SEQ ID NO: 287104 - protein, 8 aa, Influenza virus
YDGKAWLH

SEQ ID NO: 287105 - protein, 8 aa, Influenza virus
DGRAWLHV

SEQ ID NO: 287106 - protein, 8 aa, Influenza virus
GRAWLHVC

SEQ ID NO: 287107 - protein, 8 aa, Influenza virus
AWLHVCIT

SEQ ID NO: 287108 - protein, 8 aa, Influenza virus
WLHVCITG

SEQ ID NO: 287109 - protein, 8 aa, Influenza virus
NATASIIY

SEQ ID NO: 287110 - protein, 8 aa, Influenza virus
KILRTQES

SEQ ID NO: 287111 - protein, 8 aa, Influenza virus
ILRTHESE

SEQ ID NO: 287112 - protein, 8 aa, Influenza virus
LRTHESEC

SEQ ID NO: 287113 - protein, 8 aa, Influenza virus
RTQESECI

SEQ ID NO: 287114 - protein, 8 aa, Influenza virus
TQESECIC

SEQ ID NO: 287115 - protein, 8 aa, Influenza virus
QESECICI

SEQ ID NO: 287116 - protein, 8 aa, Influenza virus
ESECVCIS

SEQ ID NO: 287117 - protein, 8 aa, Influenza virus
TCTVIMTD

SEQ ID NO: 287118 - protein, 8 aa, Influenza virus
CAVVMTDG

SEQ ID NO: 287119 - protein, 8 aa, Influenza virus
AVVMTDGS

SEQ ID NO: 287120 - protein, 8 aa, Influenza virus
VIMTDGSA

SEQ ID NO: 287121 - protein, 8 aa, Influenza virus
IMTDGSAS

SEQ ID NO: 287122 - protein, 8 aa, Influenza virus
MIDGSASG

SEQ ID NO: 287123 - protein, 8 aa, Influenza virus
GSAQHIEE

SEQ ID NO: 287124 - protein, 8 aa, Influenza virus
SAQHIEEC

SEQ ID NO: 287125 - protein, 8 aa, Influenza virus
AQHIEECS

SEQ ID NO: 287126 - protein, 8 aa, Influenza virus
QHIEECSC

SEQ ID NO: 287127 - protein, 8 aa, Influenza virus
HIEECSCY

SEQ ID NO: 287128 - protein, 8 aa, Influenza virus
IEECSCYP

SEQ ID NO: 287129 - protein, 8 aa, Influenza virus
ECSCYPRF

SEQ ID NO: 287130 - protein, 8 aa, Influenza virus
CSCYPRFP

SEQ ID NO: 287131 - protein, 8 aa, Influenza virus
VRCICRDN

SEQ ID NO: 287132 - protein, 8 aa, Influenza virus
RCICRDNW

SEQ ID NO: 287133 - protein, 8 aa, Influenza virus
CICRDNWK

SEQ ID NO: 287134 - protein, 8 aa, Influenza virus
ICRDNWKG

SEQ ID NO: 287135 - protein, 8 aa, Influenza virus
CRDNWRGS

SEQ ID NO: 287136 - protein, 8 aa, Influenza virus
RDNWRGSN

SEQ ID NO: 287137 - protein, 8 aa, Influenza virus
DNWRGSNR

SEQ ID NO: 287138 - protein, 8 aa, Influenza virus
NWRGSNRP

SEQ ID NO: 287139 - protein, 8 aa, Influenza virus
WKGSNRPV

SEQ ID NO: 287140 - protein, 8 aa, Influenza virus
KGSNRPVV

SEQ ID NO: 287141 - protein, 8 aa, Influenza virus
GSNRPVVD

SEQ ID NO: 287142 - protein, 8 aa, Influenza virus
SNRPVVDI

SEQ ID NO: 287143 - protein, 8 aa, Influenza virus
SSYMCSGL

SEQ ID NO: 287144 - protein, 8 aa, Influenza virus
SYMCSGLV

SEQ ID NO: 287145 - protein, 8 aa, Influenza virus
YMCSGLVG

SEQ ID NO: 287146 - protein, 8 aa, Influenza virus
MCSGLVGD

SEQ ID NO: 287147 - protein, 8 aa, Influenza virus
GNHGVKGW

SEQ ID NO: 287148 - protein, 8 aa, Influenza virus
NHGVKGWA

SEQ ID NO: 287149 - protein, 8 aa, Influenza virus
PGVKGWAF

SEQ ID NO: 287150 - protein, 8 aa, Influenza virus
VKGWAFDN

SEQ ID NO: 287151 - protein, 8 aa, Influenza virus
DLWMGRTI

SEQ ID NO: 287152 - protein, 8 aa, Influenza virus
LRLGYETF

SEQ ID NO: 287153 - protein, 8 aa, Influenza virus
RLGYETFK

SEQ ID NO: 287154 - protein, 8 aa, Influenza virus
LGYETFKV

SEQ ID NO: 287155 - protein, 8 aa, Influenza virus
GYETFRVI

SEQ ID NO: 287156 - protein, 8 aa, Influenza virus
WSGYSGIF

SEQ ID NO: 287157 - protein, 8 aa, Influenza virus
SGYSGVFS

SEQ ID NO: 287158 - protein, 8 aa, Influenza virus
GYSGVFSV

SEQ ID NO: 287159 - protein, 8 aa, Influenza virus
YSGVFSVE

SEQ ID NO: 287160 - protein, 8 aa, Influenza virus
NCINRCFY

SEQ ID NO: 287161 - protein, 8 aa, Influenza virus
VELIRGRR

SEQ ID NO: 287162 - protein, 8 aa, Influenza virus
VLWTSNSI

SEQ ID NO: 287163 - protein, 8 aa, Influenza virus
LWTSNSIV

SEQ ID NO: 287164 - protein, 8 aa, Influenza virus
WTSNSIVA

SEQ ID NO: 287165 - protein, 8 aa, Influenza virus
TSNSIVEF

SEQ ID NO: 287166 - protein, 8 aa, Influenza virus
SNSVVVFC

SEQ ID NO: 287167 - protein, 8 aa, Influenza virus
NSIVVFCS

SEQ ID NO: 287168 - protein, 8 aa, Influenza virus
SIVVFCGA

SEQ ID NO: 287169 - protein, 8 aa, Influenza virus
IVVFCSTS

SEQ ID NO: 287170 - protein, 8 aa, Influenza virus
VAFCGTSG

SEQ ID NO: 287171 - protein, 8 aa, Influenza virus
VFCSTSGT

SEQ ID NO: 287172 - protein, 8 aa, Influenza virus
FCGTSGIY

SEQ ID NO: 287173 - protein, 8 aa, Influenza virus
CGTSGIYG

SEQ ID NO: 287174 - protein, 8 aa, Influenza virus
TSGTYGSG

SEQ ID NO: 287175 - protein, 8 aa, Influenza virus
GTYGTGTW

SEQ ID NO: 287176 - protein, 8 aa, Influenza virus
TYGTGTWP

SEQ ID NO: 287177 - protein, 8 aa, Influenza virus
YGTGTWPD

SEQ ID NO: 287178 - protein, 8 aa, Influenza virus
GTGTWPDG

SEQ ID NO: 287179 - protein, 8 aa, Influenza virus
TGTWPDGA

SEQ ID NO: 287180 - protein, 8 aa, Influenza virus
GSWPDGAN

SEQ ID NO: 287181 - protein, 8 aa, Influenza virus
SWPDGANI

SEQ ID NO: 287182 - protein, 8 aa, Influenza virus
MDNQTKKM

SEQ ID NO: 287183 - protein, 8 aa, Influenza virus
DNKTKKMT

SEQ ID NO: 287184 - protein, 8 aa, Influenza virus
NQTKKMTI

SEQ ID NO: 287185 - protein, 8 aa, Influenza virus
QTKKMTIT

SEQ ID NO: 287186 - protein, 8 aa, Influenza virus
TKKMTITF

SEQ ID NO: 287187 - protein, 8 aa, Influenza virus
KKMTITFL

SEQ ID NO: 287188 - protein, 8 aa, Influenza virus
KMTITFLI

SEQ ID NO: 287189 - protein, 8 aa, Influenza virus
GDQICVGY

SEQ ID NO: 287190 - protein, 8 aa, Influenza virus
DQICVGYH

SEQ ID NO: 287191 - protein, 8 aa, Influenza virus
QICIGYHS

SEQ ID NO: 287192 - protein, 8 aa, Influenza virus
ICIGYHSN

SEQ ID NO: 287193 - protein, 8 aa, Influenza virus
CIGYHSNN

SEQ ID NO: 287194 - protein, 8 aa, Influenza virus
IGYHSNNS

SEQ ID NO: 287195 - protein, 8 aa, Influenza virus
GYHSNNST

SEQ ID NO: 287196 - protein, 8 aa, Influenza virus
YHSNNSTE

SEQ ID NO: 287197 - protein, 8 aa, Influenza virus
HSNNSTEK

SEQ ID NO: 287198 - protein, 8 aa, Influenza virus
NNSTETVD

SEQ ID NO: 287199 - protein, 8 aa, Influenza virus
NSTETVDT

SEQ ID NO: 287200 - protein, 8 aa, Influenza virus
VDTILEQN

SEQ ID NO: 287201 - protein, 8 aa, Influenza virus
DTILEQNV

SEQ ID NO: 287202 - protein, 8 aa, Influenza virus
TILEQNVT

SEQ ID NO: 287203 - protein, 8 aa, Influenza virus
ILEQNVTV

SEQ ID NO: 287204 - protein, 8 aa, Influenza virus
LEQNVTVT

SEQ ID NO: 287205 - protein, 8 aa, Influenza virus
EQNVTVTH

SEQ ID NO: 287206 - protein, 8 aa, Influenza virus
QNVTVTHA

SEQ ID NO: 287207 - protein, 8 aa, Influenza virus
NVTVTHAQ

SEQ ID NO: 287208 - protein, 8 aa, Influenza virus
VTVTHAQD

SEQ ID NO: 287209 - protein, 8 aa, Influenza virus
TVTHAQDI

SEQ ID NO: 287210 - protein, 8 aa, Influenza virus
VTHAQDIL

SEQ ID NO: 287211 - protein, 8 aa, Influenza virus
THAQDILE

SEQ ID NO: 287212 - protein, 8 aa, Influenza virus
HAQDILEK

SEQ ID NO: 287213 - protein, 8 aa, Influenza virus
NILEKTHN

SEQ ID NO: 287214 - protein, 8 aa, Influenza virus
ILEKVHNG

SEQ ID NO: 287215 - protein, 8 aa, Influenza virus
LEKVHNGK

SEQ ID NO: 287216 - protein, 8 aa, Influenza virus
EKVHNGKL

SEQ ID NO: 287217 - protein, 8 aa, Influenza virus
KVHNGKLC

SEQ ID NO: 287218 - protein, 8 aa, Influenza virus
THNGKLCR

SEQ ID NO: 287219 - protein, 8 aa, Influenza virus
HNGKLCRL

SEQ ID NO: 287220 - protein, 8 aa, Influenza virus
NGKLCRLS

SEQ ID NO: 287221 - protein, 8 aa, Influenza virus
GKLCRLSG

SEQ ID NO: 287222 - protein, 8 aa, Influenza virus
LSGIPPLE

SEQ ID NO: 287223 - protein, 8 aa, Influenza virus
SGIPPLEL

SEQ ID NO: 287224 - protein, 8 aa, Influenza virus
GIPPLELR

SEQ ID NO: 287225 - protein, 8 aa, Influenza virus
IPPLELRD

SEQ ID NO: 287226 - protein, 8 aa, Influenza virus
PPLELRDC

SEQ ID NO: 287227 - protein, 8 aa, Influenza virus
PLELRDCS

SEQ ID NO: 287228 - protein, 8 aa, Influenza virus
LELRDCSI

SEQ ID NO: 287229 - protein, 8 aa, Influenza virus
ELRDCSIA

SEQ ID NO: 287230 - protein, 8 aa, Influenza virus
LRDCSIAG

SEQ ID NO: 287231 - protein, 8 aa, Influenza virus
RDCSIAGW

SEQ ID NO: 287232 - protein, 8 aa, Influenza virus
GWLLGNPK

SEQ ID NO: 287233 - protein, 8 aa, Influenza virus
WLLGNPKC

SEQ ID NO: 287234 - protein, 8 aa, Influenza virus
LLGNPKCD

SEQ ID NO: 287235 - protein, 8 aa, Influenza virus
LGNPECDI

SEQ ID NO: 287236 - protein, 8 aa, Influenza virus
GNPECDIL

SEQ ID NO: 287237 - protein, 8 aa, Influenza virus
NPECDILL

SEQ ID NO: 287238 - protein, 8 aa, Influenza virus
VPEWSYIM

SEQ ID NO: 287239 - protein, 8 aa, Influenza virus
PEWSYIME

SEQ ID NO: 287240 - protein, 8 aa, Influenza virus
EWSYIVEK

SEQ ID NO: 287241 - protein, 8 aa, Influenza virus
WSYIMEKE

SEQ ID NO: 287242 - protein, 8 aa, Influenza virus
LCYPGNFN

SEQ ID NO: 287243 - protein, 8 aa, Influenza virus
FNEYEELK

SEQ ID NO: 287244 - protein, 8 aa, Influenza virus
NEYEELKH

SEQ ID NO: 287245 - protein, 8 aa, Influenza virus
HFEKIKIL

SEQ ID NO: 287246 - protein, 8 aa, Influenza virus
SSFFRNMV

SEQ ID NO: 287247 - protein, 8 aa, Influenza virus
SFFRNMIW

SEQ ID NO: 287248 - protein, 8 aa, Influenza virus
FFRNMIWL

SEQ ID NO: 287249 - protein, 8 aa, Influenza virus
FRNMIWLT

SEQ ID NO: 287250 - protein, 8 aa, Influenza virus
GSYNNTSG

SEQ ID NO: 287251 - protein, 8 aa, Influenza virus
SYNNTNGE

SEQ ID NO: 287252 - protein, 8 aa, Influenza virus
YNNTNGEQ

SEQ ID NO: 287253 - protein, 8 aa, Influenza virus
NNTNGEQI

SEQ ID NO: 287254 - protein, 8 aa, Influenza virus
NTNGEQIL

SEQ ID NO: 287255 - protein, 8 aa, Influenza virus
TSTLYKRS

SEQ ID NO: 287256 - protein, 8 aa, Influenza virus
GLGSRMEF

SEQ ID NO: 287257 - protein, 8 aa, Influenza virus
SRMEFSWT

SEQ ID NO: 287258 - protein, 8 aa, Influenza virus
RMEFSWTI

SEQ ID NO: 287259 - protein, 8 aa, Influenza virus
MEFSWTIL

SEQ ID NO: 287260 - protein, 8 aa, Influenza virus
ISFESTGN

SEQ ID NO: 287261 - protein, 8 aa, Influenza virus
SFESTGNL

SEQ ID NO: 287262 - protein, 8 aa, Influenza virus
FESTGNLV

SEQ ID NO: 287263 - protein, 8 aa, Influenza virus
ESTGNLVA

SEQ ID NO: 287264 - protein, 8 aa, Influenza virus
STGNLVAP

SEQ ID NO: 287265 - protein, 8 aa, Influenza virus
TGNLVAPE

SEQ ID NO: 287266 - protein, 8 aa, Influenza virus
GNLVAPEY

SEQ ID NO: 287267 - protein, 8 aa, Influenza virus
NLVAPEYG

SEQ ID NO: 287268 - protein, 8 aa, Influenza virus
LVAPEYGF

SEQ ID NO: 287269 - protein, 8 aa, Influenza virus
VAPEYGFK

SEQ ID NO: 287270 - protein, 8 aa, Influenza virus
APEYGFRI

SEQ ID NO: 287271 - protein, 8 aa, Influenza virus
PEYGFRIS

SEQ ID NO: 287272 - protein, 8 aa, Influenza virus
EYGFRISK

SEQ ID NO: 287273 - protein, 8 aa, Influenza virus
YGFRISKR

SEQ ID NO: 287274 - protein, 8 aa, Influenza virus
GFRISKRG

SEQ ID NO: 287275 - protein, 8 aa, Influenza virus
FKISKRGG

SEQ ID NO: 287276 - protein, 8 aa, Influenza virus
KISKRGGS

SEQ ID NO: 287277 - protein, 8 aa, Influenza virus
ISKRGGSG

SEQ ID NO: 287278 - protein, 8 aa, Influenza virus
SKRGGSGI

SEQ ID NO: 287279 - protein, 8 aa, Influenza virus
KRGGSGIM

SEQ ID NO: 287280 - protein, 8 aa, Influenza virus
RGGSGIMK

SEQ ID NO: 287281 - protein, 8 aa, Influenza virus
GGSGIMKT

SEQ ID NO: 287282 - protein, 8 aa, Influenza virus
CETRCQTP

SEQ ID NO: 287283 - protein, 8 aa, Influenza virus
ETRCQTPL

SEQ ID NO: 287284 - protein, 8 aa, Influenza virus
TRCQTPLG

SEQ ID NO: 287285 - protein, 8 aa, Influenza virus
RCQTPLGA

SEQ ID NO: 287286 - protein, 8 aa, Influenza virus
CQTPLGAL

SEQ ID NO: 287287 - protein, 8 aa, Influenza virus
QTPLGALN

SEQ ID NO: 287288 - protein, 8 aa, Influenza virus
TPLGALNT

SEQ ID NO: 287289 - protein, 8 aa, Influenza virus
PLGALNTT

SEQ ID NO: 287290 - protein, 8 aa, Influenza virus
LGALNTTL

SEQ ID NO: 287291 - protein, 8 aa, Influenza virus
GALNTTLP

SEQ ID NO: 287292 - protein, 8 aa, Influenza virus
ALNTTLPF

SEQ ID NO: 287293 - protein, 8 aa, Influenza virus
LNTTLPFH

SEQ ID NO: 287294 - protein, 8 aa, Influenza virus
TTLPFHNV

SEQ ID NO: 287295 - protein, 8 aa, Influenza virus
TLPFHNVH

SEQ ID NO: 287296 - protein, 8 aa, Influenza virus
LPFHNVHP

SEQ ID NO: 287297 - protein, 8 aa, Influenza virus
PFHNVHPL

SEQ ID NO: 287298 - protein, 8 aa, Influenza virus
FHNVHPLT

SEQ ID NO: 287299 - protein, 8 aa, Influenza virus
HNVHPLTI

SEQ ID NO: 287300 - protein, 8 aa, Influenza virus
NVHPLTIG

SEQ ID NO: 287301 - protein, 8 aa, Influenza virus
VHPLTIGE

SEQ ID NO: 287302 - protein, 8 aa, Influenza virus
HPLAIGEC

SEQ ID NO: 287303 - protein, 8 aa, Influenza virus
PLAIGECP

SEQ ID NO: 287304 - protein, 8 aa, Influenza virus
LAIGECPK

SEQ ID NO: 287305 - protein, 8 aa, Influenza virus
AIGECPKY

SEQ ID NO: 287306 - protein, 8 aa, Influenza virus
IGECPKYI

SEQ ID NO: 287307 - protein, 8 aa, Influenza virus
GECPKYIK

SEQ ID NO: 287308 - protein, 8 aa, Influenza virus
ECPKYIKS

SEQ ID NO: 287309 - protein, 8 aa, Influenza virus
LVLATGPR

SEQ ID NO: 287310 - protein, 8 aa, Influenza virus
VLATGPRN

SEQ ID NO: 287311 - protein, 8 aa, Influenza virus
PQMESRGL

SEQ ID NO: 287312 - protein, 8 aa, Influenza virus
QIEPRGLF

SEQ ID NO: 287313 - protein, 8 aa, Influenza virus
MESRGLFG

SEQ ID NO: 287314 - protein, 8 aa, Influenza virus
EPRGLFGA

SEQ ID NO: 287315 - protein, 8 aa, Influenza virus
PRGLFGAI

SEQ ID NO: 287316 - protein, 8 aa, Influenza virus
EGGWQGMI

SEQ ID NO: 287317 - protein, 8 aa, Influenza virus
GGWQGMID

SEQ ID NO: 287318 - protein, 8 aa, Influenza virus
GWQGMIDG

SEQ ID NO: 287319 - protein, 8 aa, Influenza virus
WQGMIDGW

SEQ ID NO: 287320 - protein, 8 aa, Influenza virus
QGMIDGWY

SEQ ID NO: 287321 - protein, 8 aa, Influenza virus
GMIDGWYG

SEQ ID NO: 287322 - protein, 8 aa, Influenza virus
MIDGWYGY

SEQ ID NO: 287323 - protein, 8 aa, Influenza virus
IDGWYGYH

SEQ ID NO: 287324 - protein, 8 aa, Influenza virus
HHSNDQGA

SEQ ID NO: 287325 - protein, 8 aa, Influenza virus
HSNDQGAG

SEQ ID NO: 287326 - protein, 8 aa, Influenza virus
SNDQGAGY

SEQ ID NO: 287327 - protein, 8 aa, Influenza virus
NDQGAGYA

SEQ ID NO: 287328 - protein, 8 aa, Influenza virus
DQGAGYAA

SEQ ID NO: 287329 - protein, 8 aa, Influenza virus
QGAGYAAD

SEQ ID NO: 287330 - protein, 8 aa, Influenza virus
GAGYAADK

SEQ ID NO: 287331 - protein, 8 aa, Influenza virus
AGYAADKE

SEQ ID NO: 287332 - protein, 8 aa, Influenza virus
GYAADKAS

SEQ ID NO: 287333 - protein, 8 aa, Influenza virus
YAADKAST

SEQ ID NO: 287334 - protein, 8 aa, Influenza virus
AADKASTQ

SEQ ID NO: 287335 - protein, 8 aa, Influenza virus
ADKESTQR

SEQ ID NO: 287336 - protein, 8 aa, Influenza virus
DKESTQRA

SEQ ID NO: 287337 - protein, 8 aa, Influenza virus
NFVIEKMN

SEQ ID NO: 287338 - protein, 8 aa, Influenza virus
FVIEKMNT

SEQ ID NO: 287339 - protein, 8 aa, Influenza virus
VIEKINTQ

SEQ ID NO: 287340 - protein, 8 aa, Influenza virus
IEKINTQF

SEQ ID NO: 287341 - protein, 8 aa, Influenza virus
EKMNTQFG

SEQ ID NO: 287342 - protein, 8 aa, Influenza virus
VGKEFSNL

SEQ ID NO: 287343 - protein, 8 aa, Influenza virus
GKEFSNLE

SEQ ID NO: 287344 - protein, 8 aa, Influenza virus
NLEKRLEN

SEQ ID NO: 287345 - protein, 8 aa, Influenza virus
LEKRLENL

SEQ ID NO: 287346 - protein, 8 aa, Influenza virus
EKRLENLN

SEQ ID NO: 287347 - protein, 8 aa, Influenza virus
KRLENLNK

SEQ ID NO: 287348 - protein, 8 aa, Influenza virus
RLGNLNKK

SEQ ID NO: 287349 - protein, 8 aa, Influenza virus
LENLNKKV

SEQ ID NO: 287350 - protein, 8 aa, Influenza virus
ENLNKKVE

SEQ ID NO: 287351 - protein, 8 aa, Influenza virus
NLNKKVED

SEQ ID NO: 287352 - protein, 8 aa, Influenza virus
LNKKVEDG

SEQ ID NO: 287353 - protein, 8 aa, Influenza virus
NKKVEDGF

SEQ ID NO: 287354 - protein, 8 aa, Influenza virus
KKMEDGFI

SEQ ID NO: 287355 - protein, 8 aa, Influenza virus
VWTYNVEL

SEQ ID NO: 287356 - protein, 8 aa, Influenza virus
WTYNVELL

SEQ ID NO: 287357 - protein, 8 aa, Influenza virus
TYNAEVLV

SEQ ID NO: 287358 - protein, 8 aa, Influenza virus
YNVELLVL

SEQ ID NO: 287359 - protein, 8 aa, Influenza virus
NAEVLVLM

SEQ ID NO: 287360 - protein, 8 aa, Influenza virus
VELLVLME

SEQ ID NO: 287361 - protein, 8 aa, Influenza virus
VLMENEMT

SEQ ID NO: 287362 - protein, 8 aa, Influenza virus
LMENEMTL

SEQ ID NO: 287363 - protein, 8 aa, Influenza virus
MENEMTLD

SEQ ID NO: 287364 - protein, 8 aa, Influenza virus
ENERTLDY

SEQ ID NO: 287365 - protein, 8 aa, Influenza virus
NERTLDYH

SEQ ID NO: 287366 - protein, 8 aa, Influenza virus
ERTLDYHD

SEQ ID NO: 287367 - protein, 8 aa, Influenza virus
RTLDYHDS

SEQ ID NO: 287368 - protein, 8 aa, Influenza virus
TLDYHDSN

SEQ ID NO: 287369 - protein, 8 aa, Influenza virus
LDYHDSNV

SEQ ID NO: 287370 - protein, 8 aa, Influenza virus
DFHDSNVR

SEQ ID NO: 287371 - protein, 8 aa, Influenza virus
FHDSNVRN

SEQ ID NO: 287372 - protein, 8 aa, Influenza virus
HDSNVRNL

SEQ ID NO: 287373 - protein, 8 aa, Influenza virus
DSNVRNLY

SEQ ID NO: 287374 - protein, 8 aa, Influenza virus
SNVRNLYD

SEQ ID NO: 287375 - protein, 8 aa, Influenza virus
SLYDKVRM

SEQ ID NO: 287376 - protein, 8 aa, Influenza virus
LYNKVRMQ

SEQ ID NO: 287377 - protein, 8 aa, Influenza virus
YNKVRMQL

SEQ ID NO: 287378 - protein, 8 aa, Influenza virus
NKVRMQLR

SEQ ID NO: 287379 - protein, 8 aa, Influenza virus
KVRMQLKD

SEQ ID NO: 287380 - protein, 8 aa, Influenza virus
VRMQLKDN

SEQ ID NO: 287381 - protein, 8 aa, Influenza virus
RMQLRDNV

SEQ ID NO: 287382 - protein, 8 aa, Influenza virus
MQLRDNVK

SEQ ID NO: 287383 - protein, 8 aa, Influenza virus
QLRDNVKE

SEQ ID NO: 287384 - protein, 8 aa, Influenza virus
LRDNVKEL

SEQ ID NO: 287385 - protein, 8 aa, Influenza virus
RDNVKELG

SEQ ID NO: 287386 - protein, 8 aa, Influenza virus
DNVKELGN

SEQ ID NO: 287387 - protein, 8 aa, Influenza virus
NVKELGNG

SEQ ID NO: 287388 - protein, 8 aa, Influenza virus
VKELGNGC

SEQ ID NO: 287389 - protein, 8 aa, Influenza virus
KELGNGCF

SEQ ID NO: 287390 - protein, 8 aa, Influenza virus
ELGNGCFE

SEQ ID NO: 287391 - protein, 8 aa, Influenza virus
LGNGCFEF

SEQ ID NO: 287392 - protein, 8 aa, Influenza virus
FEFYHKCN

SEQ ID NO: 287393 - protein, 8 aa, Influenza virus
EFYHKCDN

SEQ ID NO: 287394 - protein, 8 aa, Influenza virus
FYHKCDNE

SEQ ID NO: 287395 - protein, 8 aa, Influenza virus
YHKCDNEC

SEQ ID NO: 287396 - protein, 8 aa, Influenza virus
HKCDNECM

SEQ ID NO: 287397 - protein, 8 aa, Influenza virus
KCDDECMD

SEQ ID NO: 287398 - protein, 8 aa, Influenza virus
CDDECMDS

SEQ ID NO: 287399 - protein, 8 aa, Influenza virus
SVRNGTYD

SEQ ID NO: 287400 - protein, 8 aa, Influenza virus
VRNGTYDY

SEQ ID NO: 287401 - protein, 8 aa, Influenza virus
NGTYDYSK

SEQ ID NO: 287402 - protein, 8 aa, Influenza virus
GTYDYSKY

SEQ ID NO: 287403 - protein, 8 aa, Influenza virus
TYDYSKYE

SEQ ID NO: 287404 - protein, 8 aa, Influenza virus
YDYSKYEE

SEQ ID NO: 287405 - protein, 8 aa, Influenza virus
DYSKYEEE

SEQ ID NO: 287406 - protein, 8 aa, Influenza virus
YSKYEEES

SEQ ID NO: 287407 - protein, 8 aa, Influenza virus
SKYEEESK

SEQ ID NO: 287408 - protein, 8 aa, Influenza virus
KYEEESRL

SEQ ID NO: 287409 - protein, 8 aa, Influenza virus
YEEESKLK

SEQ ID NO: 287410 - protein, 8 aa, Influenza virus
EEESKLKR

SEQ ID NO: 287411 - protein, 8 aa, Influenza virus
EESKLKRN

SEQ ID NO: 287412 - protein, 8 aa, Influenza virus
ESKLKRNE

SEQ ID NO: 287413 - protein, 8 aa, Influenza virus
SKLKRNEI

SEQ ID NO: 287414 - protein, 8 aa, Influenza virus
KLKRNEIK

SEQ ID NO: 287415 - protein, 8 aa, Influenza virus
LKRNEIKG

SEQ ID NO: 287416 - protein, 8 aa, Influenza virus
TEIKGVKL

SEQ ID NO: 287417 - protein, 8 aa, Influenza virus
EIKGVKLN

SEQ ID NO: 287418 - protein, 8 aa, Influenza virus
MGIYQILA

SEQ ID NO: 287419 - protein, 8 aa, Influenza virus
GIYQILAI

SEQ ID NO: 287420 - protein, 8 aa, Influenza virus
IYQILAIY

SEQ ID NO: 287421 - protein, 8 aa, Influenza virus
SLSLAIMM

SEQ ID NO: 287422 - protein, 8 aa, Influenza virus
LSLAIMMA

SEQ ID NO: 287423 - protein, 8 aa, Influenza virus
SLAIMMAG

SEQ ID NO: 287424 - protein, 8 aa, Influenza virus
LAIMMAGI

SEQ ID NO: 287425 - protein, 8 aa, Influenza virus
AIMMAGIS

SEQ ID NO: 287426 - protein, 8 aa, Influenza virus
AGISLWMC

SEQ ID NO: 287427 - protein, 8 aa, Influenza virus
GISLWMCS

SEQ ID NO: 287428 - protein, 8 aa, Influenza virus
ISLWMCSN

SEQ ID NO: 287429 - protein, 8 aa, Influenza virus
SLWMCSNG

SEQ ID NO: 287430 - protein, 8 aa, Influenza virus
LWMCSNGS

SEQ ID NO: 287431 - protein, 8 aa, Influenza virus
VKGDQICI

SEQ ID NO: 287432 - protein, 8 aa, Influenza virus
KGDQICIG

SEQ ID NO: 287433 - protein, 8 aa, Influenza virus
GDQICVGY

SEQ ID NO: 287434 - protein, 8 aa, Influenza virus
DQICVGYH

SEQ ID NO: 287435 - protein, 8 aa, Influenza virus
QICIGYHS

SEQ ID NO: 287436 - protein, 8 aa, Influenza virus
ICIGYHSN

SEQ ID NO: 287437 - protein, 8 aa, Influenza virus
CIGYHSNN

SEQ ID NO: 287438 - protein, 8 aa, Influenza virus
IGYHSNNS

SEQ ID NO: 287439 - protein, 8 aa, Influenza virus
GYHSNNST

SEQ ID NO: 287440 - protein, 8 aa, Influenza virus
YHSNNSTE

SEQ ID NO: 287441 - protein, 8 aa, Influenza virus
HSNNSTEK

SEQ ID NO: 287442 - protein, 8 aa, Influenza virus
NNSTETVD

SEQ ID NO: 287443 - protein, 8 aa, Influenza virus
NSTETVDT

SEQ ID NO: 287444 - protein, 8 aa, Influenza virus
TVDTILER

SEQ ID NO: 287445 - protein, 8 aa, Influenza virus
VDTNLERN

SEQ ID NO: 287446 - protein, 8 aa, Influenza virus
NVTVTHAQ

SEQ ID NO: 287447 - protein, 8 aa, Influenza virus
VTVTHAQD

SEQ ID NO: 287448 - protein, 8 aa, Influenza virus
TVTHAQDI

SEQ ID NO: 287449 - protein, 8 aa, Influenza virus
VTHAQDIL

SEQ ID NO: 287450 - protein, 8 aa, Influenza virus
THAQDILE

SEQ ID NO: 287451 - protein, 8 aa, Influenza virus
HAQDILEK

SEQ ID NO: 287452 - protein, 8 aa, Influenza virus
AQDILEKT

SEQ ID NO: 287453 - protein, 8 aa, Influenza virus
QDILEKTH

SEQ ID NO: 287454 - protein, 8 aa, Influenza virus
NILEKTHN

SEQ ID NO: 287455 - protein, 8 aa, Influenza virus
ILEKAHNG

SEQ ID NO: 287456 - protein, 8 aa, Influenza virus
LEKTHNGR

SEQ ID NO: 287457 - protein, 8 aa, Influenza virus
ERTHNGKL

SEQ ID NO: 287458 - protein, 8 aa, Influenza virus
KAHNGKLC

SEQ ID NO: 287459 - protein, 8 aa, Influenza virus
THNGKLCR

SEQ ID NO: 287460 - protein, 8 aa, Influenza virus
HNGKLCRL

SEQ ID NO: 287461 - protein, 8 aa, Influenza virus
NGKLCRLS

SEQ ID NO: 287462 - protein, 8 aa, Influenza virus
GKLCRLSG

SEQ ID NO: 287463 - protein, 8 aa, Influenza virus
KLCRLSGI

SEQ ID NO: 287464 - protein, 8 aa, Influenza virus
LCRLSGIP

SEQ ID NO: 287465 - protein, 8 aa, Influenza virus
CRLSGIPP

SEQ ID NO: 287466 - protein, 8 aa, Influenza virus
RLSGIPPL

SEQ ID NO: 287467 - protein, 8 aa, Influenza virus
LSGIPPLE

SEQ ID NO: 287468 - protein, 8 aa, Influenza virus
SGIPPLEL

SEQ ID NO: 287469 - protein, 8 aa, Influenza virus
ELGDCSIT

SEQ ID NO: 287470 - protein, 8 aa, Influenza virus
LGNCSIAG

SEQ ID NO: 287471 - protein, 8 aa, Influenza virus
GDCSITGW

SEQ ID NO: 287472 - protein, 8 aa, Influenza virus
NCSIAGWL

SEQ ID NO: 287473 - protein, 8 aa, Influenza virus
PECDRLLR

SEQ ID NO: 287474 - protein, 8 aa, Influenza virus
LRVPEWSY

SEQ ID NO: 287475 - protein, 8 aa, Influenza virus
RVPEWSYI

SEQ ID NO: 287476 - protein, 8 aa, Influenza virus
VPEWSYIV

SEQ ID NO: 287477 - protein, 8 aa, Influenza virus
PEWSYIVE

SEQ ID NO: 287478 - protein, 8 aa, Influenza virus
EWSYIVER

SEQ ID NO: 287479 - protein, 8 aa, Influenza virus
WSYIVERE

SEQ ID NO: 287480 - protein, 8 aa, Influenza virus
SYIVEREN

SEQ ID NO: 287481 - protein, 8 aa, Influenza virus
YIVERENP

SEQ ID NO: 287482 - protein, 8 aa, Influenza virus
DGLCYPGS

SEQ ID NO: 287483 - protein, 8 aa, Influenza virus
SLCYPGSF

SEQ ID NO: 287484 - protein, 8 aa, Influenza virus
LCYPGSLN

SEQ ID NO: 287485 - protein, 8 aa, Influenza virus
CYPGSFNN

SEQ ID NO: 287486 - protein, 8 aa, Influenza virus
YPGSFNNY

SEQ ID NO: 287487 - protein, 8 aa, Influenza virus
PGSFNNYE

SEQ ID NO: 287488 - protein, 8 aa, Influenza virus
GSFNNYEE

SEQ ID NO: 287489 - protein, 8 aa, Influenza virus
SFNNYEEL

SEQ ID NO: 287490 - protein, 8 aa, Influenza virus
FNNYEELK

SEQ ID NO: 287491 - protein, 8 aa, Influenza virus
NNYEELKH

SEQ ID NO: 287492 - protein, 8 aa, Influenza virus
NYEELKHL

SEQ ID NO: 287493 - protein, 8 aa, Influenza virus
YEELKHLI

SEQ ID NO: 287494 - protein, 8 aa, Influenza virus
SVTHFEKV

SEQ ID NO: 287495 - protein, 8 aa, Influenza virus
VTHFEKVK

SEQ ID NO: 287496 - protein, 8 aa, Influenza virus
THFEKVKI

SEQ ID NO: 287497 - protein, 8 aa, Influenza virus
HFEKVRIL

SEQ ID NO: 287498 - protein, 8 aa, Influenza virus
FEKVRILP

SEQ ID NO: 287499 - protein, 8 aa, Influenza virus
EKVKILPR

SEQ ID NO: 287500 - protein, 8 aa, Influenza virus
KVKILPRD

SEQ ID NO: 287501 - protein, 8 aa, Influenza virus
SSFFRNMV

SEQ ID NO: 287502 - protein, 8 aa, Influenza virus
SFFRNMIW

SEQ ID NO: 287503 - protein, 8 aa, Influenza virus
FFRNMIWL

SEQ ID NO: 287504 - protein, 8 aa, Influenza virus
FRNMIWLT

SEQ ID NO: 287505 - protein, 8 aa, Influenza virus
IAKRSYNN

SEQ ID NO: 287506 - protein, 8 aa, Influenza virus
AKRSYNNT

SEQ ID NO: 287507 - protein, 8 aa, Influenza virus
KRSYNNTS

SEQ ID NO: 287508 - protein, 8 aa, Influenza virus
RSYNNTSG

SEQ ID NO: 287509 - protein, 8 aa, Influenza virus
SYNNTNGE

SEQ ID NO: 287510 - protein, 8 aa, Influenza virus
YNNTNGEQ

SEQ ID NO: 287511 - protein, 8 aa, Influenza virus
NNTNGEQI

SEQ ID NO: 287512 - protein, 8 aa, Influenza virus
NTNGEQIL

SEQ ID NO: 287513 - protein, 8 aa, Influenza virus
TSGEQMLV

SEQ ID NO: 287514 - protein, 8 aa, Influenza virus
SGEQMLVI

SEQ ID NO: 287515 - protein, 8 aa, Influenza virus
GEQMLVIW

SEQ ID NO: 287516 - protein, 8 aa, Influenza virus
EQMLVIWG

SEQ ID NO: 287517 - protein, 8 aa, Influenza virus
LIIWGIHH

SEQ ID NO: 287518 - protein, 8 aa, Influenza virus
IIWGIHHP

SEQ ID NO: 287519 - protein, 8 aa, Influenza virus
IWGIHHPN

SEQ ID NO: 287520 - protein, 8 aa, Influenza virus
WGIHHPND

SEQ ID NO: 287521 - protein, 8 aa, Influenza virus
GIHHPNDD

SEQ ID NO: 287522 - protein, 8 aa, Influenza virus
LYQKVGTY

SEQ ID NO: 287523 - protein, 8 aa, Influenza virus
YQKVGTYV

SEQ ID NO: 287524 - protein, 8 aa, Influenza virus
QKVGTYVS

SEQ ID NO: 287525 - protein, 8 aa, Influenza virus
TSTLYKRS

SEQ ID NO: 287526 - protein, 8 aa, Influenza virus
GLGSRMEF

SEQ ID NO: 287527 - protein, 8 aa, Influenza virus
RMEFSWTI

SEQ ID NO: 287528 - protein, 8 aa, Influenza virus
MEFSWTIL

SEQ ID NO: 287529 - protein, 8 aa, Influenza virus
WDVINFES

SEQ ID NO: 287530 - protein, 8 aa, Influenza virus
DVINFEST

SEQ ID NO: 287531 - protein, 8 aa, Influenza virus
VINFESTG

SEQ ID NO: 287532 - protein, 8 aa, Influenza virus
ISFESTGN

SEQ ID NO: 287533 - protein, 8 aa, Influenza virus
SFESTGNL

SEQ ID NO: 287534 - protein, 8 aa, Influenza virus
FESTGNLV

SEQ ID NO: 287535 - protein, 8 aa, Influenza virus
ESTGNLVA

SEQ ID NO: 287536 - protein, 8 aa, Influenza virus
STGNLVAP

SEQ ID NO: 287537 - protein, 8 aa, Influenza virus
TGNLVAPE

SEQ ID NO: 287538 - protein, 8 aa, Influenza virus
GNLVAPEY

SEQ ID NO: 287539 - protein, 8 aa, Influenza virus
NLVAPEYG

SEQ ID NO: 287540 - protein, 8 aa, Influenza virus
LVAPEYGF

SEQ ID NO: 287541 - protein, 8 aa, Influenza virus
VAPEYGFK

SEQ ID NO: 287542 - protein, 8 aa, Influenza virus
VPEYGFKI

SEQ ID NO: 287543 - protein, 8 aa, Influenza virus
EYGFKISR

SEQ ID NO: 287544 - protein, 8 aa, Influenza virus
YGFRISKR

SEQ ID NO: 287545 - protein, 8 aa, Influenza virus
GFKISRRG

SEQ ID NO: 287546 - protein, 8 aa, Influenza virus
FKISKRGG

SEQ ID NO: 287547 - protein, 8 aa, Influenza virus
KISKRGGS

SEQ ID NO: 287548 - protein, 8 aa, Influenza virus
ISKRGGSG

SEQ ID NO: 287549 - protein, 8 aa, Influenza virus
SKRGGSGI

SEQ ID NO: 287550 - protein, 8 aa, Influenza virus
KRGGSGIM

SEQ ID NO: 287551 - protein, 8 aa, Influenza virus
RGGSGIMK

SEQ ID NO: 287552 - protein, 8 aa, Influenza virus
GGSGIMKT

SEQ ID NO: 287553 - protein, 8 aa, Influenza virus
GSGIMKTE

SEQ ID NO: 287554 - protein, 8 aa, Influenza virus
SGIMKTEK

SEQ ID NO: 287555 - protein, 8 aa, Influenza virus
GIMKTEKT

SEQ ID NO: 287556 - protein, 8 aa, Influenza virus
IMKTEKTL

SEQ ID NO: 287557 - protein, 8 aa, Influenza virus
MKTEGTLG

SEQ ID NO: 287558 - protein, 8 aa, Influenza virus
GNCETKCQ

SEQ ID NO: 287559 - protein, 8 aa, Influenza virus
NCETKCQS

SEQ ID NO: 287560 - protein, 8 aa, Influenza virus
CETKCQSP

SEQ ID NO: 287561 - protein, 8 aa, Influenza virus
ETKCQSPL

SEQ ID NO: 287562 - protein, 8 aa, Influenza virus
TKCQSPLG

SEQ ID NO: 287563 - protein, 8 aa, Influenza virus
KCQSPLGA

SEQ ID NO: 287564 - protein, 8 aa, Influenza virus
CQTPLGAL

SEQ ID NO: 287565 - protein, 8 aa, Influenza virus
QTPLGALN

SEQ ID NO: 287566 - protein, 8 aa, Influenza virus
TPLGALNT

SEQ ID NO: 287567 - protein, 8 aa, Influenza virus
PLGALNTT

SEQ ID NO: 287568 - protein, 8 aa, Influenza virus
LGALNTTL

SEQ ID NO: 287569 - protein, 8 aa, Influenza virus
GALNTTLP

SEQ ID NO: 287570 - protein, 8 aa, Influenza virus
ALNTTLPF

SEQ ID NO: 287571 - protein, 8 aa, Influenza virus
LNTTLPFH

SEQ ID NO: 287572 - protein, 8 aa, Influenza virus
TTLPFHNI

SEQ ID NO: 287573 - protein, 8 aa, Influenza virus
TLPFHNIH

SEQ ID NO: 287574 - protein, 8 aa, Influenza virus
LPFHNIHP

SEQ ID NO: 287575 - protein, 8 aa, Influenza virus
PFHNIHPL

SEQ ID NO: 287576 - protein, 8 aa, Influenza virus
FHNIHPLT

SEQ ID NO: 287577 - protein, 8 aa, Influenza virus
HNIHPLTI

SEQ ID NO: 287578 - protein, 8 aa, Influenza virus
NIHPLTIG

SEQ ID NO: 287579 - protein, 8 aa, Influenza virus
IHPLTIGE

SEQ ID NO: 287580 - protein, 8 aa, Influenza virus
HPLAIGEC

SEQ ID NO: 287581 - protein, 8 aa, Influenza virus
PLTMGECP

SEQ ID NO: 287582 - protein, 8 aa, Influenza virus
LAIGECPK

SEQ ID NO: 287583 - protein, 8 aa, Influenza virus
TMGECPKY

SEQ ID NO: 287584 - protein, 8 aa, Influenza virus
MGECPKYV

SEQ ID NO: 287585 - protein, 8 aa, Influenza virus
GECPKYVR

SEQ ID NO: 287586 - protein, 8 aa, Influenza virus
ECPKYVRS

SEQ ID NO: 287587 - protein, 8 aa, Influenza virus
CPKYVKSD

SEQ ID NO: 287588 - protein, 8 aa, Influenza virus
PKYVKSDR

SEQ ID NO: 287589 - protein, 8 aa, Influenza virus
KYVKSDRL

SEQ ID NO: 287590 - protein, 8 aa, Influenza virus
YVKSDRLV

SEQ ID NO: 287591 - protein, 8 aa, Influenza virus
VKSDRLVL

SEQ ID NO: 287592 - protein, 8 aa, Influenza virus
KSDRLVLA

SEQ ID NO: 287593 - protein, 8 aa, Influenza virus
SDRLVLAT

SEQ ID NO: 287594 - protein, 8 aa, Influenza virus
DRLVLATG

SEQ ID NO: 287595 - protein, 8 aa, Influenza virus
RLVLATGL

SEQ ID NO: 287596 - protein, 8 aa, Influenza virus
LVLATGPR

SEQ ID NO: 287597 - protein, 8 aa, Influenza virus
VLATGPRN

SEQ ID NO: 287598 - protein, 8 aa, Influenza virus
LATGLRNI

SEQ ID NO: 287599 - protein, 8 aa, Influenza virus
ATGLRNIP

SEQ ID NO: 287600 - protein, 8 aa, Influenza virus
TGLRNIPQ

SEQ ID NO: 287601 - protein, 8 aa, Influenza virus
GLRNIPQI

SEQ ID NO: 287602 - protein, 8 aa, Influenza virus
LRNIPQIE

SEQ ID NO: 287603 - protein, 8 aa, Influenza virus
RNIPQIES

SEQ ID NO: 287604 - protein, 8 aa, Influenza virus
NIPQIESR

SEQ ID NO: 287605 - protein, 8 aa, Influenza virus
IPQIESRG

SEQ ID NO: 287606 - protein, 8 aa, Influenza virus
PQMESRGL

SEQ ID NO: 287607 - protein, 8 aa, Influenza virus
QMESRGLF

SEQ ID NO: 287608 - protein, 8 aa, Influenza virus
MESRGLFG

SEQ ID NO: 287609 - protein, 8 aa, Influenza virus
EPRGLFGA

SEQ ID NO: 287610 - protein, 8 aa, Influenza virus
PRGLFGAI

SEQ ID NO: 287611 - protein, 8 aa, Influenza virus
EGGWQGMI

SEQ ID NO: 287612 - protein, 8 aa, Influenza virus
GGWQGMID

SEQ ID NO: 287613 - protein, 8 aa, Influenza virus
GWQGMIDG

SEQ ID NO: 287614 - protein, 8 aa, Influenza virus
WQGMIDGW

SEQ ID NO: 287615 - protein, 8 aa, Influenza virus
QGMIDGWY

SEQ ID NO: 287616 - protein, 8 aa, Influenza virus
GMIDGWYG

SEQ ID NO: 287617 - protein, 8 aa, Influenza virus
MIDGWYGY

SEQ ID NO: 287618 - protein, 8 aa, Influenza virus
IDGWYGYH

SEQ ID NO: 287619 - protein, 8 aa, Influenza virus
HHSNDQGA

SEQ ID NO: 287620 - protein, 8 aa, Influenza virus
HSNDQGAG

SEQ ID NO: 287621 - protein, 8 aa, Influenza virus
SNDQGAGY

SEQ ID NO: 287622 - protein, 8 aa, Influenza virus
NDQGAGYA

SEQ ID NO: 287623 - protein, 8 aa, Influenza virus
DQGAGYAA

SEQ ID NO: 287624 - protein, 8 aa, Influenza virus
QGAGYAAD

SEQ ID NO: 287625 - protein, 8 aa, Influenza virus
GAGYAADK

SEQ ID NO: 287626 - protein, 8 aa, Influenza virus
SGYAADKA

SEQ ID NO: 287627 - protein, 8 aa, Influenza virus
GYAADKAS

SEQ ID NO: 287628 - protein, 8 aa, Influenza virus
YAADKAST

SEQ ID NO: 287629 - protein, 8 aa, Influenza virus
AADKASTQ

SEQ ID NO: 287630 - protein, 8 aa, Influenza virus
ADKASTQK

SEQ ID NO: 287631 - protein, 8 aa, Influenza virus
DKASTQKA

SEQ ID NO: 287632 - protein, 8 aa, Influenza virus
KESTQKAI

SEQ ID NO: 287633 - protein, 8 aa, Influenza virus
VNSIIEKM

SEQ ID NO: 287634 - protein, 8 aa, Influenza virus
NSIIEKMN

SEQ ID NO: 287635 - protein, 8 aa, Influenza virus
SIIEKMNT

SEQ ID NO: 287636 - protein, 8 aa, Influenza virus
IIEKMNTQ

SEQ ID NO: 287637 - protein, 8 aa, Influenza virus
IEKMNIQF

SEQ ID NO: 287638 - protein, 8 aa, Influenza virus
EKMNIQFE

SEQ ID NO: 287639 - protein, 8 aa, Influenza virus
AVGKEFNN

SEQ ID NO: 287640 - protein, 8 aa, Influenza virus
VGKEFNNL

SEQ ID NO: 287641 - protein, 8 aa, Influenza virus
GKEFNNLE

SEQ ID NO: 287642 - protein, 8 aa, Influenza virus
KEFSNLEK

SEQ ID NO: 287643 - protein, 8 aa, Influenza virus
EFSNLEKR

SEQ ID NO: 287644 - protein, 8 aa, Influenza virus
FSNLEKRL

SEQ ID NO: 287645 - protein, 8 aa, Influenza virus
SNLEKRLE

SEQ ID NO: 287646 - protein, 8 aa, Influenza virus
NLEKRLEN

SEQ ID NO: 287647 - protein, 8 aa, Influenza virus
LEKRLENL

SEQ ID NO: 287648 - protein, 8 aa, Influenza virus
EKRLENLN

SEQ ID NO: 287649 - protein, 8 aa, Influenza virus
KRLENLNK

SEQ ID NO: 287650 - protein, 8 aa, Influenza virus
RLENLSKR

SEQ ID NO: 287651 - protein, 8 aa, Influenza virus
LENLNKKV

SEQ ID NO: 287652 - protein, 8 aa, Influenza virus
ENLNKKVE

SEQ ID NO: 287653 - protein, 8 aa, Influenza virus
NLNKKVED

SEQ ID NO: 287654 - protein, 8 aa, Influenza virus
LNKKVEDG

SEQ ID NO: 287655 - protein, 8 aa, Influenza virus
NKKVEDGF

SEQ ID NO: 287656 - protein, 8 aa, Influenza virus
MEDGFIDV

SEQ ID NO: 287657 - protein, 8 aa, Influenza virus
EDGFIDVW

SEQ ID NO: 287658 - protein, 8 aa, Influenza virus
DGFIDVWT

SEQ ID NO: 287659 - protein, 8 aa, Influenza virus
GFIDVWTY

SEQ ID NO: 287660 - protein, 8 aa, Influenza virus
FIDVWTYN

SEQ ID NO: 287661 - protein, 8 aa, Influenza virus
IDVWTYNA

SEQ ID NO: 287662 - protein, 8 aa, Influenza virus
GVWTYNAE

SEQ ID NO: 287663 - protein, 8 aa, Influenza virus
LVLMENEM

SEQ ID NO: 287664 - protein, 8 aa, Influenza virus
VLMENEMT

SEQ ID NO: 287665 - protein, 8 aa, Influenza virus
LMENEMTL

SEQ ID NO: 287666 - protein, 8 aa, Influenza virus
MENEMTLD

SEQ ID NO: 287667 - protein, 8 aa, Influenza virus
ENEMTLDF

SEQ ID NO: 287668 - protein, 8 aa, Influenza virus
NEMTLDFH

SEQ ID NO: 287669 - protein, 8 aa, Influenza virus
EMTLDFHD

SEQ ID NO: 287670 - protein, 8 aa, Influenza virus
MTLDFHDS

SEQ ID NO: 287671 - protein, 8 aa, Influenza virus
ILDFHDSN

SEQ ID NO: 287672 - protein, 8 aa, Influenza virus
LGFHDSNV

SEQ ID NO: 287673 - protein, 8 aa, Influenza virus
DFHDSNVR

SEQ ID NO: 287674 - protein, 8 aa, Influenza virus
FHDSNVKS

SEQ ID NO: 287675 - protein, 8 aa, Influenza virus
HDSNVKSL

SEQ ID NO: 287676 - protein, 8 aa, Influenza virus
DSNVKSLY

SEQ ID NO: 287677 - protein, 8 aa, Influenza virus
SNVKSLYD

SEQ ID NO: 287678 - protein, 8 aa, Influenza virus
VKSLYDKV

SEQ ID NO: 287679 - protein, 8 aa, Influenza virus
KSLYDKVR

SEQ ID NO: 287680 - protein, 8 aa, Influenza virus
SLYDKVRM

SEQ ID NO: 287681 - protein, 8 aa, Influenza virus
LYNKVRMQ

SEQ ID NO: 287682 - protein, 8 aa, Influenza virus
YNKVRMQL

SEQ ID NO: 287683 - protein, 8 aa, Influenza virus
NKVRMQLR

SEQ ID NO: 287684 - protein, 8 aa, Influenza virus
KVRMQLKD

SEQ ID NO: 287685 - protein, 8 aa, Influenza virus
RMQLRDNA

SEQ ID NO: 287686 - protein, 8 aa, Influenza virus
MQLRDNAK

SEQ ID NO: 287687 - protein, 8 aa, Influenza virus
QLRDNAKE

SEQ ID NO: 287688 - protein, 8 aa, Influenza virus
LRDNAKEI

SEQ ID NO: 287689 - protein, 8 aa, Influenza virus
RDNAKEIG

SEQ ID NO: 287690 - protein, 8 aa, Influenza virus
DNAKEIGN

SEQ ID NO: 287691 - protein, 8 aa, Influenza virus
NAKEIGNG

SEQ ID NO: 287692 - protein, 8 aa, Influenza virus
AKEIGNGC

SEQ ID NO: 287693 - protein, 8 aa, Influenza virus
KEIGNGCF

SEQ ID NO: 287694 - protein, 8 aa, Influenza virus
EIGNGCFE

SEQ ID NO: 287695 - protein, 8 aa, Influenza virus
IGNGCFEF

SEQ ID NO: 287696 - protein, 8 aa, Influenza virus
FEFYHKCN

SEQ ID NO: 287697 - protein, 8 aa, Influenza virus
EFYHKCDN

SEQ ID NO: 287698 - protein, 8 aa, Influenza virus
FYHKCDNE

SEQ ID NO: 287699 - protein, 8 aa, Influenza virus
YHKCDNEC

SEQ ID NO: 287700 - protein, 8 aa, Influenza virus
HKCDNECM

SEQ ID NO: 287701 - protein, 8 aa, Influenza virus
CMNSVRNG

SEQ ID NO: 287702 - protein, 8 aa, Influenza virus
MNSVRNGT

SEQ ID NO: 287703 - protein, 8 aa, Influenza virus
NSVRNGTY

SEQ ID NO: 287704 - protein, 8 aa, Influenza virus
SVRNGTYD

SEQ ID NO: 287705 - protein, 8 aa, Influenza virus
VRNGTYDY

SEQ ID NO: 287706 - protein, 8 aa, Influenza virus
RNGTYDYP

SEQ ID NO: 287707 - protein, 8 aa, Influenza virus
NGTYYYPK

SEQ ID NO: 287708 - protein, 8 aa, Influenza virus
GTYYYPKY

SEQ ID NO: 287709 - protein, 8 aa, Influenza virus
TYYYPKYE

SEQ ID NO: 287710 - protein, 8 aa, Influenza virus
YYYPKYEE

SEQ ID NO: 287711 - protein, 8 aa, Influenza virus
YYPKYEEE

SEQ ID NO: 287712 - protein, 8 aa, Influenza virus
YPKYEKES

SEQ ID NO: 287713 - protein, 8 aa, Influenza virus
PKYEEESR

SEQ ID NO: 287714 - protein, 8 aa, Influenza virus
KYEEESRL

SEQ ID NO: 287715 - protein, 8 aa, Influenza virus
YEEESKLK

SEQ ID NO: 287716 - protein, 8 aa, Influenza virus
EEESKLKR

SEQ ID NO: 287717 - protein, 8 aa, Influenza virus
EESKLKRN

SEQ ID NO: 287718 - protein, 8 aa, Influenza virus
ESKLKRNE

SEQ ID NO: 287719 - protein, 8 aa, Influenza virus
SKLKRNEI

SEQ ID NO: 287720 - protein, 8 aa, Influenza virus
KLKRNEIK

SEQ ID NO: 287721 - protein, 8 aa, Influenza virus
LKRNEIKG

SEQ ID NO: 287722 - protein, 8 aa, Influenza virus
KRNEIKGV

SEQ ID NO: 287723 - protein, 8 aa, Influenza virus
RNEIKGVE

SEQ ID NO: 287724 - protein, 8 aa, Influenza virus
NEIKGVEL

SEQ ID NO: 287725 - protein, 8 aa, Influenza virus
EIKGVELS

SEQ ID NO: 287726 - protein, 8 aa, Influenza virus
IKGVKLSN

SEQ ID NO: 287727 - protein, 8 aa, Influenza virus
KGVKLSNM

SEQ ID NO: 287728 - protein, 8 aa, Influenza virus
GVKLSNMG

SEQ ID NO: 287729 - protein, 8 aa, Influenza virus
VKLSNMGV

SEQ ID NO: 287730 - protein, 8 aa, Influenza virus
KLSNMGVY

SEQ ID NO: 287731 - protein, 8 aa, Influenza virus
LSNMGVYQ

SEQ ID NO: 287732 - protein, 8 aa, Influenza virus
SNMGVYQI

SEQ ID NO: 287733 - protein, 8 aa, Influenza virus
NMGVYQIL

SEQ ID NO: 287734 - protein, 8 aa, Influenza virus
MGIYQILA

SEQ ID NO: 287735 - protein, 8 aa, Influenza virus
GIYQILAI

SEQ ID NO: 287736 - protein, 8 aa, Influenza virus
IYQILAIY

SEQ ID NO: 287737 - protein, 8 aa, Influenza virus
YQILVIYA

SEQ ID NO: 287738 - protein, 8 aa, Influenza virus
QVLAIYAT

SEQ ID NO: 287739 - protein, 8 aa, Influenza virus
ILVIYATV

SEQ ID NO: 287740 - protein, 8 aa, Influenza virus
SLSLAIMI

SEQ ID NO: 287741 - protein, 8 aa, Influenza virus
LSLAIMIA

SEQ ID NO: 287742 - protein, 8 aa, Influenza virus
SLAIMIAG

SEQ ID NO: 287743 - protein, 8 aa, Influenza virus
LAIMIAGI

SEQ ID NO: 287744 - protein, 8 aa, Influenza virus
AIMIAGIS

SEQ ID NO: 287745 - protein, 8 aa, Influenza virus
AGISLWMC

SEQ ID NO: 287746 - protein, 8 aa, Influenza virus
GISLWMCS

SEQ ID NO: 287747 - protein, 8 aa, Influenza virus
ISLWMCSN

SEQ ID NO: 287748 - protein, 8 aa, Influenza virus
SLWMCSNG

SEQ ID NO: 287749 - protein, 8 aa, Influenza virus
LWMCSNGS

SEQ ID NO: 287750 - protein, 8 aa, Influenza virus
NGSLQFRI

SEQ ID NO: 287751 - protein, 8 aa, Influenza virus
GSLQCRVC

SEQ ID NO: 287752 - protein, 8 aa, Influenza virus
SLQFRICI

SEQ ID NO: 287753 - protein, 8 aa, Influenza virus
MNPNQKTI

SEQ ID NO: 287754 - protein, 8 aa, Influenza virus
NPNQKTIT

SEQ ID NO: 287755 - protein, 8 aa, Influenza virus
PNQKTITI

SEQ ID NO: 287756 - protein, 8 aa, Influenza virus
NQKTITIG

SEQ ID NO: 287757 - protein, 8 aa, Influenza virus
QKTITIGS

SEQ ID NO: 287758 - protein, 8 aa, Influenza virus
KIITIGSA

SEQ ID NO: 287759 - protein, 8 aa, Influenza virus
IITIGSAS

SEQ ID NO: 287760 - protein, 8 aa, Influenza virus
ITIGSASL

SEQ ID NO: 287761 - protein, 8 aa, Influenza virus
TIGSASLT

SEQ ID NO: 287762 - protein, 8 aa, Influenza virus
QIAILVTT

SEQ ID NO: 287763 - protein, 8 aa, Influenza virus
IAILVTTV

SEQ ID NO: 287764 - protein, 8 aa, Influenza virus
AILVTTVT

SEQ ID NO: 287765 - protein, 8 aa, Influenza virus
ILVTTVTL

SEQ ID NO: 287766 - protein, 8 aa, Influenza virus
LVTTVTLH

SEQ ID NO: 287767 - protein, 8 aa, Influenza virus
VTTVTLHF

SEQ ID NO: 287768 - protein, 8 aa, Influenza virus
TTITLHFK

SEQ ID NO: 287769 - protein, 8 aa, Influenza virus
TITLHFKQ

SEQ ID NO: 287770 - protein, 8 aa, Influenza virus
VTLHFKQN

SEQ ID NO: 287771 - protein, 8 aa, Influenza virus
TLHFKQNE

SEQ ID NO: 287772 - protein, 8 aa, Influenza virus
LHFKQNEC

SEQ ID NO: 287773 - protein, 8 aa, Influenza virus
HFKQNECS

SEQ ID NO: 287774 - protein, 8 aa, Influenza virus
PCEPIIVE

SEQ ID NO: 287775 - protein, 8 aa, Influenza virus
CEPIIVER

SEQ ID NO: 287776 - protein, 8 aa, Influenza virus
EPIIVERN

SEQ ID NO: 287777 - protein, 8 aa, Influenza virus
TEIVYLND

SEQ ID NO: 287778 - protein, 8 aa, Influenza virus
EIVYLNDT

SEQ ID NO: 287779 - protein, 8 aa, Influenza virus
IVYLNDTI

SEQ ID NO: 287780 - protein, 8 aa, Influenza virus
YLNDTIIE

SEQ ID NO: 287781 - protein, 8 aa, Influenza virus
YRSWSKPQ

SEQ ID NO: 287782 - protein, 8 aa, Influenza virus
RSWSKPQC

SEQ ID NO: 287783 - protein, 8 aa, Influenza virus
WSKPQCKI

SEQ ID NO: 287784 - protein, 8 aa, Influenza virus
SKPQCKIT

SEQ ID NO: 287785 - protein, 8 aa, Influenza virus
KPQCKITG

SEQ ID NO: 287786 - protein, 8 aa, Influenza virus
PQCKITGF

SEQ ID NO: 287787 - protein, 8 aa, Influenza virus
QCKITGFA

SEQ ID NO: 287788 - protein, 8 aa, Influenza virus
CKITGFAP

SEQ ID NO: 287789 - protein, 8 aa, Influenza virus
KITGFAPF

SEQ ID NO: 287790 - protein, 8 aa, Influenza virus
NSIRLSAD

SEQ ID NO: 287791 - protein, 8 aa, Influenza virus
PIRLSGGG

SEQ ID NO: 287792 - protein, 8 aa, Influenza virus
IRLSASGD

SEQ ID NO: 287793 - protein, 8 aa, Influenza virus
RLSADGDI

SEQ ID NO: 287794 - protein, 8 aa, Influenza virus
LSADGDIW

SEQ ID NO: 287795 - protein, 8 aa, Influenza virus
SAGGDIWI

SEQ ID NO: 287796 - protein, 8 aa, Influenza virus
AGGDIWIT

SEQ ID NO: 287797 - protein, 8 aa, Influenza virus
GGDIWITR

SEQ ID NO: 287798 - protein, 8 aa, Influenza virus
GDIWITRE

SEQ ID NO: 287799 - protein, 8 aa, Influenza virus
DIWITREP

SEQ ID NO: 287800 - protein, 8 aa, Influenza virus
IWITREPY

SEQ ID NO: 287801 - protein, 8 aa, Influenza virus
WITREPYV

SEQ ID NO: 287802 - protein, 8 aa, Influenza virus
ITREPYVS

SEQ ID NO: 287803 - protein, 8 aa, Influenza virus
REPYVSCS

SEQ ID NO: 287804 - protein, 8 aa, Influenza virus
EPYVSCDT

SEQ ID NO: 287805 - protein, 8 aa, Influenza virus
SKCYQFAL

SEQ ID NO: 287806 - protein, 8 aa, Influenza virus
LGQGTTLN

SEQ ID NO: 287807 - protein, 8 aa, Influenza virus
GQGTTLNN

SEQ ID NO: 287808 - protein, 8 aa, Influenza virus
QGTTLENK

SEQ ID NO: 287809 - protein, 8 aa, Influenza virus
GTTLENKH

SEQ ID NO: 287810 - protein, 8 aa, Influenza virus
TTLENKHS

SEQ ID NO: 287811 - protein, 8 aa, Influenza virus
TLNNKHSN

SEQ ID NO: 287812 - protein, 8 aa, Influenza virus
LDNKHSND

SEQ ID NO: 287813 - protein, 8 aa, Influenza virus
DNKHSNDT

SEQ ID NO: 287814 - protein, 8 aa, Influenza virus
NKHSNDTI

SEQ ID NO: 287815 - protein, 8 aa, Influenza virus
KHSNDTIH

SEQ ID NO: 287816 - protein, 8 aa, Influenza virus
HSNDTIHD

SEQ ID NO: 287817 - protein, 8 aa, Influenza virus
SNDTIHDR

SEQ ID NO: 287818 - protein, 8 aa, Influenza virus
TVHDRIPH

SEQ ID NO: 287819 - protein, 8 aa, Influenza virus
VHDRIPHR

SEQ ID NO: 287820 - protein, 8 aa, Influenza virus
HDRTPHRT

SEQ ID NO: 287821 - protein, 8 aa, Influenza virus
DRTPHRTL

SEQ ID NO: 287822 - protein, 8 aa, Influenza virus
RTPHRTLL

SEQ ID NO: 287823 - protein, 8 aa, Influenza virus
TPHRTLLM

SEQ ID NO: 287824 - protein, 8 aa, Influenza virus
LMNELGVS

SEQ ID NO: 287825 - protein, 8 aa, Influenza virus
MNELGVSF

SEQ ID NO: 287826 - protein, 8 aa, Influenza virus
NELGVSFH

SEQ ID NO: 287827 - protein, 8 aa, Influenza virus
ELGVSFHL

SEQ ID NO: 287828 - protein, 8 aa, Influenza virus
LGVSFHLG

SEQ ID NO: 287829 - protein, 8 aa, Influenza virus
GVSFHLGT

SEQ ID NO: 287830 - protein, 8 aa, Influenza virus
VPFHLGTR

SEQ ID NO: 287831 - protein, 8 aa, Influenza virus
PFHLGTRQ

SEQ ID NO: 287832 - protein, 8 aa, Influenza virus
FHLGTRQV

SEQ ID NO: 287833 - protein, 8 aa, Influenza virus
HLGTRQVC

SEQ ID NO: 287834 - protein, 8 aa, Influenza virus
LGTRQVCI

SEQ ID NO: 287835 - protein, 8 aa, Influenza virus
GTRQVCIA

SEQ ID NO: 287836 - protein, 8 aa, Influenza virus
TRQVCIAW

SEQ ID NO: 287837 - protein, 8 aa, Influenza virus
RQVCIAWS

SEQ ID NO: 287838 - protein, 8 aa, Influenza virus
QVCIAWSS

SEQ ID NO: 287839 - protein, 8 aa, Influenza virus
VCIAWSSS

SEQ ID NO: 287840 - protein, 8 aa, Influenza virus
CIAWSSSS

SEQ ID NO: 287841 - protein, 8 aa, Influenza virus
IAWSSSSC

SEQ ID NO: 287842 - protein, 8 aa, Influenza virus
SSSCHDGR

SEQ ID NO: 287843 - protein, 8 aa, Influenza virus
SSCHDGRA

SEQ ID NO: 287844 - protein, 8 aa, Influenza virus
SCHDGRAW

SEQ ID NO: 287845 - protein, 8 aa, Influenza virus
CHDGRAWL

SEQ ID NO: 287846 - protein, 8 aa, Influenza virus
HDGRAWLH

SEQ ID NO: 287847 - protein, 8 aa, Influenza virus
DGRAWLHV

SEQ ID NO: 287848 - protein, 8 aa, Influenza virus
GRAWLHVC

SEQ ID NO: 287849 - protein, 8 aa, Influenza virus
KAWLHVCI

SEQ ID NO: 287850 - protein, 8 aa, Influenza virus
AWLHVCIT

SEQ ID NO: 287851 - protein, 8 aa, Influenza virus
WLHVCITG

SEQ ID NO: 287852 - protein, 8 aa, Influenza virus
LHVCITGD

SEQ ID NO: 287853 - protein, 8 aa, Influenza virus
HVCITGDD

SEQ ID NO: 287854 - protein, 8 aa, Influenza virus
CVTGDDKN

SEQ ID NO: 287855 - protein, 8 aa, Influenza virus
VTGDDKNA

SEQ ID NO: 287856 - protein, 8 aa, Influenza virus
TGDDKNAT

SEQ ID NO: 287857 - protein, 8 aa, Influenza virus
GDDKNATA

SEQ ID NO: 287858 - protein, 8 aa, Influenza virus
DDKNATAS

SEQ ID NO: 287859 - protein, 8 aa, Influenza virus
DKNATASF

SEQ ID NO: 287860 - protein, 8 aa, Influenza virus
KNATASFI

SEQ ID NO: 287861 - protein, 8 aa, Influenza virus
NATASLIY

SEQ ID NO: 287862 - protein, 8 aa, Influenza virus
ATASFIYN

SEQ ID NO: 287863 - protein, 8 aa, Influenza virus
TASFIYNG

SEQ ID NO: 287864 - protein, 8 aa, Influenza virus
DSIVSWSQ

SEQ ID NO: 287865 - protein, 8 aa, Influenza virus
SIVSWSQN

SEQ ID NO: 287866 - protein, 8 aa, Influenza virus
IVSWSQNI

SEQ ID NO: 287867 - protein, 8 aa, Influenza virus
VSWSQNIL

SEQ ID NO: 287868 - protein, 8 aa, Influenza virus
SHNILRTQ

SEQ ID NO: 287869 - protein, 8 aa, Influenza virus
HNILRTQE

SEQ ID NO: 287870 - protein, 8 aa, Influenza virus
RTHESECV

SEQ ID NO: 287871 - protein, 8 aa, Influenza virus
TQESECIC

SEQ ID NO: 287872 - protein, 8 aa, Influenza virus
QESECICI

SEQ ID NO: 287873 - protein, 8 aa, Influenza virus
ESECVCIS

SEQ ID NO: 287874 - protein, 8 aa, Influenza virus
SECVCISG

SEQ ID NO: 287875 - protein, 8 aa, Influenza virus
ECVCINGS

SEQ ID NO: 287876 - protein, 8 aa, Influenza virus
CVCINGSC

SEQ ID NO: 287877 - protein, 8 aa, Influenza virus
VCINGSCT

SEQ ID NO: 287878 - protein, 8 aa, Influenza virus
CINGSCTV

SEQ ID NO: 287879 - protein, 8 aa, Influenza virus
INGSCTVV

SEQ ID NO: 287880 - protein, 8 aa, Influenza virus
NGSCTVVM

SEQ ID NO: 287881 - protein, 8 aa, Influenza virus
GSCTVVMT

SEQ ID NO: 287882 - protein, 8 aa, Influenza virus
SCTVVMTD

SEQ ID NO: 287883 - protein, 8 aa, Influenza virus
CAVVMTDG

SEQ ID NO: 287884 - protein, 8 aa, Influenza virus
AVVMTDGS

SEQ ID NO: 287885 - protein, 8 aa, Influenza virus
TDGSASGK

SEQ ID NO: 287886 - protein, 8 aa, Influenza virus
DGSASGKA

SEQ ID NO: 287887 - protein, 8 aa, Influenza virus
GSASGKAD

SEQ ID NO: 287888 - protein, 8 aa, Influenza virus
SASGKADT

SEQ ID NO: 287889 - protein, 8 aa, Influenza virus
ASGKADTR

SEQ ID NO: 287890 - protein, 8 aa, Influenza virus
SGKADTRI

SEQ ID NO: 287891 - protein, 8 aa, Influenza virus
GKADTRIL

SEQ ID NO: 287892 - protein, 8 aa, Influenza virus
KADTRILF

SEQ ID NO: 287893 - protein, 8 aa, Influenza virus
ADTRILFV

SEQ ID NO: 287894 - protein, 8 aa, Influenza virus
DTRILFIE

SEQ ID NO: 287895 - protein, 8 aa, Influenza virus
TRILFIEE

SEQ ID NO: 287896 - protein, 8 aa, Influenza virus
RILFIEEG

SEQ ID NO: 287897 - protein, 8 aa, Influenza virus
ILFIEEGK

SEQ ID NO: 287898 - protein, 8 aa, Influenza virus
LFIEEGKI

SEQ ID NO: 287899 - protein, 8 aa, Influenza virus
EGKIIHIS

SEQ ID NO: 287900 - protein, 8 aa, Influenza virus
GKIIHISP

SEQ ID NO: 287901 - protein, 8 aa, Influenza virus
KIIHISPL

SEQ ID NO: 287902 - protein, 8 aa, Influenza virus
IHISPLSG

SEQ ID NO: 287903 - protein, 8 aa, Influenza virus
HIGPLSGS

SEQ ID NO: 287904 - protein, 8 aa, Influenza virus
IGPLSGSA

SEQ ID NO: 287905 - protein, 8 aa, Influenza virus
GPLSGSAQ

SEQ ID NO: 287906 - protein, 8 aa, Influenza virus
PLAGSAQH

SEQ ID NO: 287907 - protein, 8 aa, Influenza virus
LSGSAQHV

SEQ ID NO: 287908 - protein, 8 aa, Influenza virus
SGSAQHVE

SEQ ID NO: 287909 - protein, 8 aa, Influenza virus
GSAQHVEE

SEQ ID NO: 287910 - protein, 8 aa, Influenza virus
SAQHVEEC

SEQ ID NO: 287911 - protein, 8 aa, Influenza virus
AQHVEECS

SEQ ID NO: 287912 - protein, 8 aa, Influenza virus
QHVEECSC

SEQ ID NO: 287913 - protein, 8 aa, Influenza virus
HVEECSCY

SEQ ID NO: 287914 - protein, 8 aa, Influenza virus
VEECSCYP

SEQ ID NO: 287915 - protein, 8 aa, Influenza virus
EECSCYSR

SEQ ID NO: 287916 - protein, 8 aa, Influenza virus
ECSCYPQY

SEQ ID NO: 287917 - protein, 8 aa, Influenza virus
CSCYPQYP

SEQ ID NO: 287918 - protein, 8 aa, Influenza virus
SCYPRYPG

SEQ ID NO: 287919 - protein, 8 aa, Influenza virus
CYPRYPGV

SEQ ID NO: 287920 - protein, 8 aa, Influenza virus
YPRYPGVR

SEQ ID NO: 287921 - protein, 8 aa, Influenza virus
PRYPGVRC

SEQ ID NO: 287922 - protein, 8 aa, Influenza virus
RYPGVRCI

SEQ ID NO: 287923 - protein, 8 aa, Influenza virus
YPGVRCIC

SEQ ID NO: 287924 - protein, 8 aa, Influenza virus
PGVRCICR

SEQ ID NO: 287925 - protein, 8 aa, Influenza virus
GVRCICRD

SEQ ID NO: 287926 - protein, 8 aa, Influenza virus
VRCVCRDN

SEQ ID NO: 287927 - protein, 8 aa, Influenza virus
RCVCRDNW

SEQ ID NO: 287928 - protein, 8 aa, Influenza virus
CVCRDNWK

SEQ ID NO: 287929 - protein, 8 aa, Influenza virus
VCRDNWKG

SEQ ID NO: 287930 - protein, 8 aa, Influenza virus
CRDNWRGS

SEQ ID NO: 287931 - protein, 8 aa, Influenza virus
RDNWRGSN

SEQ ID NO: 287932 - protein, 8 aa, Influenza virus
DNWRGSNR

SEQ ID NO: 287933 - protein, 8 aa, Influenza virus
NWRGSNRP

SEQ ID NO: 287934 - protein, 8 aa, Influenza virus
WKGSNRPI

SEQ ID NO: 287935 - protein, 8 aa, Influenza virus
GSNRPVVD

SEQ ID NO: 287936 - protein, 8 aa, Influenza virus
SNRPVVDI

SEQ ID NO: 287937 - protein, 8 aa, Influenza virus
NRPVVDIN

SEQ ID NO: 287938 - protein, 8 aa, Influenza virus
DINMADYS

SEQ ID NO: 287939 - protein, 8 aa, Influenza virus
INMADYSI

SEQ ID NO: 287940 - protein, 8 aa, Influenza virus
NMADYSID

SEQ ID NO: 287941 - protein, 8 aa, Influenza virus
MADYSIDS

SEQ ID NO: 287942 - protein, 8 aa, Influenza virus
EYSIDSSY

SEQ ID NO: 287943 - protein, 8 aa, Influenza virus
YSIDSSYI

SEQ ID NO: 287944 - protein, 8 aa, Influenza virus
SIDSSYIC

SEQ ID NO: 287945 - protein, 8 aa, Influenza virus
IDSSYICS

SEQ ID NO: 287946 - protein, 8 aa, Influenza virus
DSSYICSG

SEQ ID NO: 287947 - protein, 8 aa, Influenza virus
SSYICSGL

SEQ ID NO: 287948 - protein, 8 aa, Influenza virus
SYICSGLV

SEQ ID NO: 287949 - protein, 8 aa, Influenza virus
YICSGLVG

SEQ ID NO: 287950 - protein, 8 aa, Influenza virus
ICSGLVGD

SEQ ID NO: 287951 - protein, 8 aa, Influenza virus
VGDTPRNG

SEQ ID NO: 287952 - protein, 8 aa, Influenza virus
GDTPRNGD

SEQ ID NO: 287953 - protein, 8 aa, Influenza virus
DTPRNDDR

SEQ ID NO: 287954 - protein, 8 aa, Influenza virus
TPRNDDRS

SEQ ID NO: 287955 - protein, 8 aa, Influenza virus
PRNDDRSS

SEQ ID NO: 287956 - protein, 8 aa, Influenza virus
DSSSNSNC

SEQ ID NO: 287957 - protein, 8 aa, Influenza virus
SNSNCRNP

SEQ ID NO: 287958 - protein, 8 aa, Influenza virus
NSNCRNPN

SEQ ID NO: 287959 - protein, 8 aa, Influenza virus
SNCRNPNN

SEQ ID NO: 287960 - protein, 8 aa, Influenza virus
NCRNPNNE

SEQ ID NO: 287961 - protein, 8 aa, Influenza virus
CRNPNNER

SEQ ID NO: 287962 - protein, 8 aa, Influenza virus
RNPNNERG

SEQ ID NO: 287963 - protein, 8 aa, Influenza virus
NPNNERGN

SEQ ID NO: 287964 - protein, 8 aa, Influenza virus
PNNERGNQ

SEQ ID NO: 287965 - protein, 8 aa, Influenza virus
NNERGNQG

SEQ ID NO: 287966 - protein, 8 aa, Influenza virus
NERGNQGV

SEQ ID NO: 287967 - protein, 8 aa, Influenza virus
ERGNQGVK

SEQ ID NO: 287968 - protein, 8 aa, Influenza virus
RGNQGVKG

SEQ ID NO: 287969 - protein, 8 aa, Influenza virus
GNQGVKGW

SEQ ID NO: 287970 - protein, 8 aa, Influenza virus
NQGVKGWA

SEQ ID NO: 287971 - protein, 8 aa, Influenza virus
QGVKGWAF

SEQ ID NO: 287972 - protein, 8 aa, Influenza virus
VKGWAFDS

SEQ ID NO: 287973 - protein, 8 aa, Influenza virus
KGWAFDSG

SEQ ID NO: 287974 - protein, 8 aa, Influenza virus
GNDVWMGR

SEQ ID NO: 287975 - protein, 8 aa, Influenza virus
NDVWMGRT

SEQ ID NO: 287976 - protein, 8 aa, Influenza virus
DLWMGRTI

SEQ ID NO: 287977 - protein, 8 aa, Influenza virus
VWMGRTIN

SEQ ID NO: 287978 - protein, 8 aa, Influenza virus
WMGRTINK

SEQ ID NO: 287979 - protein, 8 aa, Influenza virus
KDSRSGYE

SEQ ID NO: 287980 - protein, 8 aa, Influenza virus
DSRSGYET

SEQ ID NO: 287981 - protein, 8 aa, Influenza virus
SRSGYETF

SEQ ID NO: 287982 - protein, 8 aa, Influenza virus
RSGYETFR

SEQ ID NO: 287983 - protein, 8 aa, Influenza virus
SGYETFRV

SEQ ID NO: 287984 - protein, 8 aa, Influenza virus
GYETFRVI

SEQ ID NO: 287985 - protein, 8 aa, Influenza virus
YETFRVIG

SEQ ID NO: 287986 - protein, 8 aa, Influenza virus
ETFRVIGG

SEQ ID NO: 287987 - protein, 8 aa, Influenza virus
TFRVIGGW

SEQ ID NO: 287988 - protein, 8 aa, Influenza virus
FKVIGGWT

SEQ ID NO: 287989 - protein, 8 aa, Influenza virus
KVIGGWTT

SEQ ID NO: 287990 - protein, 8 aa, Influenza virus
VIGGWTTA

SEQ ID NO: 287991 - protein, 8 aa, Influenza virus
SKSQINRQ

SEQ ID NO: 287992 - protein, 8 aa, Influenza virus
RQVIVDSD

SEQ ID NO: 287993 - protein, 8 aa, Influenza virus
SDNRSGYS

SEQ ID NO: 287994 - protein, 8 aa, Influenza virus
DNRSGYSG

SEQ ID NO: 287995 - protein, 8 aa, Influenza virus
NRSGYSGI

SEQ ID NO: 287996 - protein, 8 aa, Influenza virus
RSGYSGIF

SEQ ID NO: 287997 - protein, 8 aa, Influenza virus
SGIFSVEH

SEQ ID NO: 287998 - protein, 8 aa, Influenza virus
GIFSVENK

SEQ ID NO: 287999 - protein, 8 aa, Influenza virus
KGCINRCF

SEQ ID NO: 288000 - protein, 8 aa, Influenza virus
GCINRCFY

SEQ ID NO: 288001 - protein, 8 aa, Influenza virus
CVNRCFYV

SEQ ID NO: 288002 - protein, 8 aa, Influenza virus
VNRCFYVE

SEQ ID NO: 288003 - protein, 8 aa, Influenza virus
VELIRGRK

SEQ ID NO: 288004 - protein, 8 aa, Influenza virus
ELIRGRKQ

SEQ ID NO: 288005 - protein, 8 aa, Influenza virus
LIRGRKQE

SEQ ID NO: 288006 - protein, 8 aa, Influenza virus
KQETRVWW

SEQ ID NO: 288007 - protein, 8 aa, Influenza virus
QEARVWWT

SEQ ID NO: 288008 - protein, 8 aa, Influenza virus
EARVWWTS

SEQ ID NO: 288009 - protein, 8 aa, Influenza virus
ARVWWTSN

SEQ ID NO: 288010 - protein, 8 aa, Influenza virus
WWTSNSIA

SEQ ID NO: 288011 - protein, 8 aa, Influenza virus
WTSNSIAV

SEQ ID NO: 288012 - protein, 8 aa, Influenza virus
TSNSIAVF

SEQ ID NO: 288013 - protein, 8 aa, Influenza virus
SNSIAVFC

SEQ ID NO: 288014 - protein, 8 aa, Influenza virus
NSIAVFCG

SEQ ID NO: 288015 - protein, 8 aa, Influenza virus
SIAVFCGT

SEQ ID NO: 288016 - protein, 8 aa, Influenza virus
IAVFCGTS

SEQ ID NO: 288017 - protein, 8 aa, Influenza virus
AVFCGTSG

SEQ ID NO: 288018 - protein, 8 aa, Influenza virus
GSWPDGAD

SEQ ID NO: 288019 - protein, 8 aa, Influenza virus
SWPDGADI

SEQ ID NO: 288020 - protein, 8 aa, Influenza virus
WPDGADIN

SEQ ID NO: 288021 - protein, 8 aa, Influenza virus
PDGANINL

SEQ ID NO: 288022 - protein, 8 aa, Influenza virus
DGANINLM

SEQ ID NO: 288023 - protein, 8 aa, Influenza virus
GANINLMP

SEQ ID NO: 288024 - protein, 8 aa, Influenza virus
ANINLMPI

SEQ ID NO: 288025 - protein, 8 aa, Influenza virus
HSMSGFRS

SEQ ID NO: 288026 - protein, 8 aa, Influenza virus
IMRTVIAL

SEQ ID NO: 288027 - protein, 8 aa, Influenza virus
IFIFLLLT

SEQ ID NO: 288028 - protein, 8 aa, Influenza virus
FIFLLLTH

SEQ ID NO: 288029 - protein, 8 aa, Influenza virus
VLSCIFCL

SEQ ID NO: 288030 - protein, 8 aa, Influenza virus
MATLCLGH

SEQ ID NO: 288031 - protein, 8 aa, Influenza virus
CLGHHAVA

SEQ ID NO: 288032 - protein, 8 aa, Influenza virus
LGHHAVAN

SEQ ID NO: 288033 - protein, 8 aa, Influenza virus
GHHAVANG

SEQ ID NO: 288034 - protein, 8 aa, Influenza virus
HHAVANGT

SEQ ID NO: 288035 - protein, 8 aa, Influenza virus
DHIEVTNA

SEQ ID NO: 288036 - protein, 8 aa, Influenza virus
HIEVTNAT

SEQ ID NO: 288037 - protein, 8 aa, Influenza virus
VEVTNATE

SEQ ID NO: 288038 - protein, 8 aa, Influenza virus
NATELVQN

SEQ ID NO: 288039 - protein, 8 aa, Influenza virus
CTLMDALL

SEQ ID NO: 288040 - protein, 8 aa, Influenza virus
TLMDALLG

SEQ ID NO: 288041 - protein, 8 aa, Influenza virus
LMDALLGD

SEQ ID NO: 288042 - protein, 8 aa, Influenza virus
MDALLGDP

SEQ ID NO: 288043 - protein, 8 aa, Influenza virus
DALLGDPQ

SEQ ID NO: 288044 - protein, 8 aa, Influenza virus
ALLGDPQC

SEQ ID NO: 288045 - protein, 8 aa, Influenza virus
LLGDPQCD

SEQ ID NO: 288046 - protein, 8 aa, Influenza virus
WDLYVERS

SEQ ID NO: 288047 - protein, 8 aa, Influenza virus
SNCYPYDI

SEQ ID NO: 288048 - protein, 8 aa, Influenza virus
CYPYDIPD

SEQ ID NO: 288049 - protein, 8 aa, Influenza virus
SLRSLIAS

SEQ ID NO: 288050 - protein, 8 aa, Influenza virus
LRSLIASS

SEQ ID NO: 288051 - protein, 8 aa, Influenza virus
RSLIASSG

SEQ ID NO: 288052 - protein, 8 aa, Influenza virus
SLIASSGT

SEQ ID NO: 288053 - protein, 8 aa, Influenza virus
LIASSGTL

SEQ ID NO: 288054 - protein, 8 aa, Influenza virus
IASSGTLE

SEQ ID NO: 288055 - protein, 8 aa, Influenza virus
ASSGTVEF

SEQ ID NO: 288056 - protein, 8 aa, Influenza virus
GFFSRLNW

SEQ ID NO: 288057 - protein, 8 aa, Influenza virus
FFRRLNWL

SEQ ID NO: 288058 - protein, 8 aa, Influenza virus
FSRLNWLH

SEQ ID NO: 288059 - protein, 8 aa, Influenza virus
FDKLYVWG

SEQ ID NO: 288060 - protein, 8 aa, Influenza virus
DKLYVWGV

SEQ ID NO: 288061 - protein, 8 aa, Influenza virus
KLYVWGVH

SEQ ID NO: 288062 - protein, 8 aa, Influenza virus
LYVWGVHH

SEQ ID NO: 288063 - protein, 8 aa, Influenza virus
YVWGVHHP

SEQ ID NO: 288064 - protein, 8 aa, Influenza virus
SIYWTVVK

SEQ ID NO: 288065 - protein, 8 aa, Influenza virus
YWTVVKPG

SEQ ID NO: 288066 - protein, 8 aa, Influenza virus
WTVVKPGD

SEQ ID NO: 288067 - protein, 8 aa, Influenza virus
SNGNLIAP

SEQ ID NO: 288068 - protein, 8 aa, Influenza virus
NGNLIAPR

SEQ ID NO: 288069 - protein, 8 aa, Influenza virus
GNLVAPRG

SEQ ID NO: 288070 - protein, 8 aa, Influenza virus
NLVAPRGY

SEQ ID NO: 288071 - protein, 8 aa, Influenza virus
LVAPRGYF

SEQ ID NO: 288072 - protein, 8 aa, Influenza virus
VAPRGYFK

SEQ ID NO: 288073 - protein, 8 aa, Influenza virus
APRGYFKM

SEQ ID NO: 288074 - protein, 8 aa, Influenza virus
SACITPNG

SEQ ID NO: 288075 - protein, 8 aa, Influenza virus
ACITPNGS

SEQ ID NO: 288076 - protein, 8 aa, Influenza virus
ITPNGSIS

SEQ ID NO: 288077 - protein, 8 aa, Influenza virus
TPNGSISN

SEQ ID NO: 288078 - protein, 8 aa, Influenza virus
PNGSISND

SEQ ID NO: 288079 - protein, 8 aa, Influenza virus
NGSISNDK

SEQ ID NO: 288080 - protein, 8 aa, Influenza virus
GSISNDKP

SEQ ID NO: 288081 - protein, 8 aa, Influenza virus
SISNDKPF

SEQ ID NO: 288082 - protein, 8 aa, Influenza virus
ISNDKPFQ

SEQ ID NO: 288083 - protein, 8 aa, Influenza virus
SNDKPFQN

SEQ ID NO: 288084 - protein, 8 aa, Influenza virus
NEKPFQNV

SEQ ID NO: 288085 - protein, 8 aa, Influenza virus
EKPFQNVN

SEQ ID NO: 288086 - protein, 8 aa, Influenza virus
KPFQNVNK

SEQ ID NO: 288087 - protein, 8 aa, Influenza virus
PFQNVNKI

SEQ ID NO: 288088 - protein, 8 aa, Influenza virus
FQNVNKIT

SEQ ID NO: 288089 - protein, 8 aa, Influenza virus
QNVNKITY

SEQ ID NO: 288090 - protein, 8 aa, Influenza virus
NVNKITYG

SEQ ID NO: 288091 - protein, 8 aa, Influenza virus
TYGACPKY

SEQ ID NO: 288092 - protein, 8 aa, Influenza virus
QSTLKLAT

SEQ ID NO: 288093 - protein, 8 aa, Influenza virus
LATGMRNI

SEQ ID NO: 288094 - protein, 8 aa, Influenza virus
ATGMRNIP

SEQ ID NO: 288095 - protein, 8 aa, Influenza virus
TGMRNIPE

SEQ ID NO: 288096 - protein, 8 aa, Influenza virus
GMRNVPER

SEQ ID NO: 288097 - protein, 8 aa, Influenza virus
MRNVPERQ

SEQ ID NO: 288098 - protein, 8 aa, Influenza virus
QTRGLFGA

SEQ ID NO: 288099 - protein, 8 aa, Influenza virus
TRGLFGAI

SEQ ID NO: 288100 - protein, 8 aa, Influenza virus
RGLFGAIA

SEQ ID NO: 288101 - protein, 8 aa, Influenza virus
GLFGAIAG

SEQ ID NO: 288102 - protein, 8 aa, Influenza virus
LFGAIAGF

SEQ ID NO: 288103 - protein, 8 aa, Influenza virus
ENGWEGMI

SEQ ID NO: 288104 - protein, 8 aa, Influenza virus
NGWEGMID

SEQ ID NO: 288105 - protein, 8 aa, Influenza virus
GWEGMIDG

SEQ ID NO: 288106 - protein, 8 aa, Influenza virus
WEGMIDGW

SEQ ID NO: 288107 - protein, 8 aa, Influenza virus
EGMIDGWY

SEQ ID NO: 288108 - protein, 8 aa, Influenza virus
GMIDGWYG

SEQ ID NO: 288109 - protein, 8 aa, Influenza virus
MIDGWYGF

SEQ ID NO: 288110 - protein, 8 aa, Influenza virus
IDGWYGFR

SEQ ID NO: 288111 - protein, 8 aa, Influenza virus
DGWYGFRY

SEQ ID NO: 288112 - protein, 8 aa, Influenza virus
GWYGFRYQ

SEQ ID NO: 288113 - protein, 8 aa, Influenza virus
WYGFRYQN

SEQ ID NO: 288114 - protein, 8 aa, Influenza virus
YGFRYQNS

SEQ ID NO: 288115 - protein, 8 aa, Influenza virus
GFRYQNSE

SEQ ID NO: 288116 - protein, 8 aa, Influenza virus
FRYQNSEG

SEQ ID NO: 288117 - protein, 8 aa, Influenza virus
QNSEGIGQ

SEQ ID NO: 288118 - protein, 8 aa, Influenza virus
NSEGIGQA

SEQ ID NO: 288119 - protein, 8 aa, Influenza virus
SEGIGQAA

SEQ ID NO: 288120 - protein, 8 aa, Influenza virus
EGIGQAAD

SEQ ID NO: 288121 - protein, 8 aa, Influenza virus
GIGQAADL

SEQ ID NO: 288122 - protein, 8 aa, Influenza virus
IGQAADLK

SEQ ID NO: 288123 - protein, 8 aa, Influenza virus
ADLKSTQT

SEQ ID NO: 288124 - protein, 8 aa, Influenza virus
DLKSTQTA

SEQ ID NO: 288125 - protein, 8 aa, Influenza virus
LKSTQTAI

SEQ ID NO: 288126 - protein, 8 aa, Influenza virus
KSTQAAIN

SEQ ID NO: 288127 - protein, 8 aa, Influenza virus
STQAAINQ

SEQ ID NO: 288128 - protein, 8 aa, Influenza virus
TQAAINQI

SEQ ID NO: 288129 - protein, 8 aa, Influenza virus
QITGKLNR

SEQ ID NO: 288130 - protein, 8 aa, Influenza virus
IEKTNEKF

SEQ ID NO: 288131 - protein, 8 aa, Influenza virus
EKTNEKFH

SEQ ID NO: 288132 - protein, 8 aa, Influenza virus
RTNEKFHQ

SEQ ID NO: 288133 - protein, 8 aa, Influenza virus
IEKEFSEI

SEQ ID NO: 288134 - protein, 8 aa, Influenza virus
EKEFSEIE

SEQ ID NO: 288135 - protein, 8 aa, Influenza virus
KEFSEIEG

SEQ ID NO: 288136 - protein, 8 aa, Influenza virus
EFSEIEGR

SEQ ID NO: 288137 - protein, 8 aa, Influenza virus
FSEIEGRI

SEQ ID NO: 288138 - protein, 8 aa, Influenza virus
SEIEGRIQ

SEQ ID NO: 288139 - protein, 8 aa, Influenza virus
EIEGRIQD

SEQ ID NO: 288140 - protein, 8 aa, Influenza virus
IEGRIQDL

SEQ ID NO: 288141 - protein, 8 aa, Influenza virus
GRIQDLER

SEQ ID NO: 288142 - protein, 8 aa, Influenza virus
RIQDLERY

SEQ ID NO: 288143 - protein, 8 aa, Influenza virus
IQDLERYV

SEQ ID NO: 288144 - protein, 8 aa, Influenza virus
QDLERYVE

SEQ ID NO: 288145 - protein, 8 aa, Influenza virus
DLERYVED

SEQ ID NO: 288146 - protein, 8 aa, Influenza virus
LERYVEDT

SEQ ID NO: 288147 - protein, 8 aa, Influenza virus
ERYVEDTK

SEQ ID NO: 288148 - protein, 8 aa, Influenza virus
KYVEDTKV

SEQ ID NO: 288149 - protein, 8 aa, Influenza virus
YVEDTKVD

SEQ ID NO: 288150 - protein, 8 aa, Influenza virus
VEDTKVDL

SEQ ID NO: 288151 - protein, 8 aa, Influenza virus
EDTKVDLW

SEQ ID NO: 288152 - protein, 8 aa, Influenza virus
DTKVDLWS

SEQ ID NO: 288153 - protein, 8 aa, Influenza virus
TKVDLWSY

SEQ ID NO: 288154 - protein, 8 aa, Influenza virus
KVDLWSYN

SEQ ID NO: 288155 - protein, 8 aa, Influenza virus
VDLWSYNA

SEQ ID NO: 288156 - protein, 8 aa, Influenza virus
DLWSYNAG

SEQ ID NO: 288157 - protein, 8 aa, Influenza virus
LWSYNAGL

SEQ ID NO: 288158 - protein, 8 aa, Influenza virus
WSYNAGLL

SEQ ID NO: 288159 - protein, 8 aa, Influenza virus
SYNAGLLV

SEQ ID NO: 288160 - protein, 8 aa, Influenza virus
YNAGLLVA

SEQ ID NO: 288161 - protein, 8 aa, Influenza virus
NAGLLVAL

SEQ ID NO: 288162 - protein, 8 aa, Influenza virus
AGLLVALE

SEQ ID NO: 288163 - protein, 8 aa, Influenza virus
GLLVALEN

SEQ ID NO: 288164 - protein, 8 aa, Influenza virus
VLVALENQ

SEQ ID NO: 288165 - protein, 8 aa, Influenza virus
ALENQNTI

SEQ ID NO: 288166 - protein, 8 aa, Influenza virus
LENQHTIH

SEQ ID NO: 288167 - protein, 8 aa, Influenza virus
ENQHTIHL

SEQ ID NO: 288168 - protein, 8 aa, Influenza virus
NQHTIHLT

SEQ ID NO: 288169 - protein, 8 aa, Influenza virus
QHTIHLTD

SEQ ID NO: 288170 - protein, 8 aa, Influenza virus
HTIDLTDA

SEQ ID NO: 288171 - protein, 8 aa, Influenza virus
TIDLTDAE

SEQ ID NO: 288172 - protein, 8 aa, Influenza virus
IDLTDAEM

SEQ ID NO: 288173 - protein, 8 aa, Influenza virus
DLTDAEMN

SEQ ID NO: 288174 - protein, 8 aa, Influenza virus
LTDAEMNK

SEQ ID NO: 288175 - protein, 8 aa, Influenza virus
TDAEMNKL

SEQ ID NO: 288176 - protein, 8 aa, Influenza virus
DAEMNKLF

SEQ ID NO: 288177 - protein, 8 aa, Influenza virus
AEMNKLFE

SEQ ID NO: 288178 - protein, 8 aa, Influenza virus
EMNKLFER

SEQ ID NO: 288179 - protein, 8 aa, Influenza virus
MNKLFERT

SEQ ID NO: 288180 - protein, 8 aa, Influenza virus
TRRQLREN

SEQ ID NO: 288181 - protein, 8 aa, Influenza virus
RRQLRENA

SEQ ID NO: 288182 - protein, 8 aa, Influenza virus
RQLRENAE

SEQ ID NO: 288183 - protein, 8 aa, Influenza virus
LRENAEDI

SEQ ID NO: 288184 - protein, 8 aa, Influenza virus
RENAEDIG

SEQ ID NO: 288185 - protein, 8 aa, Influenza virus
ENAEDMGG

SEQ ID NO: 288186 - protein, 8 aa, Influenza virus
NAEDMGGG

SEQ ID NO: 288187 - protein, 8 aa, Influenza virus
AEDMGGGC

SEQ ID NO: 288188 - protein, 8 aa, Influenza virus
EDMGGGCF

SEQ ID NO: 288189 - protein, 8 aa, Influenza virus
GGGCFKIY

SEQ ID NO: 288190 - protein, 8 aa, Influenza virus
GGCFKIYH

SEQ ID NO: 288191 - protein, 8 aa, Influenza virus
GCFTIYHK

SEQ ID NO: 288192 - protein, 8 aa, Influenza virus
CFTIYHKC

SEQ ID NO: 288193 - protein, 8 aa, Influenza virus
FTIYHKCD

SEQ ID NO: 288194 - protein, 8 aa, Influenza virus
TIYHKCDN

SEQ ID NO: 288195 - protein, 8 aa, Influenza virus
IYHKCDNS

SEQ ID NO: 288196 - protein, 8 aa, Influenza virus
YHKCDNSC

SEQ ID NO: 288197 - protein, 8 aa, Influenza virus
ESIRNGTY

SEQ ID NO: 288198 - protein, 8 aa, Influenza virus
SIRNGTYN

SEQ ID NO: 288199 - protein, 8 aa, Influenza virus
IRNGTYNH

SEQ ID NO: 288200 - protein, 8 aa, Influenza virus
YRDEAVNN

SEQ ID NO: 288201 - protein, 8 aa, Influenza virus
RDEAVNNR

SEQ ID NO: 288202 - protein, 8 aa, Influenza virus
DEAVNNRF

SEQ ID NO: 288203 - protein, 8 aa, Influenza virus
EAVNNRFQ

SEQ ID NO: 288204 - protein, 8 aa, Influenza virus
GYKDWVLW

SEQ ID NO: 288205 - protein, 8 aa, Influenza virus
YKDWVLWI

SEQ ID NO: 288206 - protein, 8 aa, Influenza virus
KDWVLWIS

SEQ ID NO: 288207 - protein, 8 aa, Influenza virus
DWVLWISF

SEQ ID NO: 288208 - protein, 8 aa, Influenza virus
WVLWISFA

SEQ ID NO: 288209 - protein, 8 aa, Influenza virus
VLWISFAI

SEQ ID NO: 288210 - protein, 8 aa, Influenza virus
LWISFATS

SEQ ID NO: 288211 - protein, 8 aa, Influenza virus
WISFATSC

SEQ ID NO: 288212 - protein, 8 aa, Influenza virus
ISFATSCF

SEQ ID NO: 288213 - protein, 8 aa, Influenza virus
SFATSCFL

SEQ ID NO: 288214 - protein, 8 aa, Influenza virus
FAISCFLI

SEQ ID NO: 288215 - protein, 8 aa, Influenza virus
AISCFLIC

SEQ ID NO: 288216 - protein, 8 aa, Influenza virus
LGFIVWAC

SEQ ID NO: 288217 - protein, 8 aa, Influenza virus
GFIVWACQ

SEQ ID NO: 288218 - protein, 8 aa, Influenza virus
FIMWACQR

SEQ ID NO: 288219 - protein, 8 aa, Influenza virus
IMWACQRG

SEQ ID NO: 288220 - protein, 8 aa, Influenza virus
MWACQRGN

SEQ ID NO: 288221 - protein, 8 aa, Influenza virus
WACQRGNI

SEQ ID NO: 288222 - protein, 8 aa, Influenza virus
ACQRGNIR

SEQ ID NO: 288223 - protein, 8 aa, Influenza virus
CQRGNIRC

SEQ ID NO: 288224 - protein, 8 aa, Influenza virus
QRGNIRCN

SEQ ID NO: 288225 - protein, 8 aa, Influenza virus
RGNIRCNI

SEQ ID NO: 288226 - protein, 8 aa, Influenza virus
GNIKCNIC

SEQ ID NO: 288227 - protein, 8 aa, Influenza virus
NIKCNICI

SEQ ID NO: 288228 - protein, 8 aa, Influenza virus
SMSGFRSN

SEQ ID NO: 288229 - protein, 8 aa, Influenza virus
MATLCLGH

SEQ ID NO: 288230 - protein, 8 aa, Influenza virus
HAVPNGTL

SEQ ID NO: 288231 - protein, 8 aa, Influenza virus
AVPNGTLV

SEQ ID NO: 288232 - protein, 8 aa, Influenza virus
VPNGTLVK

SEQ ID NO: 288233 - protein, 8 aa, Influenza virus
PNGTLVKT

SEQ ID NO: 288234 - protein, 8 aa, Influenza virus
NGTLVKTI

SEQ ID NO: 288235 - protein, 8 aa, Influenza virus
GTLVKTIT

SEQ ID NO: 288236 - protein, 8 aa, Influenza virus
DHIEVTNA

SEQ ID NO: 288237 - protein, 8 aa, Influenza virus
HIEVTNAT

SEQ ID NO: 288238 - protein, 8 aa, Influenza virus
VEVTNATE

SEQ ID NO: 288239 - protein, 8 aa, Influenza virus
NATELVQN

SEQ ID NO: 288240 - protein, 8 aa, Influenza virus
CTLMDALL

SEQ ID NO: 288241 - protein, 8 aa, Influenza virus
TLMDALLG

SEQ ID NO: 288242 - protein, 8 aa, Influenza virus
LMDALLGD

SEQ ID NO: 288243 - protein, 8 aa, Influenza virus
MDALLGDP

SEQ ID NO: 288244 - protein, 8 aa, Influenza virus
DALLGDPH

SEQ ID NO: 288245 - protein, 8 aa, Influenza virus
ALLGDPHC

SEQ ID NO: 288246 - protein, 8 aa, Influenza virus
LLGDPHCD

SEQ ID NO: 288247 - protein, 8 aa, Influenza virus
WDLFIERS

SEQ ID NO: 288248 - protein, 8 aa, Influenza virus
SNCYPYYV

SEQ ID NO: 288249 - protein, 8 aa, Influenza virus
CYPYYVPD

SEQ ID NO: 288250 - protein, 8 aa, Influenza virus
YPYYVPDY

SEQ ID NO: 288251 - protein, 8 aa, Influenza virus
SLRSLIAS

SEQ ID NO: 288252 - protein, 8 aa, Influenza virus
LRSLIASS

SEQ ID NO: 288253 - protein, 8 aa, Influenza virus
RSLIASSG

SEQ ID NO: 288254 - protein, 8 aa, Influenza virus
SLIASSGT

SEQ ID NO: 288255 - protein, 8 aa, Influenza virus
LIASSGTL

SEQ ID NO: 288256 - protein, 8 aa, Influenza virus
IASSGTLE

SEQ ID NO: 288257 - protein, 8 aa, Influenza virus
SSGTLEFI

SEQ ID NO: 288258 - protein, 8 aa, Influenza virus
GFFSRLNW

SEQ ID NO: 288259 - protein, 8 aa, Influenza virus
FFRRLNWL

SEQ ID NO: 288260 - protein, 8 aa, Influenza virus
FSRLNWLH

SEQ ID NO: 288261 - protein, 8 aa, Influenza virus
FDKLYVWG

SEQ ID NO: 288262 - protein, 8 aa, Influenza virus
DKLYVWGV

SEQ ID NO: 288263 - protein, 8 aa, Influenza virus
KLYVWGVH

SEQ ID NO: 288264 - protein, 8 aa, Influenza virus
LYVWGVHH

SEQ ID NO: 288265 - protein, 8 aa, Influenza virus
YVWGVHHP

SEQ ID NO: 288266 - protein, 8 aa, Influenza virus
WGVHHPST

SEQ ID NO: 288267 - protein, 8 aa, Influenza virus
VSIYWTIV

SEQ ID NO: 288268 - protein, 8 aa, Influenza virus
SVYWTVVK

SEQ ID NO: 288269 - protein, 8 aa, Influenza virus
VYWTVVKP

SEQ ID NO: 288270 - protein, 8 aa, Influenza virus
YWTVVKPG

SEQ ID NO: 288271 - protein, 8 aa, Influenza virus
WTVVKPGD

SEQ ID NO: 288272 - protein, 8 aa, Influenza virus
SNGNLIAP

SEQ ID NO: 288273 - protein, 8 aa, Influenza virus
NGNLIAPR

SEQ ID NO: 288274 - protein, 8 aa, Influenza virus
LIAPRGYY

SEQ ID NO: 288275 - protein, 8 aa, Influenza virus
IAPRGYFR

SEQ ID NO: 288276 - protein, 8 aa, Influenza virus
APRGYFKM

SEQ ID NO: 288277 - protein, 8 aa, Influenza virus
GKSSIMKS

SEQ ID NO: 288278 - protein, 8 aa, Influenza virus
KSSIMRSN

SEQ ID NO: 288279 - protein, 8 aa, Influenza virus
SSIMRSNA

SEQ ID NO: 288280 - protein, 8 aa, Influenza virus
SACITPNG

SEQ ID NO: 288281 - protein, 8 aa, Influenza virus
ACITPNGS

SEQ ID NO: 288282 - protein, 8 aa, Influenza virus
ITPNGSIS

SEQ ID NO: 288283 - protein, 8 aa, Influenza virus
TPNGSISN

SEQ ID NO: 288284 - protein, 8 aa, Influenza virus
PNGSIPNE

SEQ ID NO: 288285 - protein, 8 aa, Influenza virus
NGSIPNEK

SEQ ID NO: 288286 - protein, 8 aa, Influenza virus
GSIPNEKP

SEQ ID NO: 288287 - protein, 8 aa, Influenza virus
SIPNEKPF

SEQ ID NO: 288288 - protein, 8 aa, Influenza virus
IPNEKPFQ

SEQ ID NO: 288289 - protein, 8 aa, Influenza virus
PNEKPFQN

SEQ ID NO: 288290 - protein, 8 aa, Influenza virus
NEKPFQNV

SEQ ID NO: 288291 - protein, 8 aa, Influenza virus
EKPFQNVN

SEQ ID NO: 288292 - protein, 8 aa, Influenza virus
KPFQNVNK

SEQ ID NO: 288293 - protein, 8 aa, Influenza virus
PFQNVNKI

SEQ ID NO: 288294 - protein, 8 aa, Influenza virus
FQNVNKIT

SEQ ID NO: 288295 - protein, 8 aa, Influenza virus
QNVNKITY

SEQ ID NO: 288296 - protein, 8 aa, Influenza virus
NVNKITYG

SEQ ID NO: 288297 - protein, 8 aa, Influenza virus
VNKITYGA

SEQ ID NO: 288298 - protein, 8 aa, Influenza virus
NKITYGAC

SEQ ID NO: 288299 - protein, 8 aa, Influenza virus
KITYGACP

SEQ ID NO: 288300 - protein, 8 aa, Influenza virus
ITYGACPK

SEQ ID NO: 288301 - protein, 8 aa, Influenza virus
TYGACPKY

SEQ ID NO: 288302 - protein, 8 aa, Influenza virus
YGACPKYV

SEQ ID NO: 288303 - protein, 8 aa, Influenza virus
YVKQSTLK

SEQ ID NO: 288304 - protein, 8 aa, Influenza virus
VKQSTLKL

SEQ ID NO: 288305 - protein, 8 aa, Influenza virus
KQSTLKLA

SEQ ID NO: 288306 - protein, 8 aa, Influenza virus
QSTLKLAT

SEQ ID NO: 288307 - protein, 8 aa, Influenza virus
STLKLATG

SEQ ID NO: 288308 - protein, 8 aa, Influenza virus
LATGMRNI

SEQ ID NO: 288309 - protein, 8 aa, Influenza virus
ATGMRNIP

SEQ ID NO: 288310 - protein, 8 aa, Influenza virus
TGMRNIPE

SEQ ID NO: 288311 - protein, 8 aa, Influenza virus
GMRNIPEK

SEQ ID NO: 288312 - protein, 8 aa, Influenza virus
MRNVPETQ

SEQ ID NO: 288313 - protein, 8 aa, Influenza virus
RNVPETQT

SEQ ID NO: 288314 - protein, 8 aa, Influenza virus
NVPETQTR

SEQ ID NO: 288315 - protein, 8 aa, Influenza virus
VPETQTRG

SEQ ID NO: 288316 - protein, 8 aa, Influenza virus
PEKQTRGL

SEQ ID NO: 288317 - protein, 8 aa, Influenza virus
EKQTRGLF

SEQ ID NO: 288318 - protein, 8 aa, Influenza virus
KQTRGLFG

SEQ ID NO: 288319 - protein, 8 aa, Influenza virus
QTRGLFGA

SEQ ID NO: 288320 - protein, 8 aa, Influenza virus
TRGLFGAI

SEQ ID NO: 288321 - protein, 8 aa, Influenza virus
RGLFGAIA

SEQ ID NO: 288322 - protein, 8 aa, Influenza virus
GLFGAIAG

SEQ ID NO: 288323 - protein, 8 aa, Influenza virus
LFGAIAGF

SEQ ID NO: 288324 - protein, 8 aa, Influenza virus
ENGWEGMM

SEQ ID NO: 288325 - protein, 8 aa, Influenza virus
NGWEGMMD

SEQ ID NO: 288326 - protein, 8 aa, Influenza virus
GWEGMMDG

SEQ ID NO: 288327 - protein, 8 aa, Influenza virus
WEGMMDGW

SEQ ID NO: 288328 - protein, 8 aa, Influenza virus
EGMMDGWY

SEQ ID NO: 288329 - protein, 8 aa, Influenza virus
GMMDGWYG

SEQ ID NO: 288330 - protein, 8 aa, Influenza virus
MMDGWYGF

SEQ ID NO: 288331 - protein, 8 aa, Influenza virus
MDGWYGFR

SEQ ID NO: 288332 - protein, 8 aa, Influenza virus
NGWYGFRH

SEQ ID NO: 288333 - protein, 8 aa, Influenza virus
GWYGFRHH

SEQ ID NO: 288334 - protein, 8 aa, Influenza virus
WYGFRHHN

SEQ ID NO: 288335 - protein, 8 aa, Influenza virus
YGFRHHNS

SEQ ID NO: 288336 - protein, 8 aa, Influenza virus
GFRHHNSE

SEQ ID NO: 288337 - protein, 8 aa, Influenza virus
FRHHNSEG

SEQ ID NO: 288338 - protein, 8 aa, Influenza virus
RHQNSEGI

SEQ ID NO: 288339 - protein, 8 aa, Influenza virus
HQNSEGIG

SEQ ID NO: 288340 - protein, 8 aa, Influenza virus
QNSEGIGQ

SEQ ID NO: 288341 - protein, 8 aa, Influenza virus
NSEGIGQA

SEQ ID NO: 288342 - protein, 8 aa, Influenza virus
SEGIGQAA

SEQ ID NO: 288343 - protein, 8 aa, Influenza virus
EGIGQAAD

SEQ ID NO: 288344 - protein, 8 aa, Influenza virus
GIGQAADL

SEQ ID NO: 288345 - protein, 8 aa, Influenza virus
IGQAADLK

SEQ ID NO: 288346 - protein, 8 aa, Influenza virus
FKSTQAAI

SEQ ID NO: 288347 - protein, 8 aa, Influenza virus
KSTQAAID

SEQ ID NO: 288348 - protein, 8 aa, Influenza virus
STQAAIDQ

SEQ ID NO: 288349 - protein, 8 aa, Influenza virus
TQAAIDQI

SEQ ID NO: 288350 - protein, 8 aa, Influenza virus
DQINGKLN

SEQ ID NO: 288351 - protein, 8 aa, Influenza virus
QITGKLNR

SEQ ID NO: 288352 - protein, 8 aa, Influenza virus
IEKTNEKF

SEQ ID NO: 288353 - protein, 8 aa, Influenza virus
EKTNEKFH

SEQ ID NO: 288354 - protein, 8 aa, Influenza virus
FTEVEGRI

SEQ ID NO: 288355 - protein, 8 aa, Influenza virus
GRIQDLER

SEQ ID NO: 288356 - protein, 8 aa, Influenza virus
RIQDLERY

SEQ ID NO: 288357 - protein, 8 aa, Influenza virus
IQDLERYV

SEQ ID NO: 288358 - protein, 8 aa, Influenza virus
QDLERYVE

SEQ ID NO: 288359 - protein, 8 aa, Influenza virus
DLERYVED

SEQ ID NO: 288360 - protein, 8 aa, Influenza virus
LERYVEDT

SEQ ID NO: 288361 - protein, 8 aa, Influenza virus
ERYVEDTK

SEQ ID NO: 288362 - protein, 8 aa, Influenza virus
KYVEDTKV

SEQ ID NO: 288363 - protein, 8 aa, Influenza virus
YVEDTKVD

SEQ ID NO: 288364 - protein, 8 aa, Influenza virus
VEDTKVDL

SEQ ID NO: 288365 - protein, 8 aa, Influenza virus
EDTKVDLW

SEQ ID NO: 288366 - protein, 8 aa, Influenza virus
DTKVDLWS

SEQ ID NO: 288367 - protein, 8 aa, Influenza virus
TKVDLWSY

SEQ ID NO: 288368 - protein, 8 aa, Influenza virus
KVDLWSYN

SEQ ID NO: 288369 - protein, 8 aa, Influenza virus
VDLWSYNA

SEQ ID NO: 288370 - protein, 8 aa, Influenza virus
DLWSYNAG

SEQ ID NO: 288371 - protein, 8 aa, Influenza virus
LWSYNAGL

SEQ ID NO: 288372 - protein, 8 aa, Influenza virus
WSYNAGLL

SEQ ID NO: 288373 - protein, 8 aa, Influenza virus
SYNAGLLV

SEQ ID NO: 288374 - protein, 8 aa, Influenza virus
YNAGLLVA

SEQ ID NO: 288375 - protein, 8 aa, Influenza virus
NAGLLVAL

SEQ ID NO: 288376 - protein, 8 aa, Influenza virus
AGLLVALE

SEQ ID NO: 288377 - protein, 8 aa, Influenza virus
GLLVALEN

SEQ ID NO: 288378 - protein, 8 aa, Influenza virus
FLVALENQ

SEQ ID NO: 288379 - protein, 8 aa, Influenza virus
LENQHTIH

SEQ ID NO: 288380 - protein, 8 aa, Influenza virus
ENQHTIHL

SEQ ID NO: 288381 - protein, 8 aa, Influenza virus
NQHTIHLT

SEQ ID NO: 288382 - protein, 8 aa, Influenza virus
QHTIHLTD

SEQ ID NO: 288383 - protein, 8 aa, Influenza virus
HTIHLTDS

SEQ ID NO: 288384 - protein, 8 aa, Influenza virus
TIHLTDSE

SEQ ID NO: 288385 - protein, 8 aa, Influenza virus
IHLTDSEM

SEQ ID NO: 288386 - protein, 8 aa, Influenza virus
DLTDSEMS

SEQ ID NO: 288387 - protein, 8 aa, Influenza virus
LTDSEMSK

SEQ ID NO: 288388 - protein, 8 aa, Influenza virus
TDSEMSKL

SEQ ID NO: 288389 - protein, 8 aa, Influenza virus
DSEMSKLF

SEQ ID NO: 288390 - protein, 8 aa, Influenza virus
SEMSKLFE

SEQ ID NO: 288391 - protein, 8 aa, Influenza virus
EMNKLFEK

SEQ ID NO: 288392 - protein, 8 aa, Influenza virus
MNKLFEKT

SEQ ID NO: 288393 - protein, 8 aa, Influenza virus
TRKQLREN

SEQ ID NO: 288394 - protein, 8 aa, Influenza virus
RKQLRENA

SEQ ID NO: 288395 - protein, 8 aa, Influenza virus
RQLRENAE

SEQ ID NO: 288396 - protein, 8 aa, Influenza virus
LRENAEEM

SEQ ID NO: 288397 - protein, 8 aa, Influenza virus
RENAEDLG

SEQ ID NO: 288398 - protein, 8 aa, Influenza virus
ENAEEMGN

SEQ ID NO: 288399 - protein, 8 aa, Influenza virus
NAEEMGNG

SEQ ID NO: 288400 - protein, 8 aa, Influenza virus
AEDLGNGC

SEQ ID NO: 288401 - protein, 8 aa, Influenza virus
EDMGNGCL

SEQ ID NO: 288402 - protein, 8 aa, Influenza virus
DMGNGCFT

SEQ ID NO: 288403 - protein, 8 aa, Influenza virus
MGNGCFTI

SEQ ID NO: 288404 - protein, 8 aa, Influenza virus
GNGCFTIY

SEQ ID NO: 288405 - protein, 8 aa, Influenza virus
NGCFTIYH

SEQ ID NO: 288406 - protein, 8 aa, Influenza virus
GCFTIYHK

SEQ ID NO: 288407 - protein, 8 aa, Influenza virus
CFTIYHKC

SEQ ID NO: 288408 - protein, 8 aa, Influenza virus
FTIYHKCD

SEQ ID NO: 288409 - protein, 8 aa, Influenza virus
TIYHKCDN

SEQ ID NO: 288410 - protein, 8 aa, Influenza virus
IYHKCDNS

SEQ ID NO: 288411 - protein, 8 aa, Influenza virus
YHKCDNSC

SEQ ID NO: 288412 - protein, 8 aa, Influenza virus
HKCDNTCI

SEQ ID NO: 288413 - protein, 8 aa, Influenza virus
CIESIRNG

SEQ ID NO: 288414 - protein, 8 aa, Influenza virus
IESIRNGT

SEQ ID NO: 288415 - protein, 8 aa, Influenza virus
ESIRNGTY

SEQ ID NO: 288416 - protein, 8 aa, Influenza virus
SIRNGTYN

SEQ ID NO: 288417 - protein, 8 aa, Influenza virus
IRNGTYNH

SEQ ID NO: 288418 - protein, 8 aa, Influenza virus
RNGTYDHN

SEQ ID NO: 288419 - protein, 8 aa, Influenza virus
YRDEAVNN

SEQ ID NO: 288420 - protein, 8 aa, Influenza virus
RDEAVNNR

SEQ ID NO: 288421 - protein, 8 aa, Influenza virus
DEAVNNRF

SEQ ID NO: 288422 - protein, 8 aa, Influenza virus
EAVNNRFQ

SEQ ID NO: 288423 - protein, 8 aa, Influenza virus
AVNNRFQI

SEQ ID NO: 288424 - protein, 8 aa, Influenza virus
VNNRFQIK

SEQ ID NO: 288425 - protein, 8 aa, Influenza virus
NNRFQIKS

SEQ ID NO: 288426 - protein, 8 aa, Influenza virus
NRFQIKSV

SEQ ID NO: 288427 - protein, 8 aa, Influenza virus
LKSEYKDW

SEQ ID NO: 288428 - protein, 8 aa, Influenza virus
GYKDWVLW

SEQ ID NO: 288429 - protein, 8 aa, Influenza virus
YKDWVLWI

SEQ ID NO: 288430 - protein, 8 aa, Influenza virus
KDWVLWIS

SEQ ID NO: 288431 - protein, 8 aa, Influenza virus
DWVLWISF

SEQ ID NO: 288432 - protein, 8 aa, Influenza virus
WVLWISFA

SEQ ID NO: 288433 - protein, 8 aa, Influenza virus
VLWISFAI

SEQ ID NO: 288434 - protein, 8 aa, Influenza virus
LWISFATS

SEQ ID NO: 288435 - protein, 8 aa, Influenza virus
WISFATSC

SEQ ID NO: 288436 - protein, 8 aa, Influenza virus
ISFATSCF

SEQ ID NO: 288437 - protein, 8 aa, Influenza virus
SFATSCFL

SEQ ID NO: 288438 - protein, 8 aa, Influenza virus
FATSCFLL

SEQ ID NO: 288439 - protein, 8 aa, Influenza virus
ATSCFLLC

SEQ ID NO: 288440 - protein, 8 aa, Influenza virus
LGFIVWAC

SEQ ID NO: 288441 - protein, 8 aa, Influenza virus
GFIVWACQ

SEQ ID NO: 288442 - protein, 8 aa, Influenza virus
FIMWACQR

SEQ ID NO: 288443 - protein, 8 aa, Influenza virus
IMWACQRG

SEQ ID NO: 288444 - protein, 8 aa, Influenza virus
MWACQRGN

SEQ ID NO: 288445 - protein, 8 aa, Influenza virus
WACQRGNI

SEQ ID NO: 288446 - protein, 8 aa, Influenza virus
ACQRGNIR

SEQ ID NO: 288447 - protein, 8 aa, Influenza virus
CQRGNIRC

SEQ ID NO: 288448 - protein, 8 aa, Influenza virus
QRGNIRCN

SEQ ID NO: 288449 - protein, 8 aa, Influenza virus
RGNIRCNI

SEQ ID NO: 288450 - protein, 8 aa, Influenza virus
GNIKCNIC

SEQ ID NO: 288451 - protein, 8 aa, Influenza virus
NIKCNICI

SEQ ID NO: 288452 - protein, 8 aa, Influenza virus
MNPNKKII

SEQ ID NO: 288453 - protein, 8 aa, Influenza virus
NPNQKIIA

SEQ ID NO: 288454 - protein, 8 aa, Influenza virus
PNQKIIAI

SEQ ID NO: 288455 - protein, 8 aa, Influenza virus
QKIIAIGS

SEQ ID NO: 288456 - protein, 8 aa, Influenza virus
KIIAIGSV

SEQ ID NO: 288457 - protein, 8 aa, Influenza virus
ITVTLHFK

SEQ ID NO: 288458 - protein, 8 aa, Influenza virus
TITLHFKQ

SEQ ID NO: 288459 - protein, 8 aa, Influenza virus
YRKWSKPQ

SEQ ID NO: 288460 - protein, 8 aa, Influenza virus
RKWSKPQC

SEQ ID NO: 288461 - protein, 8 aa, Influenza virus
KDNSIRLA

SEQ ID NO: 288462 - protein, 8 aa, Influenza virus
DNSIRLAA

SEQ ID NO: 288463 - protein, 8 aa, Influenza virus
NSIRLAAG

SEQ ID NO: 288464 - protein, 8 aa, Influenza virus
SIRLAAGG

SEQ ID NO: 288465 - protein, 8 aa, Influenza virus
IRLSAGGA

SEQ ID NO: 288466 - protein, 8 aa, Influenza virus
RLSAGGAI

SEQ ID NO: 288467 - protein, 8 aa, Influenza virus
LSAGGAIW

SEQ ID NO: 288468 - protein, 8 aa, Influenza virus
SAGGAIWV

SEQ ID NO: 288469 - protein, 8 aa, Influenza virus
AGGAIWVT

SEQ ID NO: 288470 - protein, 8 aa, Influenza virus
GGAIWVTR

SEQ ID NO: 288471 - protein, 8 aa, Influenza virus
GAIWVTRE

SEQ ID NO: 288472 - protein, 8 aa, Influenza virus
DIWVTREL

SEQ ID NO: 288473 - protein, 8 aa, Influenza virus
IWVTRELY

SEQ ID NO: 288474 - protein, 8 aa, Influenza virus
WVTRELYV

SEQ ID NO: 288475 - protein, 8 aa, Influenza virus
VTRELYVS

SEQ ID NO: 288476 - protein, 8 aa, Influenza virus
TRELYVSC

SEQ ID NO: 288477 - protein, 8 aa, Influenza virus
REPYVSCS

SEQ ID NO: 288478 - protein, 8 aa, Influenza virus
GKCYQFAL

SEQ ID NO: 288479 - protein, 8 aa, Influenza virus
LGQGTTLD

SEQ ID NO: 288480 - protein, 8 aa, Influenza virus
GQGTTLDN

SEQ ID NO: 288481 - protein, 8 aa, Influenza virus
RIPHRTLL

SEQ ID NO: 288482 - protein, 8 aa, Influenza virus
IPHRTLLM

SEQ ID NO: 288483 - protein, 8 aa, Influenza virus
PHRTLLMN

SEQ ID NO: 288484 - protein, 8 aa, Influenza virus
HRTLLMNE

SEQ ID NO: 288485 - protein, 8 aa, Influenza virus
SELGVPFH

SEQ ID NO: 288486 - protein, 8 aa, Influenza virus
VPFHLGTR

SEQ ID NO: 288487 - protein, 8 aa, Influenza virus
PFHLGTRQ

SEQ ID NO: 288488 - protein, 8 aa, Influenza virus
FHLGTRQV

SEQ ID NO: 288489 - protein, 8 aa, Influenza virus
HLGTRQVC

SEQ ID NO: 288490 - protein, 8 aa, Influenza virus
LGTRQVCI

SEQ ID NO: 288491 - protein, 8 aa, Influenza virus
GTRQVCIA

SEQ ID NO: 288492 - protein, 8 aa, Influenza virus
TRQVCIAW

SEQ ID NO: 288493 - protein, 8 aa, Influenza virus
RQVCIAWS

SEQ ID NO: 288494 - protein, 8 aa, Influenza virus
QVCMAWSS

SEQ ID NO: 288495 - protein, 8 aa, Influenza virus
VCMAWSSS

SEQ ID NO: 288496 - protein, 8 aa, Influenza virus
CMAWSSSS

SEQ ID NO: 288497 - protein, 8 aa, Influenza virus
MAWSSSSC

SEQ ID NO: 288498 - protein, 8 aa, Influenza virus
KAWLHVCI

SEQ ID NO: 288499 - protein, 8 aa, Influenza virus
AWLHVCIT

SEQ ID NO: 288500 - protein, 8 aa, Influenza virus
WLHVCITG

SEQ ID NO: 288501 - protein, 8 aa, Influenza virus
DENATASF

SEQ ID NO: 288502 - protein, 8 aa, Influenza virus
ENATASFI

SEQ ID NO: 288503 - protein, 8 aa, Influenza virus
NATASFVY

SEQ ID NO: 288504 - protein, 8 aa, Influenza virus
ATASFIYD

SEQ ID NO: 288505 - protein, 8 aa, Influenza virus
TASFIYDG

SEQ ID NO: 288506 - protein, 8 aa, Influenza virus
LVDSIVSW

SEQ ID NO: 288507 - protein, 8 aa, Influenza virus
VDSIVSWS

SEQ ID NO: 288508 - protein, 8 aa, Influenza virus
KILRTQES

SEQ ID NO: 288509 - protein, 8 aa, Influenza virus
ESECICIN

SEQ ID NO: 288510 - protein, 8 aa, Influenza virus
SECICING

SEQ ID NO: 288511 - protein, 8 aa, Influenza virus
ECICINGT

SEQ ID NO: 288512 - protein, 8 aa, Influenza virus
CICINGTC

SEQ ID NO: 288513 - protein, 8 aa, Influenza virus
VCINGTCA

SEQ ID NO: 288514 - protein, 8 aa, Influenza virus
CINGTCAV

SEQ ID NO: 288515 - protein, 8 aa, Influenza virus
INGTCAVV

SEQ ID NO: 288516 - protein, 8 aa, Influenza virus
NGTCAVVM

SEQ ID NO: 288517 - protein, 8 aa, Influenza virus
GTCAVVMT

SEQ ID NO: 288518 - protein, 8 aa, Influenza virus
TCAVVMTD

SEQ ID NO: 288519 - protein, 8 aa, Influenza virus
CAVVMTDG

SEQ ID NO: 288520 - protein, 8 aa, Influenza virus
AVVMTDGS

SEQ ID NO: 288521 - protein, 8 aa, Influenza virus
VVMTDGNA

SEQ ID NO: 288522 - protein, 8 aa, Influenza virus
VMTDGNAS

SEQ ID NO: 288523 - protein, 8 aa, Influenza virus
MTDGSASE

SEQ ID NO: 288524 - protein, 8 aa, Influenza virus
LFIKEGKI

SEQ ID NO: 288525 - protein, 8 aa, Influenza virus
LSGSAQHI

SEQ ID NO: 288526 - protein, 8 aa, Influenza virus
SGSAQHIE

SEQ ID NO: 288527 - protein, 8 aa, Influenza virus
GSAQHIEE

SEQ ID NO: 288528 - protein, 8 aa, Influenza virus
SAQHIEEC

SEQ ID NO: 288529 - protein, 8 aa, Influenza virus
AQHIEECS

SEQ ID NO: 288530 - protein, 8 aa, Influenza virus
QHIEECSC

SEQ ID NO: 288531 - protein, 8 aa, Influenza virus
HIEECSCY

SEQ ID NO: 288532 - protein, 8 aa, Influenza virus
IEECSCYP

SEQ ID NO: 288533 - protein, 8 aa, Influenza virus
ECSCYPRF

SEQ ID NO: 288534 - protein, 8 aa, Influenza virus
CSCYPRFP

SEQ ID NO: 288535 - protein, 8 aa, Influenza virus
SCYPRYPN

SEQ ID NO: 288536 - protein, 8 aa, Influenza virus
GVRCICRD

SEQ ID NO: 288537 - protein, 8 aa, Influenza virus
VRCICRDN

SEQ ID NO: 288538 - protein, 8 aa, Influenza virus
RCICRDNW

SEQ ID NO: 288539 - protein, 8 aa, Influenza virus
CICRDNWK

SEQ ID NO: 288540 - protein, 8 aa, Influenza virus
ICRDNWKG

SEQ ID NO: 288541 - protein, 8 aa, Influenza virus
RDNWRGSN

SEQ ID NO: 288542 - protein, 8 aa, Influenza virus
WKGSNRPV

SEQ ID NO: 288543 - protein, 8 aa, Influenza virus
KGSNRPVV

SEQ ID NO: 288544 - protein, 8 aa, Influenza virus
GSNRPVVD

SEQ ID NO: 288545 - protein, 8 aa, Influenza virus
SNRPVVDI

SEQ ID NO: 288546 - protein, 8 aa, Influenza virus
NRPVVDIN

SEQ ID NO: 288547 - protein, 8 aa, Influenza virus
SRYVCSGL

SEQ ID NO: 288548 - protein, 8 aa, Influenza virus
RYVCSGLV

SEQ ID NO: 288549 - protein, 8 aa, Influenza virus
YMCSGLVG

SEQ ID NO: 288550 - protein, 8 aa, Influenza virus
MCSGLVGD

SEQ ID NO: 288551 - protein, 8 aa, Influenza virus
LVGDTPRN

SEQ ID NO: 288552 - protein, 8 aa, Influenza virus
PGVKGWAF

SEQ ID NO: 288553 - protein, 8 aa, Influenza virus
VKGWAFDN

SEQ ID NO: 288554 - protein, 8 aa, Influenza virus
KGWAFDNG

SEQ ID NO: 288555 - protein, 8 aa, Influenza virus
GDDVWMGR

SEQ ID NO: 288556 - protein, 8 aa, Influenza virus
DDVWMGRT

SEQ ID NO: 288557 - protein, 8 aa, Influenza virus
DIWMGRTI

SEQ ID NO: 288558 - protein, 8 aa, Influenza virus
VWMGRTIN

SEQ ID NO: 288559 - protein, 8 aa, Influenza virus
WMGRTISK

SEQ ID NO: 288560 - protein, 8 aa, Influenza virus
SRLGYETF

SEQ ID NO: 288561 - protein, 8 aa, Influenza virus
RLGYETFK

SEQ ID NO: 288562 - protein, 8 aa, Influenza virus
LGYETFKV

SEQ ID NO: 288563 - protein, 8 aa, Influenza virus
GYETFRVI

SEQ ID NO: 288564 - protein, 8 aa, Influenza virus
QTNRQVIV

SEQ ID NO: 288565 - protein, 8 aa, Influenza virus
WSGYSGIF

SEQ ID NO: 288566 - protein, 8 aa, Influenza virus
SGIFSVES

SEQ ID NO: 288567 - protein, 8 aa, Influenza virus
GIFSVESK

SEQ ID NO: 288568 - protein, 8 aa, Influenza virus
FSVESKSC

SEQ ID NO: 288569 - protein, 8 aa, Influenza virus
KSCVNRCF

SEQ ID NO: 288570 - protein, 8 aa, Influenza virus
SCVNRCFY

SEQ ID NO: 288571 - protein, 8 aa, Influenza virus
CVNRCFYV

SEQ ID NO: 288572 - protein, 8 aa, Influenza virus
VNRCFYVE

SEQ ID NO: 288573 - protein, 8 aa, Influenza virus
YVELIRGS

SEQ ID NO: 288574 - protein, 8 aa, Influenza virus
EVWWTSNS

SEQ ID NO: 288575 - protein, 8 aa, Influenza virus
VWWTSNSI

SEQ ID NO: 288576 - protein, 8 aa, Influenza virus
WWTSNSIV

SEQ ID NO: 288577 - protein, 8 aa, Influenza virus
GTSGTYGS

SEQ ID NO: 288578 - protein, 8 aa, Influenza virus
TSGTYGSG

SEQ ID NO: 288579 - protein, 8 aa, Influenza virus
SGTYGSGS

SEQ ID NO: 288580 - protein, 8 aa, Influenza virus
GTYGSGSW

SEQ ID NO: 288581 - protein, 8 aa, Influenza virus
TYGSGSWP

SEQ ID NO: 288582 - protein, 8 aa, Influenza virus
YGSGSWPD

SEQ ID NO: 288583 - protein, 8 aa, Influenza virus
GSGSWPDG

SEQ ID NO: 288584 - protein, 8 aa, Influenza virus
SGSWPDGA

SEQ ID NO: 288585 - protein, 8 aa, Influenza virus
GSWPDGAN

SEQ ID NO: 288586 - protein, 8 aa, Influenza virus
SWPDGANI

SEQ ID NO: 288587 - protein, 8 aa, Influenza virus
DIKSHAYI

SEQ ID NO: 288588 - protein, 8 aa, Influenza virus
IKSHAYIS

SEQ ID NO: 288589 - protein, 8 aa, Influenza virus
KSHAYISF

SEQ ID NO: 288590 - protein, 8 aa, Influenza virus
LMGRTRIS

SEQ ID NO: 288591 - protein, 8 aa, Influenza virus
YTENPVIC

SEQ ID NO: 288592 - protein, 8 aa, Influenza virus
TGNPVICM

SEQ ID NO: 288593 - protein, 8 aa, Influenza virus
GNPVICMG

SEQ ID NO: 288594 - protein, 8 aa, Influenza virus
NPVICMGH

SEQ ID NO: 288595 - protein, 8 aa, Influenza virus
PVICMGHH

SEQ ID NO: 288596 - protein, 8 aa, Influenza virus
VICMGHHA

SEQ ID NO: 288597 - protein, 8 aa, Influenza virus
ICMGHHAV

SEQ ID NO: 288598 - protein, 8 aa, Influenza virus
GHHAVSNG

SEQ ID NO: 288599 - protein, 8 aa, Influenza virus
HHAVSNGT

SEQ ID NO: 288600 - protein, 8 aa, Influenza virus
VSNGTMVK

SEQ ID NO: 288601 - protein, 8 aa, Influenza virus
SNGTMVKT

SEQ ID NO: 288602 - protein, 8 aa, Influenza virus
NGTIVKTL

SEQ ID NO: 288603 - protein, 8 aa, Influenza virus
GTIVKTLT

SEQ ID NO: 288604 - protein, 8 aa, Influenza virus
TMVKTLAD

SEQ ID NO: 288605 - protein, 8 aa, Influenza virus
VKTLADDQ

SEQ ID NO: 288606 - protein, 8 aa, Influenza virus
VEVVTAQE

SEQ ID NO: 288607 - protein, 8 aa, Influenza virus
EVVAAQEL

SEQ ID NO: 288608 - protein, 8 aa, Influenza virus
VVAAQELV

SEQ ID NO: 288609 - protein, 8 aa, Influenza virus
VAAQELVE

SEQ ID NO: 288610 - protein, 8 aa, Influenza virus
AAQELVES

SEQ ID NO: 288611 - protein, 8 aa, Influenza virus
AQELVEAQ

SEQ ID NO: 288612 - protein, 8 aa, Influenza virus
LELCPSPL

SEQ ID NO: 288613 - protein, 8 aa, Influenza virus
ELCPSPLK

SEQ ID NO: 288614 - protein, 8 aa, Influenza virus
LCPSPLKL

SEQ ID NO: 288615 - protein, 8 aa, Influenza virus
CPSPLRLI

SEQ ID NO: 288616 - protein, 8 aa, Influenza virus
PSPLRLID

SEQ ID NO: 288617 - protein, 8 aa, Influenza virus
SPLRLIDG

SEQ ID NO: 288618 - protein, 8 aa, Influenza virus
PLRLIDGQ

SEQ ID NO: 288619 - protein, 8 aa, Influenza virus
CDIINGAL

SEQ ID NO: 288620 - protein, 8 aa, Influenza virus
DIINGALG

SEQ ID NO: 288621 - protein, 8 aa, Influenza virus
IINGALGS

SEQ ID NO: 288622 - protein, 8 aa, Influenza virus
INGALGSP

SEQ ID NO: 288623 - protein, 8 aa, Influenza virus
NSALGSPG

SEQ ID NO: 288624 - protein, 8 aa, Influenza virus
SALGSPGC

SEQ ID NO: 288625 - protein, 8 aa, Influenza virus
LGSPGCDR

SEQ ID NO: 288626 - protein, 8 aa, Influenza virus
GSPGCDRL

SEQ ID NO: 288627 - protein, 8 aa, Influenza virus
EWDIFIER

SEQ ID NO: 288628 - protein, 8 aa, Influenza virus
WDIFIERP

SEQ ID NO: 288629 - protein, 8 aa, Influenza virus
CYPFDVPE

SEQ ID NO: 288630 - protein, 8 aa, Influenza virus
YPFDVPEY

SEQ ID NO: 288631 - protein, 8 aa, Influenza virus
PFDVPEYQ

SEQ ID NO: 288632 - protein, 8 aa, Influenza virus
FDVPEYQS

SEQ ID NO: 288633 - protein, 8 aa, Influenza virus
DVPEYQSL

SEQ ID NO: 288634 - protein, 8 aa, Influenza virus
VPEYQSLR

SEQ ID NO: 288635 - protein, 8 aa, Influenza virus
PEYQSLRS

SEQ ID NO: 288636 - protein, 8 aa, Influenza virus
EYQSLRSI

SEQ ID NO: 288637 - protein, 8 aa, Influenza virus
YQSIRSIL

SEQ ID NO: 288638 - protein, 8 aa, Influenza virus
SILANNGR

SEQ ID NO: 288639 - protein, 8 aa, Influenza virus
ILANNGRF

SEQ ID NO: 288640 - protein, 8 aa, Influenza virus
LANNGRFE

SEQ ID NO: 288641 - protein, 8 aa, Influenza virus
ANNGRFEF

SEQ ID NO: 288642 - protein, 8 aa, Influenza virus
NNGRFEFI

SEQ ID NO: 288643 - protein, 8 aa, Influenza virus
NGRFEFIA

SEQ ID NO: 288644 - protein, 8 aa, Influenza virus
GRFEFIAE

SEQ ID NO: 288645 - protein, 8 aa, Influenza virus
RFEFIAEE

SEQ ID NO: 288646 - protein, 8 aa, Influenza virus
FEFIAEDF

SEQ ID NO: 288647 - protein, 8 aa, Influenza virus
FIAEEFPW

SEQ ID NO: 288648 - protein, 8 aa, Influenza virus
TVKQDGKS

SEQ ID NO: 288649 - protein, 8 aa, Influenza virus
VKQNGKSS

SEQ ID NO: 288650 - protein, 8 aa, Influenza virus
KQNGKSSA

SEQ ID NO: 288651 - protein, 8 aa, Influenza virus
QNGKSSAC

SEQ ID NO: 288652 - protein, 8 aa, Influenza virus
NGKSSACK

SEQ ID NO: 288653 - protein, 8 aa, Influenza virus
GKSSACKR

SEQ ID NO: 288654 - protein, 8 aa, Influenza virus
KSSACKRA

SEQ ID NO: 288655 - protein, 8 aa, Influenza virus
SSACKRAN

SEQ ID NO: 288656 - protein, 8 aa, Influenza virus
RANINDFF

SEQ ID NO: 288657 - protein, 8 aa, Influenza virus
NDFFRRLN

SEQ ID NO: 288658 - protein, 8 aa, Influenza virus
DFFRRLNW

SEQ ID NO: 288659 - protein, 8 aa, Influenza virus
FFRRLNWL

SEQ ID NO: 288660 - protein, 8 aa, Influenza virus
RLNWLVKS

SEQ ID NO: 288661 - protein, 8 aa, Influenza virus
LNWLVKSD

SEQ ID NO: 288662 - protein, 8 aa, Influenza virus
EYPLQNLT

SEQ ID NO: 288663 - protein, 8 aa, Influenza virus
PLQNLTKI

SEQ ID NO: 288664 - protein, 8 aa, Influenza virus
LQNLTKIN

SEQ ID NO: 288665 - protein, 8 aa, Influenza virus
QNLTKINN

SEQ ID NO: 288666 - protein, 8 aa, Influenza virus
NLTKINNG

SEQ ID NO: 288667 - protein, 8 aa, Influenza virus
LTKINNGD

SEQ ID NO: 288668 - protein, 8 aa, Influenza virus
TKINNGDY

SEQ ID NO: 288669 - protein, 8 aa, Influenza virus
NNGDYTRL

SEQ ID NO: 288670 - protein, 8 aa, Influenza virus
NGDYTRLY

SEQ ID NO: 288671 - protein, 8 aa, Influenza virus
GDYTRLYI

SEQ ID NO: 288672 - protein, 8 aa, Influenza virus
DYTRLYIW

SEQ ID NO: 288673 - protein, 8 aa, Influenza virus
YTRLYIWG

SEQ ID NO: 288674 - protein, 8 aa, Influenza virus
TRLYIWGV

SEQ ID NO: 288675 - protein, 8 aa, Influenza virus
VHHPSTDK

SEQ ID NO: 288676 - protein, 8 aa, Influenza virus
HHPSTDKE

SEQ ID NO: 288677 - protein, 8 aa, Influenza virus
HPSTDKEQ

SEQ ID NO: 288678 - protein, 8 aa, Influenza virus
LYKNSPGR

SEQ ID NO: 288679 - protein, 8 aa, Influenza virus
YKNSPGRV

SEQ ID NO: 288680 - protein, 8 aa, Influenza virus
KNSPGRVT

SEQ ID NO: 288681 - protein, 8 aa, Influenza virus
NSPGRVTV

SEQ ID NO: 288682 - protein, 8 aa, Influenza virus
SPGRVTVS

SEQ ID NO: 288683 - protein, 8 aa, Influenza virus
PGRVSVST

SEQ ID NO: 288684 - protein, 8 aa, Influenza virus
GRVTVSTQ

SEQ ID NO: 288685 - protein, 8 aa, Influenza virus
QTSIVPNI

SEQ ID NO: 288686 - protein, 8 aa, Influenza virus
TSVVPNID

SEQ ID NO: 288687 - protein, 8 aa, Influenza virus
SVVPNIDS

SEQ ID NO: 288688 - protein, 8 aa, Influenza virus
RPLVRGQS

SEQ ID NO: 288689 - protein, 8 aa, Influenza virus
PLVRGQSG

SEQ ID NO: 288690 - protein, 8 aa, Influenza virus
LVRGQSGR

SEQ ID NO: 288691 - protein, 8 aa, Influenza virus
VRGQSGRV

SEQ ID NO: 288692 - protein, 8 aa, Influenza virus
RGQSGRVS

SEQ ID NO: 288693 - protein, 8 aa, Influenza virus
GQSGRVSF

SEQ ID NO: 288694 - protein, 8 aa, Influenza virus
QSGRVSFY

SEQ ID NO: 288695 - protein, 8 aa, Influenza virus
SGRVSFYW

SEQ ID NO: 288696 - protein, 8 aa, Influenza virus
GRVSFYWT

SEQ ID NO: 288697 - protein, 8 aa, Influenza virus
RVSFYWTI

SEQ ID NO: 288698 - protein, 8 aa, Influenza virus
VSFYWTIV

SEQ ID NO: 288699 - protein, 8 aa, Influenza virus
SFYWTIVD

SEQ ID NO: 288700 - protein, 8 aa, Influenza virus
FYWTIVDP

SEQ ID NO: 288701 - protein, 8 aa, Influenza virus
YWTIVDPG

SEQ ID NO: 288702 - protein, 8 aa, Influenza virus
WTIVDPGD

SEQ ID NO: 288703 - protein, 8 aa, Influenza virus
PGDIIVFN

SEQ ID NO: 288704 - protein, 8 aa, Influenza virus
GDIIVFNT

SEQ ID NO: 288705 - protein, 8 aa, Influenza virus
DIIVFNTI

SEQ ID NO: 288706 - protein, 8 aa, Influenza virus
IIVFNTIG

SEQ ID NO: 288707 - protein, 8 aa, Influenza virus
ILFNTIGN

SEQ ID NO: 288708 - protein, 8 aa, Influenza virus
LFNTIGNL

SEQ ID NO: 288709 - protein, 8 aa, Influenza virus
FNTIGNLV

SEQ ID NO: 288710 - protein, 8 aa, Influenza virus
NTIGNLVA

SEQ ID NO: 288711 - protein, 8 aa, Influenza virus
TIGNLVAP

SEQ ID NO: 288712 - protein, 8 aa, Influenza virus
IGNLVAPR

SEQ ID NO: 288713 - protein, 8 aa, Influenza virus
GNLVAPRG

SEQ ID NO: 288714 - protein, 8 aa, Influenza virus
NLVAPRGH

SEQ ID NO: 288715 - protein, 8 aa, Influenza virus
LVAPRGHY

SEQ ID NO: 288716 - protein, 8 aa, Influenza virus
VAPRGHYK

SEQ ID NO: 288717 - protein, 8 aa, Influenza virus
APRGHYRL

SEQ ID NO: 288718 - protein, 8 aa, Influenza virus
IGSCASKC

SEQ ID NO: 288719 - protein, 8 aa, Influenza virus
GSCASKCH

SEQ ID NO: 288720 - protein, 8 aa, Influenza virus
SCASKCHT

SEQ ID NO: 288721 - protein, 8 aa, Influenza virus
SKCHTDKG

SEQ ID NO: 288722 - protein, 8 aa, Influenza virus
KCHTDKGS

SEQ ID NO: 288723 - protein, 8 aa, Influenza virus
KPFQNVSR

SEQ ID NO: 288724 - protein, 8 aa, Influenza virus
PFQNISRV

SEQ ID NO: 288725 - protein, 8 aa, Influenza virus
FQNISRIA

SEQ ID NO: 288726 - protein, 8 aa, Influenza virus
GDCPKYIK

SEQ ID NO: 288727 - protein, 8 aa, Influenza virus
ECPKYVKQ

SEQ ID NO: 288728 - protein, 8 aa, Influenza virus
CPKYIKQG

SEQ ID NO: 288729 - protein, 8 aa, Influenza virus
PKYIKQGS

SEQ ID NO: 288730 - protein, 8 aa, Influenza virus
KYIKQGSL

SEQ ID NO: 288731 - protein, 8 aa, Influenza virus
YIKQGSLK

SEQ ID NO: 288732 - protein, 8 aa, Influenza virus
IKQGSLKL

SEQ ID NO: 288733 - protein, 8 aa, Influenza virus
KQGSLRLA

SEQ ID NO: 288734 - protein, 8 aa, Influenza virus
QGSLRLAT

SEQ ID NO: 288735 - protein, 8 aa, Influenza virus
GSLRLATG

SEQ ID NO: 288736 - protein, 8 aa, Influenza virus
GMRNIPER

SEQ ID NO: 288737 - protein, 8 aa, Influenza virus
KGLFGAIA

SEQ ID NO: 288738 - protein, 8 aa, Influenza virus
YGFRHQNS

SEQ ID NO: 288739 - protein, 8 aa, Influenza virus
GFRHQNSE

SEQ ID NO: 288740 - protein, 8 aa, Influenza virus
FRHQNSEG

SEQ ID NO: 288741 - protein, 8 aa, Influenza virus
RHQNSEGT

SEQ ID NO: 288742 - protein, 8 aa, Influenza virus
ADLKSTQT

SEQ ID NO: 288743 - protein, 8 aa, Influenza virus
DLKSTQTA

SEQ ID NO: 288744 - protein, 8 aa, Influenza virus
LKSTQTAI

SEQ ID NO: 288745 - protein, 8 aa, Influenza virus
KSTQTAID

SEQ ID NO: 288746 - protein, 8 aa, Influenza virus
STQTAIDQ

SEQ ID NO: 288747 - protein, 8 aa, Influenza virus
TQTAIDQI

SEQ ID NO: 288748 - protein, 8 aa, Influenza virus
QTAIDQIN

SEQ ID NO: 288749 - protein, 8 aa, Influenza virus
TAIDQING

SEQ ID NO: 288750 - protein, 8 aa, Influenza virus
AIDQITGK

SEQ ID NO: 288751 - protein, 8 aa, Influenza virus
IDQITGKL

SEQ ID NO: 288752 - protein, 8 aa, Influenza virus
DQITGKLN

SEQ ID NO: 288753 - protein, 8 aa, Influenza virus
QITGKLNR

SEQ ID NO: 288754 - protein, 8 aa, Influenza virus
ITGKLNRL

SEQ ID NO: 288755 - protein, 8 aa, Influenza virus
KLNRLIER

SEQ ID NO: 288756 - protein, 8 aa, Influenza virus
LNRLIERT

SEQ ID NO: 288757 - protein, 8 aa, Influenza virus
NRLIERTN

SEQ ID NO: 288758 - protein, 8 aa, Influenza virus
RLIERTNE

SEQ ID NO: 288759 - protein, 8 aa, Influenza virus
LIEKTNDK

SEQ ID NO: 288760 - protein, 8 aa, Influenza virus
IEKTNDKY

SEQ ID NO: 288761 - protein, 8 aa, Influenza virus
EKTNDKYH

SEQ ID NO: 288762 - protein, 8 aa, Influenza virus
KTNDKYHQ

SEQ ID NO: 288763 - protein, 8 aa, Influenza virus
TNDKYHQI

SEQ ID NO: 288764 - protein, 8 aa, Influenza virus
NDKYHQIE

SEQ ID NO: 288765 - protein, 8 aa, Influenza virus
DKYHQIEK

SEQ ID NO: 288766 - protein, 8 aa, Influenza virus
QIEKEFGQ

SEQ ID NO: 288767 - protein, 8 aa, Influenza virus
IEKEFGQV

SEQ ID NO: 288768 - protein, 8 aa, Influenza virus
EKEFGQVE

SEQ ID NO: 288769 - protein, 8 aa, Influenza virus
KEFGQVEG

SEQ ID NO: 288770 - protein, 8 aa, Influenza virus
EFGQVEGR

SEQ ID NO: 288771 - protein, 8 aa, Influenza virus
FGQVEGRI

SEQ ID NO: 288772 - protein, 8 aa, Influenza virus
GQVEGRIQ

SEQ ID NO: 288773 - protein, 8 aa, Influenza virus
QVEGRTQD

SEQ ID NO: 288774 - protein, 8 aa, Influenza virus
VEGRTQDL

SEQ ID NO: 288775 - protein, 8 aa, Influenza virus
EGRTQDLE

SEQ ID NO: 288776 - protein, 8 aa, Influenza virus
QDLERYVE

SEQ ID NO: 288777 - protein, 8 aa, Influenza virus
DLERYVED

SEQ ID NO: 288778 - protein, 8 aa, Influenza virus
LERYVEDT

SEQ ID NO: 288779 - protein, 8 aa, Influenza virus
ERYVEDTK

SEQ ID NO: 288780 - protein, 8 aa, Influenza virus
KYVEDTKV

SEQ ID NO: 288781 - protein, 8 aa, Influenza virus
YVEDTKVD

SEQ ID NO: 288782 - protein, 8 aa, Influenza virus
VEDTKVDL

SEQ ID NO: 288783 - protein, 8 aa, Influenza virus
EDTKVDLW

SEQ ID NO: 288784 - protein, 8 aa, Influenza virus
DTKVDLWS

SEQ ID NO: 288785 - protein, 8 aa, Influenza virus
TKVDLWSY

SEQ ID NO: 288786 - protein, 8 aa, Influenza virus
KVDLWSYN

SEQ ID NO: 288787 - protein, 8 aa, Influenza virus
VDLWSYNA

SEQ ID NO: 288788 - protein, 8 aa, Influenza virus
ENQHTIDM

SEQ ID NO: 288789 - protein, 8 aa, Influenza virus
NQHTIDMT

SEQ ID NO: 288790 - protein, 8 aa, Influenza virus
QHTIDMTD

SEQ ID NO: 288791 - protein, 8 aa, Influenza virus
HTIDMTDS

SEQ ID NO: 288792 - protein, 8 aa, Influenza virus
TIDMTDSE

SEQ ID NO: 288793 - protein, 8 aa, Influenza virus
IDMTDSEM

SEQ ID NO: 288794 - protein, 8 aa, Influenza virus
DMTDSEMN

SEQ ID NO: 288795 - protein, 8 aa, Influenza virus
VTDSEMNR

SEQ ID NO: 288796 - protein, 8 aa, Influenza virus
TDSEMDKL

SEQ ID NO: 288797 - protein, 8 aa, Influenza virus
DSEMNRLF

SEQ ID NO: 288798 - protein, 8 aa, Influenza virus
SEMDKLFE

SEQ ID NO: 288799 - protein, 8 aa, Influenza virus
EMNRLFER

SEQ ID NO: 288800 - protein, 8 aa, Influenza virus
MNRLFERV

SEQ ID NO: 288801 - protein, 8 aa, Influenza virus
NKLFERVK

SEQ ID NO: 288802 - protein, 8 aa, Influenza virus
KLFERVRH

SEQ ID NO: 288803 - protein, 8 aa, Influenza virus
LFERVRHQ

SEQ ID NO: 288804 - protein, 8 aa, Influenza virus
FERVRHQL

SEQ ID NO: 288805 - protein, 8 aa, Influenza virus
ERVRHQLR

SEQ ID NO: 288806 - protein, 8 aa, Influenza virus
RVRHQLRE

SEQ ID NO: 288807 - protein, 8 aa, Influenza virus
VRHQLREN

SEQ ID NO: 288808 - protein, 8 aa, Influenza virus
RHQLRENA

SEQ ID NO: 288809 - protein, 8 aa, Influenza virus
HQLRENAE

SEQ ID NO: 288810 - protein, 8 aa, Influenza virus
LRENAEDR

SEQ ID NO: 288811 - protein, 8 aa, Influenza virus
RENAEDRG

SEQ ID NO: 288812 - protein, 8 aa, Influenza virus
ENAEDRGN

SEQ ID NO: 288813 - protein, 8 aa, Influenza virus
NAEDRGNG

SEQ ID NO: 288814 - protein, 8 aa, Influenza virus
AEDRGNGC

SEQ ID NO: 288815 - protein, 8 aa, Influenza virus
EDRGNGCF

SEQ ID NO: 288816 - protein, 8 aa, Influenza virus
DRGNGCFE

SEQ ID NO: 288817 - protein, 8 aa, Influenza virus
RGNGCFEI

SEQ ID NO: 288818 - protein, 8 aa, Influenza virus
GCFEIFHK

SEQ ID NO: 288819 - protein, 8 aa, Influenza virus
CFEIFHKC

SEQ ID NO: 288820 - protein, 8 aa, Influenza virus
FEIFHKCD

SEQ ID NO: 288821 - protein, 8 aa, Influenza virus
EIFHKCDN

SEQ ID NO: 288822 - protein, 8 aa, Influenza virus
CDNSCIES

SEQ ID NO: 288823 - protein, 8 aa, Influenza virus
DNSCIESI

SEQ ID NO: 288824 - protein, 8 aa, Influenza virus
NSCIESIR

SEQ ID NO: 288825 - protein, 8 aa, Influenza virus
SCIESIRN

SEQ ID NO: 288826 - protein, 8 aa, Influenza virus
SIRNGTYN

SEQ ID NO: 288827 - protein, 8 aa, Influenza virus
IRNGTYNH

SEQ ID NO: 288828 - protein, 8 aa, Influenza virus
RNGTYNHD

SEQ ID NO: 288829 - protein, 8 aa, Influenza virus
TYDHDVYR

SEQ ID NO: 288830 - protein, 8 aa, Influenza virus
HDVYRDEA

SEQ ID NO: 288831 - protein, 8 aa, Influenza virus
DVYRDEAI

SEQ ID NO: 288832 - protein, 8 aa, Influenza virus
VYRDEAIN

SEQ ID NO: 288833 - protein, 8 aa, Influenza virus
YRDEAISN

SEQ ID NO: 288834 - protein, 8 aa, Influenza virus
RDEAISNR

SEQ ID NO: 288835 - protein, 8 aa, Influenza virus
DEAISNRF

SEQ ID NO: 288836 - protein, 8 aa, Influenza virus
EAISNRFQ

SEQ ID NO: 288837 - protein, 8 aa, Influenza virus
AISNRFQI

SEQ ID NO: 288838 - protein, 8 aa, Influenza virus
ISNRFQIQ

SEQ ID NO: 288839 - protein, 8 aa, Influenza virus
SNRFQIQG

SEQ ID NO: 288840 - protein, 8 aa, Influenza virus
SRFQIQGV

SEQ ID NO: 288841 - protein, 8 aa, Influenza virus
RFQIQGVR

SEQ ID NO: 288842 - protein, 8 aa, Influenza virus
FQIQGVRL

SEQ ID NO: 288843 - protein, 8 aa, Influenza virus
QIQGVRLT

SEQ ID NO: 288844 - protein, 8 aa, Influenza virus
IQGVRLTQ

SEQ ID NO: 288845 - protein, 8 aa, Influenza virus
QGVRLTQG

SEQ ID NO: 288846 - protein, 8 aa, Influenza virus
GVRLTQGY

SEQ ID NO: 288847 - protein, 8 aa, Influenza virus
VRLTQGYK

SEQ ID NO: 288848 - protein, 8 aa, Influenza virus
RLTQGYKD

SEQ ID NO: 288849 - protein, 8 aa, Influenza virus
LAQGYKDI

SEQ ID NO: 288850 - protein, 8 aa, Influenza virus
AQGYKDII

SEQ ID NO: 288851 - protein, 8 aa, Influenza virus
YKDIILWV

SEQ ID NO: 288852 - protein, 8 aa, Influenza virus
KDIILWVS

SEQ ID NO: 288853 - protein, 8 aa, Influenza virus
DIILWVSF

SEQ ID NO: 288854 - protein, 8 aa, Influenza virus
IILWVSFS

SEQ ID NO: 288855 - protein, 8 aa, Influenza virus
ILWVSFSI

SEQ ID NO: 288856 - protein, 8 aa, Influenza virus
LWVSFSIS

SEQ ID NO: 288857 - protein, 8 aa, Influenza virus
WVSFSISC

SEQ ID NO: 288858 - protein, 8 aa, Influenza virus
VSFSISCF

SEQ ID NO: 288859 - protein, 8 aa, Influenza virus
SISCFLLA

SEQ ID NO: 288860 - protein, 8 aa, Influenza virus
ISCFLLAA

SEQ ID NO: 288861 - protein, 8 aa, Influenza virus
SCFLLAAL

SEQ ID NO: 288862 - protein, 8 aa, Influenza virus
CFLLAALL

SEQ ID NO: 288863 - protein, 8 aa, Influenza virus
FLLAALLL

SEQ ID NO: 288864 - protein, 8 aa, Influenza virus
ALLIAFVL

SEQ ID NO: 288865 - protein, 8 aa, Influenza virus
LLIAFVLW

SEQ ID NO: 288866 - protein, 8 aa, Influenza virus
LIAFVLWA

SEQ ID NO: 288867 - protein, 8 aa, Influenza virus
IAFVLWAC

SEQ ID NO: 288868 - protein, 8 aa, Influenza virus
AFVLWACQ

SEQ ID NO: 288869 - protein, 8 aa, Influenza virus
FVLWACQN

SEQ ID NO: 288870 - protein, 8 aa, Influenza virus
VLWACQNG

SEQ ID NO: 288871 - protein, 8 aa, Influenza virus
LWACQTGN

SEQ ID NO: 288872 - protein, 8 aa, Influenza virus
WACQNGNL

SEQ ID NO: 288873 - protein, 8 aa, Influenza virus
ACQNGNLR

SEQ ID NO: 288874 - protein, 8 aa, Influenza virus
CQNGNLRC

SEQ ID NO: 288875 - protein, 8 aa, Influenza virus
QNGNLRCQ

SEQ ID NO: 288876 - protein, 8 aa, Influenza virus
NGNLRCQI

SEQ ID NO: 288877 - protein, 8 aa, Influenza virus
GNLRCQIC

SEQ ID NO: 288878 - protein, 8 aa, Influenza virus
NLRCQICI

SEQ ID NO: 288879 - protein, 8 aa, Influenza virus
ICQMEKIV

SEQ ID NO: 288880 - protein, 8 aa, Influenza virus
CQMEKIVL

SEQ ID NO: 288881 - protein, 8 aa, Influenza virus
QMEKIVLL

SEQ ID NO: 288882 - protein, 8 aa, Influenza virus
GDQICIGY

SEQ ID NO: 288883 - protein, 8 aa, Influenza virus
DHICIGYH

SEQ ID NO: 288884 - protein, 8 aa, Influenza virus
HICIGYHA

SEQ ID NO: 288885 - protein, 8 aa, Influenza virus
ICVGYHAN

SEQ ID NO: 288886 - protein, 8 aa, Influenza virus
CVGYHANN

SEQ ID NO: 288887 - protein, 8 aa, Influenza virus
VGYHANNS

SEQ ID NO: 288888 - protein, 8 aa, Influenza virus
YHANNSTK

SEQ ID NO: 288889 - protein, 8 aa, Influenza virus
HANNSTKQ

SEQ ID NO: 288890 - protein, 8 aa, Influenza virus
STKQVDTI

SEQ ID NO: 288891 - protein, 8 aa, Influenza virus
KQVDTIME

SEQ ID NO: 288892 - protein, 8 aa, Influenza virus
QIDTIMEK

SEQ ID NO: 288893 - protein, 8 aa, Influenza virus
IDTIMEKN

SEQ ID NO: 288894 - protein, 8 aa, Influenza virus
DTIMERNV

SEQ ID NO: 288895 - protein, 8 aa, Influenza virus
TIMERNVT

SEQ ID NO: 288896 - protein, 8 aa, Influenza virus
IMERNVTV

SEQ ID NO: 288897 - protein, 8 aa, Influenza virus
MERNVTVT

SEQ ID NO: 288898 - protein, 8 aa, Influenza virus
ERNVTVTH

SEQ ID NO: 288899 - protein, 8 aa, Influenza virus
RNVTVTHA

SEQ ID NO: 288900 - protein, 8 aa, Influenza virus
NVTVTHAK

SEQ ID NO: 288901 - protein, 8 aa, Influenza virus
VTVTHAQN

SEQ ID NO: 288902 - protein, 8 aa, Influenza virus
TVTHAQNI

SEQ ID NO: 288903 - protein, 8 aa, Influenza virus
VTHAQNIL

SEQ ID NO: 288904 - protein, 8 aa, Influenza virus
THAQNILE

SEQ ID NO: 288905 - protein, 8 aa, Influenza virus
HAQDILER

SEQ ID NO: 288906 - protein, 8 aa, Influenza virus
GVKPLILK

SEQ ID NO: 288907 - protein, 8 aa, Influenza virus
KPLILKDC

SEQ ID NO: 288908 - protein, 8 aa, Influenza virus
PLILKDCS

SEQ ID NO: 288909 - protein, 8 aa, Influenza virus
LILKDCSV

SEQ ID NO: 288910 - protein, 8 aa, Influenza virus
ILKDCSVA

SEQ ID NO: 288911 - protein, 8 aa, Influenza virus
LKDCSVAG

SEQ ID NO: 288912 - protein, 8 aa, Influenza virus
KDCSVAGW

SEQ ID NO: 288913 - protein, 8 aa, Influenza virus
DCSIAGWL

SEQ ID NO: 288914 - protein, 8 aa, Influenza virus
CSIAGWLL

SEQ ID NO: 288915 - protein, 8 aa, Influenza virus
SIAGWLLG

SEQ ID NO: 288916 - protein, 8 aa, Influenza virus
IAGWLLGN

SEQ ID NO: 288917 - protein, 8 aa, Influenza virus
GWLLGNPL

SEQ ID NO: 288918 - protein, 8 aa, Influenza virus
WLLGNPLC

SEQ ID NO: 288919 - protein, 8 aa, Influenza virus
LLGNPLCD

SEQ ID NO: 288920 - protein, 8 aa, Influenza virus
LGNPLCDE

SEQ ID NO: 288921 - protein, 8 aa, Influenza virus
GNPLCDEF

SEQ ID NO: 288922 - protein, 8 aa, Influenza virus
NVSEWSYI

SEQ ID NO: 288923 - protein, 8 aa, Influenza virus
VSEWSYIV

SEQ ID NO: 288924 - protein, 8 aa, Influenza virus
SEWSYIVE

SEQ ID NO: 288925 - protein, 8 aa, Influenza virus
NYEELKHL

SEQ ID NO: 288926 - protein, 8 aa, Influenza virus
TGRSSFFR

SEQ ID NO: 288927 - protein, 8 aa, Influenza virus
SFYRNVVW

SEQ ID NO: 288928 - protein, 8 aa, Influenza virus
FYRNVVWL

SEQ ID NO: 288929 - protein, 8 aa, Influenza virus
LLILWGIH

SEQ ID NO: 288930 - protein, 8 aa, Influenza virus
LILWGIHH

SEQ ID NO: 288931 - protein, 8 aa, Influenza virus
YVSVGTST

SEQ ID NO: 288932 - protein, 8 aa, Influenza virus
VSVGTSTL

SEQ ID NO: 288933 - protein, 8 aa, Influenza virus
SIGTSTLN

SEQ ID NO: 288934 - protein, 8 aa, Influenza virus
IGTSTLNQ

SEQ ID NO: 288935 - protein, 8 aa, Influenza virus
GTSTLNLR

SEQ ID NO: 288936 - protein, 8 aa, Influenza virus
TSTLNQRS

SEQ ID NO: 288937 - protein, 8 aa, Influenza virus
FESTGNFI

SEQ ID NO: 288938 - protein, 8 aa, Influenza virus
ESTGNFIA

SEQ ID NO: 288939 - protein, 8 aa, Influenza virus
STGNFIAP

SEQ ID NO: 288940 - protein, 8 aa, Influenza virus
TGNFIAPE

SEQ ID NO: 288941 - protein, 8 aa, Influenza virus
GNFIAPEN

SEQ ID NO: 288942 - protein, 8 aa, Influenza virus
NFIAPENA

SEQ ID NO: 288943 - protein, 8 aa, Influenza virus
FIAPENAY

SEQ ID NO: 288944 - protein, 8 aa, Influenza virus
IAPENAYK

SEQ ID NO: 288945 - protein, 8 aa, Influenza virus
APENAYKI

SEQ ID NO: 288946 - protein, 8 aa, Influenza virus
CQTPIGAI

SEQ ID NO: 288947 - protein, 8 aa, Influenza virus
QTPIGAIN

SEQ ID NO: 288948 - protein, 8 aa, Influenza virus
GAINSSLP

SEQ ID NO: 288949 - protein, 8 aa, Influenza virus
NSSLPFHN

SEQ ID NO: 288950 - protein, 8 aa, Influenza virus
SSMPFHNV

SEQ ID NO: 288951 - protein, 8 aa, Influenza virus
SMPFHNVH

SEQ ID NO: 288952 - protein, 8 aa, Influenza virus
MPFHNVHP

SEQ ID NO: 288953 - protein, 8 aa, Influenza virus
PFHNVHPL

SEQ ID NO: 288954 - protein, 8 aa, Influenza virus
FHNVHPLT

SEQ ID NO: 288955 - protein, 8 aa, Influenza virus
HNVHPLTI

SEQ ID NO: 288956 - protein, 8 aa, Influenza virus
NVHPLTIG

SEQ ID NO: 288957 - protein, 8 aa, Influenza virus
VHPLTIGE

SEQ ID NO: 288958 - protein, 8 aa, Influenza virus
HPFTIGEC

SEQ ID NO: 288959 - protein, 8 aa, Influenza virus
PFTIGECP

SEQ ID NO: 288960 - protein, 8 aa, Influenza virus
FTIGECPK

SEQ ID NO: 288961 - protein, 8 aa, Influenza virus
TIGECPRY

SEQ ID NO: 288962 - protein, 8 aa, Influenza virus
IGECPRYV

SEQ ID NO: 288963 - protein, 8 aa, Influenza virus
GECPRYVK

SEQ ID NO: 288964 - protein, 8 aa, Influenza virus
ECPRYVKS

SEQ ID NO: 288965 - protein, 8 aa, Influenza virus
LVLATGPR

SEQ ID NO: 288966 - protein, 8 aa, Influenza virus
VLATGPRN

SEQ ID NO: 288967 - protein, 8 aa, Influenza virus
RRKRGLFG

SEQ ID NO: 288968 - protein, 8 aa, Influenza virus
ETRGLFGA

SEQ ID NO: 288969 - protein, 8 aa, Influenza virus
KRRKKRGL

SEQ ID NO: 288970 - protein, 8 aa, Influenza virus
RRKKRGLF

SEQ ID NO: 288971 - protein, 8 aa, Influenza virus
RKKRGLFG

SEQ ID NO: 288972 - protein, 8 aa, Influenza virus
KKRGLFGA

SEQ ID NO: 288973 - protein, 8 aa, Influenza virus
TRGLFGAI

SEQ ID NO: 288974 - protein, 8 aa, Influenza virus
EGGWQGMI

SEQ ID NO: 288975 - protein, 8 aa, Influenza virus
GGWQGMID

SEQ ID NO: 288976 - protein, 8 aa, Influenza virus
GWQGMIDG

SEQ ID NO: 288977 - protein, 8 aa, Influenza virus
WQGMIDGW

SEQ ID NO: 288978 - protein, 8 aa, Influenza virus
QGMIDGWY

SEQ ID NO: 288979 - protein, 8 aa, Influenza virus
GMIDGWYG

SEQ ID NO: 288980 - protein, 8 aa, Influenza virus
MVDGWYGF

SEQ ID NO: 288981 - protein, 8 aa, Influenza virus
VDGWYGFH

SEQ ID NO: 288982 - protein, 8 aa, Influenza virus
DGWYGFHH

SEQ ID NO: 288983 - protein, 8 aa, Influenza virus
GWYGFHHS

SEQ ID NO: 288984 - protein, 8 aa, Influenza virus
WYGFHHSN

SEQ ID NO: 288985 - protein, 8 aa, Influenza virus
NGQGSGYA

SEQ ID NO: 288986 - protein, 8 aa, Influenza virus
GQGSGYAA

SEQ ID NO: 288987 - protein, 8 aa, Influenza virus
GSGYAADQ

SEQ ID NO: 288988 - protein, 8 aa, Influenza virus
SGYAADQE

SEQ ID NO: 288989 - protein, 8 aa, Influenza virus
GYAADQES

SEQ ID NO: 288990 - protein, 8 aa, Influenza virus
YAADQEST

SEQ ID NO: 288991 - protein, 8 aa, Influenza virus
AADQESTQ

SEQ ID NO: 288992 - protein, 8 aa, Influenza virus
ADKESTQR

SEQ ID NO: 288993 - protein, 8 aa, Influenza virus
DKESTQRA

SEQ ID NO: 288994 - protein, 8 aa, Influenza virus
ESTQRAID

SEQ ID NO: 288995 - protein, 8 aa, Influenza virus
STQRAIDG

SEQ ID NO: 288996 - protein, 8 aa, Influenza virus
DGITNKVN

SEQ ID NO: 288997 - protein, 8 aa, Influenza virus
GITNKVNS

SEQ ID NO: 288998 - protein, 8 aa, Influenza virus
ITNKVNSI

SEQ ID NO: 288999 - protein, 8 aa, Influenza virus
TNKINSII

SEQ ID NO: 289000 - protein, 8 aa, Influenza virus
NKVNSIIN

SEQ ID NO: 289001 - protein, 8 aa, Influenza virus
KVNSIINK

SEQ ID NO: 289002 - protein, 8 aa, Influenza virus
VNSIINKM

SEQ ID NO: 289003 - protein, 8 aa, Influenza virus
NSIINKMN

SEQ ID NO: 289004 - protein, 8 aa, Influenza virus
SIINKMNT

SEQ ID NO: 289005 - protein, 8 aa, Influenza virus
IINKMNTQ

SEQ ID NO: 289006 - protein, 8 aa, Influenza virus
INKMNTQF

SEQ ID NO: 289007 - protein, 8 aa, Influenza virus
LEKRIENL

SEQ ID NO: 289008 - protein, 8 aa, Influenza virus
EKRIENLN

SEQ ID NO: 289009 - protein, 8 aa, Influenza virus
NLNRKMED

SEQ ID NO: 289010 - protein, 8 aa, Influenza virus
LNRKMEDG

SEQ ID NO: 289011 - protein, 8 aa, Influenza virus
NRKMEDGF

SEQ ID NO: 289012 - protein, 8 aa, Influenza virus
EDGFLNVW

SEQ ID NO: 289013 - protein, 8 aa, Influenza virus
GFLNVWTY

SEQ ID NO: 289014 - protein, 8 aa, Influenza virus
FLNVWTYN

SEQ ID NO: 289015 - protein, 8 aa, Influenza virus
LNVWTYNA

SEQ ID NO: 289016 - protein, 8 aa, Influenza virus
NVWTYNAE

SEQ ID NO: 289017 - protein, 8 aa, Influenza virus
AEILVLME

SEQ ID NO: 289018 - protein, 8 aa, Influenza virus
ENERTLDL

SEQ ID NO: 289019 - protein, 8 aa, Influenza virus
NERTLDLH

SEQ ID NO: 289020 - protein, 8 aa, Influenza virus
ERTLDLHD

SEQ ID NO: 289021 - protein, 8 aa, Influenza virus
RTLDLHDS

SEQ ID NO: 289022 - protein, 8 aa, Influenza virus
TLDLHDSN

SEQ ID NO: 289023 - protein, 8 aa, Influenza virus
LDLHDSNV

SEQ ID NO: 289024 - protein, 8 aa, Influenza virus
DLHDSNVK

SEQ ID NO: 289025 - protein, 8 aa, Influenza virus
LHDSNVKN

SEQ ID NO: 289026 - protein, 8 aa, Influenza virus
HDSNVRNL

SEQ ID NO: 289027 - protein, 8 aa, Influenza virus
DSNVRNLY

SEQ ID NO: 289028 - protein, 8 aa, Influenza virus
SNVKNLYE

SEQ ID NO: 289029 - protein, 8 aa, Influenza virus
NVKNLYEK

SEQ ID NO: 289030 - protein, 8 aa, Influenza virus
VKNLYEKV

SEQ ID NO: 289031 - protein, 8 aa, Influenza virus
KNLYEKVR

SEQ ID NO: 289032 - protein, 8 aa, Influenza virus
NLYEKVRL

SEQ ID NO: 289033 - protein, 8 aa, Influenza virus
LYEKVRLQ

SEQ ID NO: 289034 - protein, 8 aa, Influenza virus
YEKVRLQL

SEQ ID NO: 289035 - protein, 8 aa, Influenza virus
KVRLQLKD

SEQ ID NO: 289036 - protein, 8 aa, Influenza virus
VRLQLKDN

SEQ ID NO: 289037 - protein, 8 aa, Influenza virus
RLQLKDNA

SEQ ID NO: 289038 - protein, 8 aa, Influenza virus
LQLKDNAK

SEQ ID NO: 289039 - protein, 8 aa, Influenza virus
QLKDNAKE

SEQ ID NO: 289040 - protein, 8 aa, Influenza virus
LKDNAKEL

SEQ ID NO: 289041 - protein, 8 aa, Influenza virus
KDNAKELG

SEQ ID NO: 289042 - protein, 8 aa, Influenza virus
DNARELGN

SEQ ID NO: 289043 - protein, 8 aa, Influenza virus
NARELGNG

SEQ ID NO: 289044 - protein, 8 aa, Influenza virus
ARELGNGC

SEQ ID NO: 289045 - protein, 8 aa, Influenza virus
RELGNGCF

SEQ ID NO: 289046 - protein, 8 aa, Influenza virus
GCFEFYHR

SEQ ID NO: 289047 - protein, 8 aa, Influenza virus
CFEFYHRC

SEQ ID NO: 289048 - protein, 8 aa, Influenza virus
FEFYHRCD

SEQ ID NO: 289049 - protein, 8 aa, Influenza virus
EFYHRCDN

SEQ ID NO: 289050 - protein, 8 aa, Influenza virus
CMESIRNG

SEQ ID NO: 289051 - protein, 8 aa, Influenza virus
MESIRNGT

SEQ ID NO: 289052 - protein, 8 aa, Influenza virus
ESIRNGTY

SEQ ID NO: 289053 - protein, 8 aa, Influenza virus
IYQILSIY

SEQ ID NO: 289054 - protein, 8 aa, Influenza virus
QILSVYST

SEQ ID NO: 289055 - protein, 8 aa, Influenza virus
ILSIYSTA

SEQ ID NO: 289056 - protein, 8 aa, Influenza virus
LSIYSTAA

SEQ ID NO: 289057 - protein, 8 aa, Influenza virus
SIYSTAAS

SEQ ID NO: 289058 - protein, 8 aa, Influenza virus
IYSTAASS

SEQ ID NO: 289059 - protein, 8 aa, Influenza virus
YSTAASSL

SEQ ID NO: 289060 - protein, 8 aa, Influenza virus
ASSLVLAI

SEQ ID NO: 289061 - protein, 8 aa, Influenza virus
SSLVLAIM

SEQ ID NO: 289062 - protein, 8 aa, Influenza virus
LAIMIAGL

SEQ ID NO: 289063 - protein, 8 aa, Influenza virus
AGLSFWMC

SEQ ID NO: 289064 - protein, 8 aa, Influenza virus
GLSFWMCS

SEQ ID NO: 289065 - protein, 8 aa, Influenza virus
LSFWMCSN

SEQ ID NO: 289066 - protein, 8 aa, Influenza virus
SFWMCSNG

SEQ ID NO: 289067 - protein, 8 aa, Influenza virus
FWMCSNGS

SEQ ID NO: 289068 - protein, 8 aa, Influenza virus
WMCSNGSY

SEQ ID NO: 289069 - protein, 8 aa, Influenza virus
MCFNGSLQ

SEQ ID NO: 289070 - protein, 8 aa, Influenza virus
CFNGSLQC

SEQ ID NO: 289071 - protein, 8 aa, Influenza virus
SNGSLQCK

SEQ ID NO: 289072 - protein, 8 aa, Influenza virus
NGSLQCRV

SEQ ID NO: 289073 - protein, 8 aa, Influenza virus
GSLQCRVC

SEQ ID NO: 289074 - protein, 8 aa, Influenza virus
SLQCRVCI

SEQ ID NO: 289075 - protein, 8 aa, Influenza virus
CIRFVNSD

SEQ ID NO: 289076 - protein, 8 aa, Influenza virus
KICESRLR

SEQ ID NO: 289077 - protein, 8 aa, Influenza virus
ICQMEKIV

SEQ ID NO: 289078 - protein, 8 aa, Influenza virus
CQMEKIVL

SEQ ID NO: 289079 - protein, 8 aa, Influenza virus
QMEKIVLL

SEQ ID NO: 289080 - protein, 8 aa, Influenza virus
SDHICIGY

SEQ ID NO: 289081 - protein, 8 aa, Influenza virus
DHICIGYH

SEQ ID NO: 289082 - protein, 8 aa, Influenza virus
HICIGYHA

SEQ ID NO: 289083 - protein, 8 aa, Influenza virus
ICVGYHAN

SEQ ID NO: 289084 - protein, 8 aa, Influenza virus
CVGYHANN

SEQ ID NO: 289085 - protein, 8 aa, Influenza virus
VGYHANNS

SEQ ID NO: 289086 - protein, 8 aa, Influenza virus
YHANNSTK

SEQ ID NO: 289087 - protein, 8 aa, Influenza virus
HANNSTKQ

SEQ ID NO: 289088 - protein, 8 aa, Influenza virus
ANNSTKQV

SEQ ID NO: 289089 - protein, 8 aa, Influenza virus
NNSTKQVD

SEQ ID NO: 289090 - protein, 8 aa, Influenza virus
NSTKQVDT

SEQ ID NO: 289091 - protein, 8 aa, Influenza virus
STKQVDTI

SEQ ID NO: 289092 - protein, 8 aa, Influenza virus
TKQVDTIM

SEQ ID NO: 289093 - protein, 8 aa, Influenza virus
KQVDTIME

SEQ ID NO: 289094 - protein, 8 aa, Influenza virus
QVDTIMER

SEQ ID NO: 289095 - protein, 8 aa, Influenza virus
TIMERNVT

SEQ ID NO: 289096 - protein, 8 aa, Influenza virus
IMERNVTV

SEQ ID NO: 289097 - protein, 8 aa, Influenza virus
MERNVTVT

SEQ ID NO: 289098 - protein, 8 aa, Influenza virus
ERNVTVTH

SEQ ID NO: 289099 - protein, 8 aa, Influenza virus
RNVTVTHA

SEQ ID NO: 289100 - protein, 8 aa, Influenza virus
NVTVTHAK

SEQ ID NO: 289101 - protein, 8 aa, Influenza virus
VTVTHAQN

SEQ ID NO: 289102 - protein, 8 aa, Influenza virus
TVTHAQNI

SEQ ID NO: 289103 - protein, 8 aa, Influenza virus
VTHAQNIL

SEQ ID NO: 289104 - protein, 8 aa, Influenza virus
THAQNILE

SEQ ID NO: 289105 - protein, 8 aa, Influenza virus
HAQDILER

SEQ ID NO: 289106 - protein, 8 aa, Influenza virus
DILERTHN

SEQ ID NO: 289107 - protein, 8 aa, Influenza virus
ILERTHNG

SEQ ID NO: 289108 - protein, 8 aa, Influenza virus
HNGKLCNL

SEQ ID NO: 289109 - protein, 8 aa, Influenza virus
LNGVKPLI

SEQ ID NO: 289110 - protein, 8 aa, Influenza virus
NGVKPLIL

SEQ ID NO: 289111 - protein, 8 aa, Influenza virus
GVKPLILK

SEQ ID NO: 289112 - protein, 8 aa, Influenza virus
VKPLILKD

SEQ ID NO: 289113 - protein, 8 aa, Influenza virus
KPLILKDC

SEQ ID NO: 289114 - protein, 8 aa, Influenza virus
PLILKDCS

SEQ ID NO: 289115 - protein, 8 aa, Influenza virus
LILKDCSV

SEQ ID NO: 289116 - protein, 8 aa, Influenza virus
ILKDCSVA

SEQ ID NO: 289117 - protein, 8 aa, Influenza virus
LKDCSVAG

SEQ ID NO: 289118 - protein, 8 aa, Influenza virus
KDCSVAGW

SEQ ID NO: 289119 - protein, 8 aa, Influenza virus
GWLLGNPL

SEQ ID NO: 289120 - protein, 8 aa, Influenza virus
WLLGNPLC

SEQ ID NO: 289121 - protein, 8 aa, Influenza virus
LLGNPLCD

SEQ ID NO: 289122 - protein, 8 aa, Influenza virus
LGNPLCDE

SEQ ID NO: 289123 - protein, 8 aa, Influenza virus
GNPLCDEF

SEQ ID NO: 289124 - protein, 8 aa, Influenza virus
NVSEWSYI

SEQ ID NO: 289125 - protein, 8 aa, Influenza virus
VSEWSYIV

SEQ ID NO: 289126 - protein, 8 aa, Influenza virus
SEWSYIVE

SEQ ID NO: 289127 - protein, 8 aa, Influenza virus
WSYIVEKI

SEQ ID NO: 289128 - protein, 8 aa, Influenza virus
FNNYEELK

SEQ ID NO: 289129 - protein, 8 aa, Influenza virus
NNYEELKH

SEQ ID NO: 289130 - protein, 8 aa, Influenza virus
NYEELKHL

SEQ ID NO: 289131 - protein, 8 aa, Influenza virus
YEELKHLM

SEQ ID NO: 289132 - protein, 8 aa, Influenza virus
EELKHLMS

SEQ ID NO: 289133 - protein, 8 aa, Influenza virus
ELKHLMSS

SEQ ID NO: 289134 - protein, 8 aa, Influenza virus
LKHLMSST

SEQ ID NO: 289135 - protein, 8 aa, Influenza virus
KHLMSSTN

SEQ ID NO: 289136 - protein, 8 aa, Influenza virus
SFYRNVVW

SEQ ID NO: 289137 - protein, 8 aa, Influenza virus
FYRNVVWL

SEQ ID NO: 289138 - protein, 8 aa, Influenza virus
EDLLILWG

SEQ ID NO: 289139 - protein, 8 aa, Influenza virus
LLILWGIH

SEQ ID NO: 289140 - protein, 8 aa, Influenza virus
LILWGIHH

SEQ ID NO: 289141 - protein, 8 aa, Influenza virus
LWGIHHSN

SEQ ID NO: 289142 - protein, 8 aa, Influenza virus
WGIHHSND

SEQ ID NO: 289143 - protein, 8 aa, Influenza virus
TYISIGTS

SEQ ID NO: 289144 - protein, 8 aa, Influenza virus
YISIGTST

SEQ ID NO: 289145 - protein, 8 aa, Influenza virus
ISIGTSTL

SEQ ID NO: 289146 - protein, 8 aa, Influenza virus
SIGTSTLN

SEQ ID NO: 289147 - protein, 8 aa, Influenza virus
IGTSTLNQ

SEQ ID NO: 289148 - protein, 8 aa, Influenza virus
GTSTLNLR

SEQ ID NO: 289149 - protein, 8 aa, Influenza virus
TSTLNLRL

SEQ ID NO: 289150 - protein, 8 aa, Influenza virus
KINGQSGR

SEQ ID NO: 289151 - protein, 8 aa, Influenza virus
IHFESNGN

SEQ ID NO: 289152 - protein, 8 aa, Influenza virus
HFESNGNF

SEQ ID NO: 289153 - protein, 8 aa, Influenza virus
FDSNGNFI

SEQ ID NO: 289154 - protein, 8 aa, Influenza virus
DSNGNFIA

SEQ ID NO: 289155 - protein, 8 aa, Influenza virus
NGNFITPE

SEQ ID NO: 289156 - protein, 8 aa, Influenza virus
GNFIAPEN

SEQ ID NO: 289157 - protein, 8 aa, Influenza virus
NFIAPENA

SEQ ID NO: 289158 - protein, 8 aa, Influenza virus
FIAPENAY

SEQ ID NO: 289159 - protein, 8 aa, Influenza virus
IAPENAYK

SEQ ID NO: 289160 - protein, 8 aa, Influenza virus
APENAYKI

SEQ ID NO: 289161 - protein, 8 aa, Influenza virus
PENAYKIV

SEQ ID NO: 289162 - protein, 8 aa, Influenza virus
ENAYKIVK

SEQ ID NO: 289163 - protein, 8 aa, Influenza virus
NAYKIVKK

SEQ ID NO: 289164 - protein, 8 aa, Influenza virus
AYKIVKEG

SEQ ID NO: 289165 - protein, 8 aa, Influenza virus
YKIVKEGD

SEQ ID NO: 289166 - protein, 8 aa, Influenza virus
KIVKEGDS

SEQ ID NO: 289167 - protein, 8 aa, Influenza virus
CNTRCQTP

SEQ ID NO: 289168 - protein, 8 aa, Influenza virus
CQTPMGAI

SEQ ID NO: 289169 - protein, 8 aa, Influenza virus
QTPMGAIN

SEQ ID NO: 289170 - protein, 8 aa, Influenza virus
TPMGAINS

SEQ ID NO: 289171 - protein, 8 aa, Influenza virus
PMGAINSS

SEQ ID NO: 289172 - protein, 8 aa, Influenza virus
MGAINSSM

SEQ ID NO: 289173 - protein, 8 aa, Influenza virus
GAVNSSMP

SEQ ID NO: 289174 - protein, 8 aa, Influenza virus
AVNSSMPF

SEQ ID NO: 289175 - protein, 8 aa, Influenza virus
VNSSMPFH

SEQ ID NO: 289176 - protein, 8 aa, Influenza virus
NSSMPLHN

SEQ ID NO: 289177 - protein, 8 aa, Influenza virus
SSMPFHNV

SEQ ID NO: 289178 - protein, 8 aa, Influenza virus
SMPFHNVH

SEQ ID NO: 289179 - protein, 8 aa, Influenza virus
MPFHNVHP

SEQ ID NO: 289180 - protein, 8 aa, Influenza virus
PFHNVHPL

SEQ ID NO: 289181 - protein, 8 aa, Influenza virus
FHNVHPLT

SEQ ID NO: 289182 - protein, 8 aa, Influenza virus
HNVHPLTI

SEQ ID NO: 289183 - protein, 8 aa, Influenza virus
NVHPLTIG

SEQ ID NO: 289184 - protein, 8 aa, Influenza virus
VHPLTIGE

SEQ ID NO: 289185 - protein, 8 aa, Influenza virus
LTIGKCPK

SEQ ID NO: 289186 - protein, 8 aa, Influenza virus
CPKYVKSD

SEQ ID NO: 289187 - protein, 8 aa, Influenza virus
KLVLATGL

SEQ ID NO: 289188 - protein, 8 aa, Influenza virus
LILATGLR

SEQ ID NO: 289189 - protein, 8 aa, Influenza virus
ILATGLRN

SEQ ID NO: 289190 - protein, 8 aa, Influenza virus
LATGLRNT

SEQ ID NO: 289191 - protein, 8 aa, Influenza virus
RKRGLFGA

SEQ ID NO: 289192 - protein, 8 aa, Influenza virus
KRGLFGAI

SEQ ID NO: 289193 - protein, 8 aa, Influenza virus
TRGLFGAI

SEQ ID NO: 289194 - protein, 8 aa, Influenza virus
EGGWQGMI

SEQ ID NO: 289195 - protein, 8 aa, Influenza virus
GGWQGMID

SEQ ID NO: 289196 - protein, 8 aa, Influenza virus
GWQGMIDG

SEQ ID NO: 289197 - protein, 8 aa, Influenza virus
WQGMIDGW

SEQ ID NO: 289198 - protein, 8 aa, Influenza virus
QGMIDGWY

SEQ ID NO: 289199 - protein, 8 aa, Influenza virus
GMIDGWYG

SEQ ID NO: 289200 - protein, 8 aa, Influenza virus
MVDGWYGF

SEQ ID NO: 289201 - protein, 8 aa, Influenza virus
VDGWYGFH

SEQ ID NO: 289202 - protein, 8 aa, Influenza virus
DGWYGFHH

SEQ ID NO: 289203 - protein, 8 aa, Influenza virus
GWYGFHHS

SEQ ID NO: 289204 - protein, 8 aa, Influenza virus
WYGFHHSN

SEQ ID NO: 289205 - protein, 8 aa, Influenza virus
YGFHHSNE

SEQ ID NO: 289206 - protein, 8 aa, Influenza virus
GFHHSNEQ

SEQ ID NO: 289207 - protein, 8 aa, Influenza virus
FHHSNEQG

SEQ ID NO: 289208 - protein, 8 aa, Influenza virus
HHSNGQGS

SEQ ID NO: 289209 - protein, 8 aa, Influenza virus
HSNGQGSG

SEQ ID NO: 289210 - protein, 8 aa, Influenza virus
SNGQGSGY

SEQ ID NO: 289211 - protein, 8 aa, Influenza virus
NGQGSGYA

SEQ ID NO: 289212 - protein, 8 aa, Influenza virus
GQGSGYAA

SEQ ID NO: 289213 - protein, 8 aa, Influenza virus
GSGYAADQ

SEQ ID NO: 289214 - protein, 8 aa, Influenza virus
SGYAADQE

SEQ ID NO: 289215 - protein, 8 aa, Influenza virus
GYAADQES

SEQ ID NO: 289216 - protein, 8 aa, Influenza virus
YAADQEST

SEQ ID NO: 289217 - protein, 8 aa, Influenza virus
AADQESTQ

SEQ ID NO: 289218 - protein, 8 aa, Influenza virus
ADKESTQR

SEQ ID NO: 289219 - protein, 8 aa, Influenza virus
DKESTQRA

SEQ ID NO: 289220 - protein, 8 aa, Influenza virus
KESTQRAI

SEQ ID NO: 289221 - protein, 8 aa, Influenza virus
ESTQRAID

SEQ ID NO: 289222 - protein, 8 aa, Influenza virus
STQRAIDG

SEQ ID NO: 289223 - protein, 8 aa, Influenza virus
TQKAIDGI

SEQ ID NO: 289224 - protein, 8 aa, Influenza virus
QKAIDGIT

SEQ ID NO: 289225 - protein, 8 aa, Influenza virus
KAIDGITN

SEQ ID NO: 289226 - protein, 8 aa, Influenza virus
AIDGITNK

SEQ ID NO: 289227 - protein, 8 aa, Influenza virus
IDGITNKV

SEQ ID NO: 289228 - protein, 8 aa, Influenza virus
DGITNKVN

SEQ ID NO: 289229 - protein, 8 aa, Influenza virus
GITNKVNS

SEQ ID NO: 289230 - protein, 8 aa, Influenza virus
ITNKVNSI

SEQ ID NO: 289231 - protein, 8 aa, Influenza virus
NKVNSIIN

SEQ ID NO: 289232 - protein, 8 aa, Influenza virus
KVNSIINK

SEQ ID NO: 289233 - protein, 8 aa, Influenza virus
VNSIINKM

SEQ ID NO: 289234 - protein, 8 aa, Influenza virus
NSIINKMN

SEQ ID NO: 289235 - protein, 8 aa, Influenza virus
SIINKMNT

SEQ ID NO: 289236 - protein, 8 aa, Influenza virus
IINKMNTQ

SEQ ID NO: 289237 - protein, 8 aa, Influenza virus
INKMNTQF

SEQ ID NO: 289238 - protein, 8 aa, Influenza virus
NKMNTQFE

SEQ ID NO: 289239 - protein, 8 aa, Influenza virus
KMNTRFEA

SEQ ID NO: 289240 - protein, 8 aa, Influenza virus
MNTQFEAI

SEQ ID NO: 289241 - protein, 8 aa, Influenza virus
NTQFEAIG

SEQ ID NO: 289242 - protein, 8 aa, Influenza virus
TQFEAVGK

SEQ ID NO: 289243 - protein, 8 aa, Influenza virus
QFEAVGKE

SEQ ID NO: 289244 - protein, 8 aa, Influenza virus
FEAVGKEF

SEQ ID NO: 289245 - protein, 8 aa, Influenza virus
EAVGKEFN

SEQ ID NO: 289246 - protein, 8 aa, Influenza virus
EFNNLEKR

SEQ ID NO: 289247 - protein, 8 aa, Influenza virus
LEKRIENL

SEQ ID NO: 289248 - protein, 8 aa, Influenza virus
EKRIENLN

SEQ ID NO: 289249 - protein, 8 aa, Influenza virus
KRIENLNK

SEQ ID NO: 289250 - protein, 8 aa, Influenza virus
RIESLNKK

SEQ ID NO: 289251 - protein, 8 aa, Influenza virus
IESLNKKM

SEQ ID NO: 289252 - protein, 8 aa, Influenza virus
ESLNKKME

SEQ ID NO: 289253 - protein, 8 aa, Influenza virus
SLNKKMED

SEQ ID NO: 289254 - protein, 8 aa, Influenza virus
LNRKMEDG

SEQ ID NO: 289255 - protein, 8 aa, Influenza virus
NRKMEDGF

SEQ ID NO: 289256 - protein, 8 aa, Influenza virus
RKMEDGFL

SEQ ID NO: 289257 - protein, 8 aa, Influenza virus
DFHDSNVR

SEQ ID NO: 289258 - protein, 8 aa, Influenza virus
FHDSNVRN

SEQ ID NO: 289259 - protein, 8 aa, Influenza virus
HDSNVRNL

SEQ ID NO: 289260 - protein, 8 aa, Influenza virus
DSNVRNLY

SEQ ID NO: 289261 - protein, 8 aa, Influenza virus
SNVKNLYE

SEQ ID NO: 289262 - protein, 8 aa, Influenza virus
NVKNLYEK

SEQ ID NO: 289263 - protein, 8 aa, Influenza virus
VKNLYEKV

SEQ ID NO: 289264 - protein, 8 aa, Influenza virus
KNLYEKVR

SEQ ID NO: 289265 - protein, 8 aa, Influenza virus
NLYEKVRL

SEQ ID NO: 289266 - protein, 8 aa, Influenza virus
LYEKVRLQ

SEQ ID NO: 289267 - protein, 8 aa, Influenza virus
YEKVRLQL

SEQ ID NO: 289268 - protein, 8 aa, Influenza virus
DKVRLQLK

SEQ ID NO: 289269 - protein, 8 aa, Influenza virus
KVRLQLKD

SEQ ID NO: 289270 - protein, 8 aa, Influenza virus
VRLQLKDN

SEQ ID NO: 289271 - protein, 8 aa, Influenza virus
RLQLKDNA

SEQ ID NO: 289272 - protein, 8 aa, Influenza virus
LQLKDNAK

SEQ ID NO: 289273 - protein, 8 aa, Influenza virus
QLKDNAKE

SEQ ID NO: 289274 - protein, 8 aa, Influenza virus
LKDNAKEL

SEQ ID NO: 289275 - protein, 8 aa, Influenza virus
KDNAKELG

SEQ ID NO: 289276 - protein, 8 aa, Influenza virus
GCFEFYHR

SEQ ID NO: 289277 - protein, 8 aa, Influenza virus
CFEFYHRC

SEQ ID NO: 289278 - protein, 8 aa, Influenza virus
FEFYHRCD

SEQ ID NO: 289279 - protein, 8 aa, Influenza virus
EFYHRCDN

SEQ ID NO: 289280 - protein, 8 aa, Influenza virus
CMESIRNG

SEQ ID NO: 289281 - protein, 8 aa, Influenza virus
MESIRNGT

SEQ ID NO: 289282 - protein, 8 aa, Influenza virus
ESIRNGTY

SEQ ID NO: 289283 - protein, 8 aa, Influenza virus
SIRNGTYN

SEQ ID NO: 289284 - protein, 8 aa, Influenza virus
IRNGTYNY

SEQ ID NO: 289285 - protein, 8 aa, Influenza virus
RNGTYNYP

SEQ ID NO: 289286 - protein, 8 aa, Influenza virus
NGTYNYPQ

SEQ ID NO: 289287 - protein, 8 aa, Influenza virus
GTYNYPQY

SEQ ID NO: 289288 - protein, 8 aa, Influenza virus
GIYQILSI

SEQ ID NO: 289289 - protein, 8 aa, Influenza virus
IYQILSIY

SEQ ID NO: 289290 - protein, 8 aa, Influenza virus
ILSIYSTA

SEQ ID NO: 289291 - protein, 8 aa, Influenza virus
LSIYSTAA

SEQ ID NO: 289292 - protein, 8 aa, Influenza virus
SIYSTAAS

SEQ ID NO: 289293 - protein, 8 aa, Influenza virus
IYSTAASS

SEQ ID NO: 289294 - protein, 8 aa, Influenza virus
YSTAASSL

SEQ ID NO: 289295 - protein, 8 aa, Influenza virus
STVASSLV

SEQ ID NO: 289296 - protein, 8 aa, Influenza virus
TVASSLVL

SEQ ID NO: 289297 - protein, 8 aa, Influenza virus
VASSLVLA

SEQ ID NO: 289298 - protein, 8 aa, Influenza virus
ASSLVLAI

SEQ ID NO: 289299 - protein, 8 aa, Influenza virus
SSLVLAIM

SEQ ID NO: 289300 - protein, 8 aa, Influenza virus
LAIMMAGL

SEQ ID NO: 289301 - protein, 8 aa, Influenza virus
AGLFLWMC

SEQ ID NO: 289302 - protein, 8 aa, Influenza virus
GLFLWMCS

SEQ ID NO: 289303 - protein, 8 aa, Influenza virus
LFLWMCSN

SEQ ID NO: 289304 - protein, 8 aa, Influenza virus
FLWMCSNG

SEQ ID NO: 289305 - protein, 8 aa, Influenza virus
FWMCSNGS

SEQ ID NO: 289306 - protein, 8 aa, Influenza virus
WMCSNGSY

SEQ ID NO: 289307 - protein, 8 aa, Influenza virus
MCFNGSLQ

SEQ ID NO: 289308 - protein, 8 aa, Influenza virus
CFNGSLQC

SEQ ID NO: 289309 - protein, 8 aa, Influenza virus
SNGSLQCK

SEQ ID NO: 289310 - protein, 8 aa, Influenza virus
NGSLQCRV

SEQ ID NO: 289311 - protein, 8 aa, Influenza virus
GSLQCRVC

SEQ ID NO: 289312 - protein, 8 aa, Influenza virus
SLQCRVCI

SEQ ID NO: 289313 - protein, 8 aa, Influenza virus
CIRFVNSD

SEQ ID NO: 289314 - protein, 8 aa, Influenza virus
KICESRLR

SEQ ID NO: 289315 - protein, 8 aa, Influenza virus
VFREQKQE

SEQ ID NO: 289316 - protein, 8 aa, Influenza virus
SGSQKQEF

SEQ ID NO: 289317 - protein, 8 aa, Influenza virus
GSQKQEFK

SEQ ID NO: 289318 - protein, 8 aa, Influenza virus
SQKQEFKM

SEQ ID NO: 289319 - protein, 8 aa, Influenza virus
QKQEIKMN

SEQ ID NO: 289320 - protein, 8 aa, Influenza virus
KQEIKMNP

SEQ ID NO: 289321 - protein, 8 aa, Influenza virus
QEIKMNPN

SEQ ID NO: 289322 - protein, 8 aa, Influenza virus
EIKMNPNQ

SEQ ID NO: 289323 - protein, 8 aa, Influenza virus
IKMNPNQK

SEQ ID NO: 289324 - protein, 8 aa, Influenza virus
KMNPNQKI

SEQ ID NO: 289325 - protein, 8 aa, Influenza virus
IEIITIGS

SEQ ID NO: 289326 - protein, 8 aa, Influenza virus
EIITIGSI

SEQ ID NO: 289327 - protein, 8 aa, Influenza virus
IITIGSIC

SEQ ID NO: 289328 - protein, 8 aa, Influenza virus
IIYENNTW

SEQ ID NO: 289329 - protein, 8 aa, Influenza virus
YKNNTWVN

SEQ ID NO: 289330 - protein, 8 aa, Influenza virus
QNSTWVSQ

SEQ ID NO: 289331 - protein, 8 aa, Influenza virus
NNTWGNQT

SEQ ID NO: 289332 - protein, 8 aa, Influenza virus
NTWVNQTF

SEQ ID NO: 289333 - protein, 8 aa, Influenza virus
TWVNQTYI

SEQ ID NO: 289334 - protein, 8 aa, Influenza virus
GNSSLCPV

SEQ ID NO: 289335 - protein, 8 aa, Influenza virus
GWAVHSKD

SEQ ID NO: 289336 - protein, 8 aa, Influenza virus
WAVHSKDN

SEQ ID NO: 289337 - protein, 8 aa, Influenza virus
HSKDNSIR

SEQ ID NO: 289338 - protein, 8 aa, Influenza virus
SKDNGIRI

SEQ ID NO: 289339 - protein, 8 aa, Influenza virus
KDNGIRIG

SEQ ID NO: 289340 - protein, 8 aa, Influenza virus
DNGIRIGS

SEQ ID NO: 289341 - protein, 8 aa, Influenza virus
NSIRIGSR

SEQ ID NO: 289342 - protein, 8 aa, Influenza virus
SIRIGSRG

SEQ ID NO: 289343 - protein, 8 aa, Influenza virus
IRIGSRGD

SEQ ID NO: 289344 - protein, 8 aa, Influenza virus
RIGSRGDV

SEQ ID NO: 289345 - protein, 8 aa, Influenza virus
IGSRGDVF

SEQ ID NO: 289346 - protein, 8 aa, Influenza virus
GSRGDVFV

SEQ ID NO: 289347 - protein, 8 aa, Influenza virus
GDVFVVRE

SEQ ID NO: 289348 - protein, 8 aa, Influenza virus
DVFVVREP

SEQ ID NO: 289349 - protein, 8 aa, Influenza virus
VFVVREPF

SEQ ID NO: 289350 - protein, 8 aa, Influenza virus
FVVREPFI

SEQ ID NO: 289351 - protein, 8 aa, Influenza virus
VVREPFIS

SEQ ID NO: 289352 - protein, 8 aa, Influenza virus
VREPFISC

SEQ ID NO: 289353 - protein, 8 aa, Influenza virus
REPFVSCS

SEQ ID NO: 289354 - protein, 8 aa, Influenza virus
EPFVSCSH

SEQ ID NO: 289355 - protein, 8 aa, Influenza virus
PFISCSHM

SEQ ID NO: 289356 - protein, 8 aa, Influenza virus
FISCSHME

SEQ ID NO: 289357 - protein, 8 aa, Influenza virus
ISCSHMEC

SEQ ID NO: 289358 - protein, 8 aa, Influenza virus
SCSHMECR

SEQ ID NO: 289359 - protein, 8 aa, Influenza virus
CSHMECRT

SEQ ID NO: 289360 - protein, 8 aa, Influenza virus
SHMECRTF

SEQ ID NO: 289361 - protein, 8 aa, Influenza virus
HMECRTFF

SEQ ID NO: 289362 - protein, 8 aa, Influenza virus
MECRTFFL

SEQ ID NO: 289363 - protein, 8 aa, Influenza virus
CRTFFLTH

SEQ ID NO: 289364 - protein, 8 aa, Influenza virus
RTFFLTHG

SEQ ID NO: 289365 - protein, 8 aa, Influenza virus
TFFLTQGS

SEQ ID NO: 289366 - protein, 8 aa, Influenza virus
FFLTQGSL

SEQ ID NO: 289367 - protein, 8 aa, Influenza virus
FLTQGSLL

SEQ ID NO: 289368 - protein, 8 aa, Influenza virus
LTQGSLLN

SEQ ID NO: 289369 - protein, 8 aa, Influenza virus
TQGSLLND

SEQ ID NO: 289370 - protein, 8 aa, Influenza virus
QGSLLNDK

SEQ ID NO: 289371 - protein, 8 aa, Influenza virus
GSLLNDKH

SEQ ID NO: 289372 - protein, 8 aa, Influenza virus
SLLNDKHS

SEQ ID NO: 289373 - protein, 8 aa, Influenza virus
LNDKHSNE

SEQ ID NO: 289374 - protein, 8 aa, Influenza virus
NDKHSNET

SEQ ID NO: 289375 - protein, 8 aa, Influenza virus
DKHSNGTI

SEQ ID NO: 289376 - protein, 8 aa, Influenza virus
KHSNGTIK

SEQ ID NO: 289377 - protein, 8 aa, Influenza virus
HSNGTIKD

SEQ ID NO: 289378 - protein, 8 aa, Influenza virus
SNGTIKDR

SEQ ID NO: 289379 - protein, 8 aa, Influenza virus
NGTIKDRS

SEQ ID NO: 289380 - protein, 8 aa, Influenza virus
GTIKDRSP

SEQ ID NO: 289381 - protein, 8 aa, Influenza virus
VKDRSPYR

SEQ ID NO: 289382 - protein, 8 aa, Influenza virus
KDRSPYRT

SEQ ID NO: 289383 - protein, 8 aa, Influenza virus
DRSPYRTL

SEQ ID NO: 289384 - protein, 8 aa, Influenza virus
RSPYRTLM

SEQ ID NO: 289385 - protein, 8 aa, Influenza virus
SPYRTLMS

SEQ ID NO: 289386 - protein, 8 aa, Influenza virus
PYRTLMSC

SEQ ID NO: 289387 - protein, 8 aa, Influenza virus
YRTLMSCP

SEQ ID NO: 289388 - protein, 8 aa, Influenza virus
RTLMSCPM

SEQ ID NO: 289389 - protein, 8 aa, Influenza virus
TLMSCPMG

SEQ ID NO: 289390 - protein, 8 aa, Influenza virus
LMSCPMGE

SEQ ID NO: 289391 - protein, 8 aa, Influenza virus
PMGEAPSP

SEQ ID NO: 289392 - protein, 8 aa, Influenza virus
MGEAPSPY

SEQ ID NO: 289393 - protein, 8 aa, Influenza virus
GEVPSPYN

SEQ ID NO: 289394 - protein, 8 aa, Influenza virus
EVPSPYNS

SEQ ID NO: 289395 - protein, 8 aa, Influenza virus
APSPYNSK

SEQ ID NO: 289396 - protein, 8 aa, Influenza virus
PSPYNSKF

SEQ ID NO: 289397 - protein, 8 aa, Influenza virus
SPYNSKFE

SEQ ID NO: 289398 - protein, 8 aa, Influenza virus
PYNSKFES

SEQ ID NO: 289399 - protein, 8 aa, Influenza virus
YNSKFESV

SEQ ID NO: 289400 - protein, 8 aa, Influenza virus
NSKFESVA

SEQ ID NO: 289401 - protein, 8 aa, Influenza virus
ASACHDGI

SEQ ID NO: 289402 - protein, 8 aa, Influenza virus
SACHDGIS

SEQ ID NO: 289403 - protein, 8 aa, Influenza virus
ACHDGISW

SEQ ID NO: 289404 - protein, 8 aa, Influenza virus
CHDGISWL

SEQ ID NO: 289405 - protein, 8 aa, Influenza virus
HDGISWLT

SEQ ID NO: 289406 - protein, 8 aa, Influenza virus
DGISWLTI

SEQ ID NO: 289407 - protein, 8 aa, Influenza virus
NWLTIGIS

SEQ ID NO: 289408 - protein, 8 aa, Influenza virus
WLTIGVSG

SEQ ID NO: 289409 - protein, 8 aa, Influenza virus
LTIGVSGP

SEQ ID NO: 289410 - protein, 8 aa, Influenza virus
TIGVSGPD

SEQ ID NO: 289411 - protein, 8 aa, Influenza virus
IGISGPDS

SEQ ID NO: 289412 - protein, 8 aa, Influenza virus
GISGPDNE

SEQ ID NO: 289413 - protein, 8 aa, Influenza virus
ISGPDNEA

SEQ ID NO: 289414 - protein, 8 aa, Influenza virus
SGPDNEAV

SEQ ID NO: 289415 - protein, 8 aa, Influenza virus
GPDNEAVA

SEQ ID NO: 289416 - protein, 8 aa, Influenza virus
PDNEAVAV

SEQ ID NO: 289417 - protein, 8 aa, Influenza virus
DNEAVAVL

SEQ ID NO: 289418 - protein, 8 aa, Influenza virus
NEAVAVLK

SEQ ID NO: 289419 - protein, 8 aa, Influenza virus
EAVAVLKY

SEQ ID NO: 289420 - protein, 8 aa, Influenza virus
AVAVVKYN

SEQ ID NO: 289421 - protein, 8 aa, Influenza virus
VAVVKYNG

SEQ ID NO: 289422 - protein, 8 aa, Influenza virus
KYNGMITD

SEQ ID NO: 289423 - protein, 8 aa, Influenza virus
YNGMITDT

SEQ ID NO: 289424 - protein, 8 aa, Influenza virus
NGMITDTI

SEQ ID NO: 289425 - protein, 8 aa, Influenza virus
GMITDTIK

SEQ ID NO: 289426 - protein, 8 aa, Influenza virus
MITDTIKS

SEQ ID NO: 289427 - protein, 8 aa, Influenza virus
ITDTIRSW

SEQ ID NO: 289428 - protein, 8 aa, Influenza virus
TDTIKSWG

SEQ ID NO: 289429 - protein, 8 aa, Influenza virus
NIMRTQES

SEQ ID NO: 289430 - protein, 8 aa, Influenza virus
IMRTQESE

SEQ ID NO: 289431 - protein, 8 aa, Influenza virus
MRTQESEC

SEQ ID NO: 289432 - protein, 8 aa, Influenza virus
QESECACI

SEQ ID NO: 289433 - protein, 8 aa, Influenza virus
ESECACIN

SEQ ID NO: 289434 - protein, 8 aa, Influenza virus
SECACING

SEQ ID NO: 289435 - protein, 8 aa, Influenza virus
GSCFTIMT

SEQ ID NO: 289436 - protein, 8 aa, Influenza virus
SCFTIMTD

SEQ ID NO: 289437 - protein, 8 aa, Influenza virus
CFTIMTDG

SEQ ID NO: 289438 - protein, 8 aa, Influenza virus
FTIMTDGP

SEQ ID NO: 289439 - protein, 8 aa, Influenza virus
TIMTDGPS

SEQ ID NO: 289440 - protein, 8 aa, Influenza virus
QASHKIFK

SEQ ID NO: 289441 - protein, 8 aa, Influenza virus
GKRGKWVK

SEQ ID NO: 289442 - protein, 8 aa, Influenza virus
APDYHYEE

SEQ ID NO: 289443 - protein, 8 aa, Influenza virus
PDYHYEEC

SEQ ID NO: 289444 - protein, 8 aa, Influenza virus
DYHYEECS

SEQ ID NO: 289445 - protein, 8 aa, Influenza virus
EECSCYPN

SEQ ID NO: 289446 - protein, 8 aa, Influenza virus
ECSCYPDS

SEQ ID NO: 289447 - protein, 8 aa, Influenza virus
CSCYPDAS

SEQ ID NO: 289448 - protein, 8 aa, Influenza virus
SCYPDASE

SEQ ID NO: 289449 - protein, 8 aa, Influenza virus
ICVCRDNW

SEQ ID NO: 289450 - protein, 8 aa, Influenza virus
HGSNRPWI

SEQ ID NO: 289451 - protein, 8 aa, Influenza virus
GSNRPWIS

SEQ ID NO: 289452 - protein, 8 aa, Influenza virus
SNRPWISF

SEQ ID NO: 289453 - protein, 8 aa, Influenza virus
NRPWISFN

SEQ ID NO: 289454 - protein, 8 aa, Influenza virus
RPWISFNQ

SEQ ID NO: 289455 - protein, 8 aa, Influenza virus
YRIGYICS

SEQ ID NO: 289456 - protein, 8 aa, Influenza virus
RIGYICSG

SEQ ID NO: 289457 - protein, 8 aa, Influenza virus
IGYICSGI

SEQ ID NO: 289458 - protein, 8 aa, Influenza virus
GYICSGIF

SEQ ID NO: 289459 - protein, 8 aa, Influenza virus
YICSGIFG

SEQ ID NO: 289460 - protein, 8 aa, Influenza virus
ICSGIFGD

SEQ ID NO: 289461 - protein, 8 aa, Influenza virus
CSGIFGDN

SEQ ID NO: 289462 - protein, 8 aa, Influenza virus
SGIFGDNP

SEQ ID NO: 289463 - protein, 8 aa, Influenza virus
GIFGDNPR

SEQ ID NO: 289464 - protein, 8 aa, Influenza virus
IFGDNPRP

SEQ ID NO: 289465 - protein, 8 aa, Influenza virus
FGDTPRPN

SEQ ID NO: 289466 - protein, 8 aa, Influenza virus
GDTPRPND

SEQ ID NO: 289467 - protein, 8 aa, Influenza virus
DTPRPNDG

SEQ ID NO: 289468 - protein, 8 aa, Influenza virus
PRPNDGAG

SEQ ID NO: 289469 - protein, 8 aa, Influenza virus
DGAGSCGP

SEQ ID NO: 289470 - protein, 8 aa, Influenza virus
GAYGIKGF

SEQ ID NO: 289471 - protein, 8 aa, Influenza virus
AYGIKGFS

SEQ ID NO: 289472 - protein, 8 aa, Influenza virus
YGIKGFSF

SEQ ID NO: 289473 - protein, 8 aa, Influenza virus
GIKGFSFK

SEQ ID NO: 289474 - protein, 8 aa, Influenza virus
IKGFSFKY

SEQ ID NO: 289475 - protein, 8 aa, Influenza virus
KGFSFRYG

SEQ ID NO: 289476 - protein, 8 aa, Influenza virus
GFSFRYGN

SEQ ID NO: 289477 - protein, 8 aa, Influenza virus
FSFRYGNG

SEQ ID NO: 289478 - protein, 8 aa, Influenza virus
FRYGNGVW

SEQ ID NO: 289479 - protein, 8 aa, Influenza virus
RYGNGVWI

SEQ ID NO: 289480 - protein, 8 aa, Influenza virus
YGDGVWIG

SEQ ID NO: 289481 - protein, 8 aa, Influenza virus
GDGVWIGR

SEQ ID NO: 289482 - protein, 8 aa, Influenza virus
DGVWIGRT

SEQ ID NO: 289483 - protein, 8 aa, Influenza virus
WIGRTKSP

SEQ ID NO: 289484 - protein, 8 aa, Influenza virus
SSRSGFEM

SEQ ID NO: 289485 - protein, 8 aa, Influenza virus
SRSGFEMV

SEQ ID NO: 289486 - protein, 8 aa, Influenza virus
RSGFEMVW

SEQ ID NO: 289487 - protein, 8 aa, Influenza virus
SGFEMVWD

SEQ ID NO: 289488 - protein, 8 aa, Influenza virus
GFEMVWDP

SEQ ID NO: 289489 - protein, 8 aa, Influenza virus
FEMVWDPN

SEQ ID NO: 289490 - protein, 8 aa, Influenza virus
EMVWDPNG

SEQ ID NO: 289491 - protein, 8 aa, Influenza virus
MVWDPNGW

SEQ ID NO: 289492 - protein, 8 aa, Influenza virus
TTDWSGYS

SEQ ID NO: 289493 - protein, 8 aa, Influenza virus
TEWSGYSG

SEQ ID NO: 289494 - protein, 8 aa, Influenza virus
SGYSGSFI

SEQ ID NO: 289495 - protein, 8 aa, Influenza virus
GYSGSFIQ

SEQ ID NO: 289496 - protein, 8 aa, Influenza virus
YSGSFIQH

SEQ ID NO: 289497 - protein, 8 aa, Influenza virus
SGSFIQHP

SEQ ID NO: 289498 - protein, 8 aa, Influenza virus
GSFIQHPE

SEQ ID NO: 289499 - protein, 8 aa, Influenza virus
SFIQHPEL

SEQ ID NO: 289500 - protein, 8 aa, Influenza virus
FIQHPELT

SEQ ID NO: 289501 - protein, 8 aa, Influenza virus
IQHPELTG

SEQ ID NO: 289502 - protein, 8 aa, Influenza virus
QHPEMTGL

SEQ ID NO: 289503 - protein, 8 aa, Influenza virus
HPELTGLN

SEQ ID NO: 289504 - protein, 8 aa, Influenza virus
PELTGLNC

SEQ ID NO: 289505 - protein, 8 aa, Influenza virus
TGLDCMRP

SEQ ID NO: 289506 - protein, 8 aa, Influenza virus
GLDCMRPC

SEQ ID NO: 289507 - protein, 8 aa, Influenza virus
LDCMRPCF

SEQ ID NO: 289508 - protein, 8 aa, Influenza virus
DCMRPCFW

SEQ ID NO: 289509 - protein, 8 aa, Influenza virus
CMRPCFWV

SEQ ID NO: 289510 - protein, 8 aa, Influenza virus
MRPCFWVE

SEQ ID NO: 289511 - protein, 8 aa, Influenza virus
KPCFWVEL

SEQ ID NO: 289512 - protein, 8 aa, Influenza virus
PCFWVELV

SEQ ID NO: 289513 - protein, 8 aa, Influenza virus
CFWVELVR

SEQ ID NO: 289514 - protein, 8 aa, Influenza virus
FWVELVRG

SEQ ID NO: 289515 - protein, 8 aa, Influenza virus
WVELIRGQ

SEQ ID NO: 289516 - protein, 8 aa, Influenza virus
VELIRGQP

SEQ ID NO: 289517 - protein, 8 aa, Influenza virus
ELIRGQPK

SEQ ID NO: 289518 - protein, 8 aa, Influenza virus
LIRGQPKE

SEQ ID NO: 289519 - protein, 8 aa, Influenza virus
TVWTSGSS

SEQ ID NO: 289520 - protein, 8 aa, Influenza virus
VWTSGSSI

SEQ ID NO: 289521 - protein, 8 aa, Influenza virus
WTSGSIIS

SEQ ID NO: 289522 - protein, 8 aa, Influenza virus
TSGSIISF

SEQ ID NO: 289523 - protein, 8 aa, Influenza virus
SGSIISFC

SEQ ID NO: 289524 - protein, 8 aa, Influenza virus
GSIISFCG

SEQ ID NO: 289525 - protein, 8 aa, Influenza virus
SIISFCGV

SEQ ID NO: 289526 - protein, 8 aa, Influenza virus
SISFCGVS

SEQ ID NO: 289527 - protein, 8 aa, Influenza virus
ISFCGVNG

SEQ ID NO: 289528 - protein, 8 aa, Influenza virus
TVGWSWPD

SEQ ID NO: 289529 - protein, 8 aa, Influenza virus
GWSWPDGA

SEQ ID NO: 289530 - protein, 8 aa, Influenza virus
WSWPDDAE

SEQ ID NO: 289531 - protein, 8 aa, Influenza virus
SWPDDAEL

SEQ ID NO: 289532 - protein, 8 aa, Influenza virus
WPDDAELP

SEQ ID NO: 289533 - protein, 8 aa, Influenza virus
PDDAELPF

SEQ ID NO: 289534 - protein, 8 aa, Influenza virus
AELPFIID

SEQ ID NO: 289535 - protein, 8 aa, Influenza virus
LPFTIDKS

SEQ ID NO: 289536 - protein, 8 aa, Influenza virus
SDQICIGY

SEQ ID NO: 289537 - protein, 8 aa, Influenza virus
DRICIGYH

SEQ ID NO: 289538 - protein, 8 aa, Influenza virus
RICIGYHA

SEQ ID NO: 289539 - protein, 8 aa, Influenza virus
ICIGHHAN

SEQ ID NO: 289540 - protein, 8 aa, Influenza virus
CIGHHANN

SEQ ID NO: 289541 - protein, 8 aa, Influenza virus
IGHHANNS

SEQ ID NO: 289542 - protein, 8 aa, Influenza virus
GYHANNSK

SEQ ID NO: 289543 - protein, 8 aa, Influenza virus
YHANNSTK

SEQ ID NO: 289544 - protein, 8 aa, Influenza virus
HANNSTKQ

SEQ ID NO: 289545 - protein, 8 aa, Influenza virus
ANNSTKQV

SEQ ID NO: 289546 - protein, 8 aa, Influenza virus
NNSTKQVD

SEQ ID NO: 289547 - protein, 8 aa, Influenza virus
NSTKQVDT

SEQ ID NO: 289548 - protein, 8 aa, Influenza virus
STKQVDTI

SEQ ID NO: 289549 - protein, 8 aa, Influenza virus
KQVDTIME

SEQ ID NO: 289550 - protein, 8 aa, Influenza virus
QIDTIMEK

SEQ ID NO: 289551 - protein, 8 aa, Influenza virus
IDTIMEKN

SEQ ID NO: 289552 - protein, 8 aa, Influenza virus
DTIMERNV

SEQ ID NO: 289553 - protein, 8 aa, Influenza virus
TIMERNVT

SEQ ID NO: 289554 - protein, 8 aa, Influenza virus
IMERNVTV

SEQ ID NO: 289555 - protein, 8 aa, Influenza virus
MERNVTVT

SEQ ID NO: 289556 - protein, 8 aa, Influenza virus
ERNVTVTH

SEQ ID NO: 289557 - protein, 8 aa, Influenza virus
RNVTVTHA

SEQ ID NO: 289558 - protein, 8 aa, Influenza virus
NVTVTHAR

SEQ ID NO: 289559 - protein, 8 aa, Influenza virus
VTVTHAQN

SEQ ID NO: 289560 - protein, 8 aa, Influenza virus
HNGRLCSL

SEQ ID NO: 289561 - protein, 8 aa, Influenza virus
DCSIAGWL

SEQ ID NO: 289562 - protein, 8 aa, Influenza virus
AGLVLGNP

SEQ ID NO: 289563 - protein, 8 aa, Influenza virus
GWLIGNPK

SEQ ID NO: 289564 - protein, 8 aa, Influenza virus
WLIGNPKC

SEQ ID NO: 289565 - protein, 8 aa, Influenza virus
APEWSYIV

SEQ ID NO: 289566 - protein, 8 aa, Influenza virus
WSYIVEKN

SEQ ID NO: 289567 - protein, 8 aa, Influenza virus
SYIVEKDS

SEQ ID NO: 289568 - protein, 8 aa, Influenza virus
YIVEKDSP

SEQ ID NO: 289569 - protein, 8 aa, Influenza virus
SSGVSAAC

SEQ ID NO: 289570 - protein, 8 aa, Influenza virus
SGVSAACP

SEQ ID NO: 289571 - protein, 8 aa, Influenza virus
YHTGRSSF

SEQ ID NO: 289572 - protein, 8 aa, Influenza virus
PSFFRNVV

SEQ ID NO: 289573 - protein, 8 aa, Influenza virus
SFYRNVVW

SEQ ID NO: 289574 - protein, 8 aa, Influenza virus
FYRNVVWL

SEQ ID NO: 289575 - protein, 8 aa, Influenza virus
FRNVVWLT

SEQ ID NO: 289576 - protein, 8 aa, Influenza virus
RNVVWLTK

SEQ ID NO: 289577 - protein, 8 aa, Influenza virus
NVVWLTKK

SEQ ID NO: 289578 - protein, 8 aa, Influenza virus
SIGTSTLN

SEQ ID NO: 289579 - protein, 8 aa, Influenza virus
GTSTLNKR

SEQ ID NO: 289580 - protein, 8 aa, Influenza virus
TSTLNQRL

SEQ ID NO: 289581 - protein, 8 aa, Influenza virus
IATRPQVN

SEQ ID NO: 289582 - protein, 8 aa, Influenza virus
ATRPQVNG

SEQ ID NO: 289583 - protein, 8 aa, Influenza virus
TRPQVNGQ

SEQ ID NO: 289584 - protein, 8 aa, Influenza virus
RPQVNGQR

SEQ ID NO: 289585 - protein, 8 aa, Influenza virus
PQVNGQRG

SEQ ID NO: 289586 - protein, 8 aa, Influenza virus
QVNGQRGR

SEQ ID NO: 289587 - protein, 8 aa, Influenza virus
VNGQRGRM

SEQ ID NO: 289588 - protein, 8 aa, Influenza virus
FESTGNFI

SEQ ID NO: 289589 - protein, 8 aa, Influenza virus
ESTGNFIA

SEQ ID NO: 289590 - protein, 8 aa, Influenza virus
STGNFIAP

SEQ ID NO: 289591 - protein, 8 aa, Influenza virus
TGNFIAPE

SEQ ID NO: 289592 - protein, 8 aa, Influenza virus
FIAPEYAF

SEQ ID NO: 289593 - protein, 8 aa, Influenza virus
IAPEYAYR

SEQ ID NO: 289594 - protein, 8 aa, Influenza virus
APEYAFKI

SEQ ID NO: 289595 - protein, 8 aa, Influenza virus
PEYAYKII

SEQ ID NO: 289596 - protein, 8 aa, Influenza virus
EYAYKIIK

SEQ ID NO: 289597 - protein, 8 aa, Influenza virus
YGNCNTKC

SEQ ID NO: 289598 - protein, 8 aa, Influenza virus
GNCNTKCQ

SEQ ID NO: 289599 - protein, 8 aa, Influenza virus
NCNTKCQT

SEQ ID NO: 289600 - protein, 8 aa, Influenza virus
CNTKCQTP

SEQ ID NO: 289601 - protein, 8 aa, Influenza virus
KCQTPMGA

SEQ ID NO: 289602 - protein, 8 aa, Influenza virus
MPFHNIHP

SEQ ID NO: 289603 - protein, 8 aa, Influenza virus
PFHNIHPL

SEQ ID NO: 289604 - protein, 8 aa, Influenza virus
FHNIHPLT

SEQ ID NO: 289605 - protein, 8 aa, Influenza virus
ERRRKKRG

SEQ ID NO: 289606 - protein, 8 aa, Influenza virus
RRRKKRGL

SEQ ID NO: 289607 - protein, 8 aa, Influenza virus
KKRGLFGA

SEQ ID NO: 289608 - protein, 8 aa, Influenza virus
KRGLFGAI

SEQ ID NO: 289609 - protein, 8 aa, Influenza virus
IEGGWQGL

SEQ ID NO: 289610 - protein, 8 aa, Influenza virus
EGGWQGMI

SEQ ID NO: 289611 - protein, 8 aa, Influenza virus
GGWQGMID

SEQ ID NO: 289612 - protein, 8 aa, Influenza virus
GWQGMIDG

SEQ ID NO: 289613 - protein, 8 aa, Influenza virus
WQGMIDGW

SEQ ID NO: 289614 - protein, 8 aa, Influenza virus
QGMIDGWY

SEQ ID NO: 289615 - protein, 8 aa, Influenza virus
GMIDGWYG

SEQ ID NO: 289616 - protein, 8 aa, Influenza virus
MIDGWYGY

SEQ ID NO: 289617 - protein, 8 aa, Influenza virus
IDGWYGYH

SEQ ID NO: 289618 - protein, 8 aa, Influenza virus
GWYGYHHI

SEQ ID NO: 289619 - protein, 8 aa, Influenza virus
WYGYHHIN

SEQ ID NO: 289620 - protein, 8 aa, Influenza virus
NGQGSGYA

SEQ ID NO: 289621 - protein, 8 aa, Influenza virus
GQGSGYAA

SEQ ID NO: 289622 - protein, 8 aa, Influenza virus
QGSGYGED

SEQ ID NO: 289623 - protein, 8 aa, Influenza virus
GSGYAADR

SEQ ID NO: 289624 - protein, 8 aa, Influenza virus
SGYAADKK

SEQ ID NO: 289625 - protein, 8 aa, Influenza virus
GYAADKKS

SEQ ID NO: 289626 - protein, 8 aa, Influenza virus
YAADKKST

SEQ ID NO: 289627 - protein, 8 aa, Influenza virus
AADKKSTQ

SEQ ID NO: 289628 - protein, 8 aa, Influenza virus
ADKKSTQK

SEQ ID NO: 289629 - protein, 8 aa, Influenza virus
DKKSTQKA

SEQ ID NO: 289630 - protein, 8 aa, Influenza virus
KKSTQKAI

SEQ ID NO: 289631 - protein, 8 aa, Influenza virus
ESTQKAIN

SEQ ID NO: 289632 - protein, 8 aa, Influenza virus
STQKAING

SEQ ID NO: 289633 - protein, 8 aa, Influenza virus
TQKAINGI

SEQ ID NO: 289634 - protein, 8 aa, Influenza virus
QKAINGIT

SEQ ID NO: 289635 - protein, 8 aa, Influenza virus
KAINGITN

SEQ ID NO: 289636 - protein, 8 aa, Influenza virus
NSIIGKMN

SEQ ID NO: 289637 - protein, 8 aa, Influenza virus
NVWTYNAE

SEQ ID NO: 289638 - protein, 8 aa, Influenza virus
VWTYNTEL

SEQ ID NO: 289639 - protein, 8 aa, Influenza virus
WTYNTELL

SEQ ID NO: 289640 - protein, 8 aa, Influenza virus
TYNAELFV

SEQ ID NO: 289641 - protein, 8 aa, Influenza virus
YNAELFVL

SEQ ID NO: 289642 - protein, 8 aa, Influenza virus
NTELLVLM

SEQ ID NO: 289643 - protein, 8 aa, Influenza virus
AELLVLIE

SEQ ID NO: 289644 - protein, 8 aa, Influenza virus
ELFVLMEN

SEQ ID NO: 289645 - protein, 8 aa, Influenza virus
LFVLMENE

SEQ ID NO: 289646 - protein, 8 aa, Influenza virus
FVLMENER

SEQ ID NO: 289647 - protein, 8 aa, Influenza virus
VLIENERT

SEQ ID NO: 289648 - protein, 8 aa, Influenza virus
LIENERTL

SEQ ID NO: 289649 - protein, 8 aa, Influenza virus
MENERTLY

SEQ ID NO: 289650 - protein, 8 aa, Influenza virus
ENERTLDL

SEQ ID NO: 289651 - protein, 8 aa, Influenza virus
NERTLDLH

SEQ ID NO: 289652 - protein, 8 aa, Influenza virus
ERTLDLHD

SEQ ID NO: 289653 - protein, 8 aa, Influenza virus
RTLDLHDS

SEQ ID NO: 289654 - protein, 8 aa, Influenza virus
TLDLHDSN

SEQ ID NO: 289655 - protein, 8 aa, Influenza virus
LDLHDSNV

SEQ ID NO: 289656 - protein, 8 aa, Influenza virus
DLHDSNVK

SEQ ID NO: 289657 - protein, 8 aa, Influenza virus
LHDSNVKN

SEQ ID NO: 289658 - protein, 8 aa, Influenza virus
HDSNVRNL

SEQ ID NO: 289659 - protein, 8 aa, Influenza virus
DSNVRNLY

SEQ ID NO: 289660 - protein, 8 aa, Influenza virus
SNVRNLYD

SEQ ID NO: 289661 - protein, 8 aa, Influenza virus
NVRNLYDK

SEQ ID NO: 289662 - protein, 8 aa, Influenza virus
VRNLYDKV

SEQ ID NO: 289663 - protein, 8 aa, Influenza virus
RNLYDKVR

SEQ ID NO: 289664 - protein, 8 aa, Influenza virus
NLYNKVRL

SEQ ID NO: 289665 - protein, 8 aa, Influenza virus
LYNKVRLQ

SEQ ID NO: 289666 - protein, 8 aa, Influenza virus
YNKVRLQL

SEQ ID NO: 289667 - protein, 8 aa, Influenza virus
VRLQLKDN

SEQ ID NO: 289668 - protein, 8 aa, Influenza virus
RLQLKDNA

SEQ ID NO: 289669 - protein, 8 aa, Influenza virus
QLKDNARE

SEQ ID NO: 289670 - protein, 8 aa, Influenza virus
DNARELGN

SEQ ID NO: 289671 - protein, 8 aa, Influenza virus
NARELGNG

SEQ ID NO: 289672 - protein, 8 aa, Influenza virus
ARELGNGC

SEQ ID NO: 289673 - protein, 8 aa, Influenza virus
RELGNGCF

SEQ ID NO: 289674 - protein, 8 aa, Influenza virus
EMGNGCFE

SEQ ID NO: 289675 - protein, 8 aa, Influenza virus
MGNGCFEF

SEQ ID NO: 289676 - protein, 8 aa, Influenza virus
GCFEFYHR

SEQ ID NO: 289677 - protein, 8 aa, Influenza virus
CFEFYHRC

SEQ ID NO: 289678 - protein, 8 aa, Influenza virus
FEFYHRCD

SEQ ID NO: 289679 - protein, 8 aa, Influenza virus
EFYHKCDD

SEQ ID NO: 289680 - protein, 8 aa, Influenza virus
ECMESVKN

SEQ ID NO: 289681 - protein, 8 aa, Influenza virus
CMESVKNG

SEQ ID NO: 289682 - protein, 8 aa, Influenza virus
MESVKNGT

SEQ ID NO: 289683 - protein, 8 aa, Influenza virus
ESVKNGTY

SEQ ID NO: 289684 - protein, 8 aa, Influenza virus
SVRNGTYN

SEQ ID NO: 289685 - protein, 8 aa, Influenza virus
VRNGTYNY

SEQ ID NO: 289686 - protein, 8 aa, Influenza virus
YQILSVYS

SEQ ID NO: 289687 - protein, 8 aa, Influenza virus
ILSIYSSV

SEQ ID NO: 289688 - protein, 8 aa, Influenza virus
LSIYSTVV

SEQ ID NO: 289689 - protein, 8 aa, Influenza virus
SIYSTVVS

SEQ ID NO: 289690 - protein, 8 aa, Influenza virus
IYSTVVSS

SEQ ID NO: 289691 - protein, 8 aa, Influenza virus
YSTVVSSL

SEQ ID NO: 289692 - protein, 8 aa, Influenza virus
VVSSLVLA

SEQ ID NO: 289693 - protein, 8 aa, Influenza virus
VSSLVLAI

SEQ ID NO: 289694 - protein, 8 aa, Influenza virus
SSLVLAIM

SEQ ID NO: 289695 - protein, 8 aa, Influenza virus
LAIMVAGL

SEQ ID NO: 289696 - protein, 8 aa, Influenza virus
AIMVAGLS

SEQ ID NO: 289697 - protein, 8 aa, Influenza virus
IMVAGLSF

SEQ ID NO: 289698 - protein, 8 aa, Influenza virus
MVAGLSFW

SEQ ID NO: 289699 - protein, 8 aa, Influenza virus
VAGLSFWM

SEQ ID NO: 289700 - protein, 8 aa, Influenza virus
AGLFFWMC

SEQ ID NO: 289701 - protein, 8 aa, Influenza virus
GLFFWMCS

SEQ ID NO: 289702 - protein, 8 aa, Influenza virus
LFFWMCSN

SEQ ID NO: 289703 - protein, 8 aa, Influenza virus
FFWMCSNG

SEQ ID NO: 289704 - protein, 8 aa, Influenza virus
FWRCSNGS

SEQ ID NO: 289705 - protein, 8 aa, Influenza virus
NGSLQCTI

SEQ ID NO: 289706 - protein, 8 aa, Influenza virus
GSLQCTIC

SEQ ID NO: 289707 - protein, 8 aa, Influenza virus
SLQCTICI

SEQ ID NO: 289708 - protein, 8 aa, Influenza virus
QRIITIGS

SEQ ID NO: 289709 - protein, 8 aa, Influenza virus
IITIGSIS

SEQ ID NO: 289710 - protein, 8 aa, Influenza virus
ITIGSISL

SEQ ID NO: 289711 - protein, 8 aa, Influenza virus
YRDWSKPQ

SEQ ID NO: 289712 - protein, 8 aa, Influenza virus
RDWSKPQC

SEQ ID NO: 289713 - protein, 8 aa, Influenza virus
WSKPQCQV

SEQ ID NO: 289714 - protein, 8 aa, Influenza virus
KPQCQVTG

SEQ ID NO: 289715 - protein, 8 aa, Influenza virus
PQCQVTGF

SEQ ID NO: 289716 - protein, 8 aa, Influenza virus
QCQVTGFA

SEQ ID NO: 289717 - protein, 8 aa, Influenza virus
CQVTGFAP

SEQ ID NO: 289718 - protein, 8 aa, Influenza virus
QVTGFAPF

SEQ ID NO: 289719 - protein, 8 aa, Influenza virus
VTGFAPFS

SEQ ID NO: 289720 - protein, 8 aa, Influenza virus
AGFAPFSK

SEQ ID NO: 289721 - protein, 8 aa, Influenza virus
FSKDNSIQ

SEQ ID NO: 289722 - protein, 8 aa, Influenza virus
SKDNSIQL

SEQ ID NO: 289723 - protein, 8 aa, Influenza virus
KDNSIQLS

SEQ ID NO: 289724 - protein, 8 aa, Influenza virus
DNSIQLSA

SEQ ID NO: 289725 - protein, 8 aa, Influenza virus
NSIQLSAG

SEQ ID NO: 289726 - protein, 8 aa, Influenza virus
SIQLSAGG

SEQ ID NO: 289727 - protein, 8 aa, Influenza virus
RLSAGGNI

SEQ ID NO: 289728 - protein, 8 aa, Influenza virus
LSAGGNIW

SEQ ID NO: 289729 - protein, 8 aa, Influenza virus
IWITREPY

SEQ ID NO: 289730 - protein, 8 aa, Influenza virus
WITREPYV

SEQ ID NO: 289731 - protein, 8 aa, Influenza virus
ITREPYVS

SEQ ID NO: 289732 - protein, 8 aa, Influenza virus
REPYVSCS

SEQ ID NO: 289733 - protein, 8 aa, Influenza virus
RCYQFALG

SEQ ID NO: 289734 - protein, 8 aa, Influenza virus
LGQGTTLN

SEQ ID NO: 289735 - protein, 8 aa, Influenza virus
GQGTTLNN

SEQ ID NO: 289736 - protein, 8 aa, Influenza virus
NNHSNGTI

SEQ ID NO: 289737 - protein, 8 aa, Influenza virus
NHSNGTIH

SEQ ID NO: 289738 - protein, 8 aa, Influenza virus
NGTIHDRT

SEQ ID NO: 289739 - protein, 8 aa, Influenza virus
PHRTLLMS

SEQ ID NO: 289740 - protein, 8 aa, Influenza virus
HRTLLMSE

SEQ ID NO: 289741 - protein, 8 aa, Influenza virus
RTLLMSEL

SEQ ID NO: 289742 - protein, 8 aa, Influenza virus
TLLMSELG

SEQ ID NO: 289743 - protein, 8 aa, Influenza virus
LLMSELGV

SEQ ID NO: 289744 - protein, 8 aa, Influenza virus
LMSELGVP

SEQ ID NO: 289745 - protein, 8 aa, Influenza virus
MSELGVPF

SEQ ID NO: 289746 - protein, 8 aa, Influenza virus
SELGVPFH

SEQ ID NO: 289747 - protein, 8 aa, Influenza virus
ELGIPFHL

SEQ ID NO: 289748 - protein, 8 aa, Influenza virus
LGIPFHLG

SEQ ID NO: 289749 - protein, 8 aa, Influenza virus
GIPFHLGT

SEQ ID NO: 289750 - protein, 8 aa, Influenza virus
VPFHLGTR

SEQ ID NO: 289751 - protein, 8 aa, Influenza virus
PFHLGTRQ

SEQ ID NO: 289752 - protein, 8 aa, Influenza virus
FHLGTRQV

SEQ ID NO: 289753 - protein, 8 aa, Influenza virus
HLGTRQVC

SEQ ID NO: 289754 - protein, 8 aa, Influenza virus
LGTRQVCI

SEQ ID NO: 289755 - protein, 8 aa, Influenza virus
GTRQVCIA

SEQ ID NO: 289756 - protein, 8 aa, Influenza virus
TRQVCIAW

SEQ ID NO: 289757 - protein, 8 aa, Influenza virus
RQVCIAWS

SEQ ID NO: 289758 - protein, 8 aa, Influenza virus
QVCMAWSS

SEQ ID NO: 289759 - protein, 8 aa, Influenza virus
VCMAWSSS

SEQ ID NO: 289760 - protein, 8 aa, Influenza virus
CMAWSSSS

SEQ ID NO: 289761 - protein, 8 aa, Influenza virus
MAWSSSSC

SEQ ID NO: 289762 - protein, 8 aa, Influenza virus
AWSSSSCY

SEQ ID NO: 289763 - protein, 8 aa, Influenza virus
WSSSSCYD

SEQ ID NO: 289764 - protein, 8 aa, Influenza virus
SRSSCHDG

SEQ ID NO: 289765 - protein, 8 aa, Influenza virus
SSSCHDGR

SEQ ID NO: 289766 - protein, 8 aa, Influenza virus
SSCHDGRA

SEQ ID NO: 289767 - protein, 8 aa, Influenza virus
SCHDGRAW

SEQ ID NO: 289768 - protein, 8 aa, Influenza virus
CHDGRAWL

SEQ ID NO: 289769 - protein, 8 aa, Influenza virus
HDGRAWLH

SEQ ID NO: 289770 - protein, 8 aa, Influenza virus
DGRAWLHV

SEQ ID NO: 289771 - protein, 8 aa, Influenza virus
GRAWLHVC

SEQ ID NO: 289772 - protein, 8 aa, Influenza virus
RAWLHVCV

SEQ ID NO: 289773 - protein, 8 aa, Influenza virus
AWLHICVT

SEQ ID NO: 289774 - protein, 8 aa, Influenza virus
WLHICVTG

SEQ ID NO: 289775 - protein, 8 aa, Influenza virus
LHICVTGD

SEQ ID NO: 289776 - protein, 8 aa, Influenza virus
HICVTGDD

SEQ ID NO: 289777 - protein, 8 aa, Influenza virus
TGDDKNAT

SEQ ID NO: 289778 - protein, 8 aa, Influenza virus
GDDKNATA

SEQ ID NO: 289779 - protein, 8 aa, Influenza virus
DDKNATAS

SEQ ID NO: 289780 - protein, 8 aa, Influenza virus
NATASFVY

SEQ ID NO: 289781 - protein, 8 aa, Influenza virus
SWSKNILR

SEQ ID NO: 289782 - protein, 8 aa, Influenza virus
WSKNILRT

SEQ ID NO: 289783 - protein, 8 aa, Influenza virus
SKNILRTQ

SEQ ID NO: 289784 - protein, 8 aa, Influenza virus
KNILRTQE

SEQ ID NO: 289785 - protein, 8 aa, Influenza virus
RTQESECI

SEQ ID NO: 289786 - protein, 8 aa, Influenza virus
TQESECIC

SEQ ID NO: 289787 - protein, 8 aa, Influenza virus
QESECVCV

SEQ ID NO: 289788 - protein, 8 aa, Influenza virus
ESECVCIS

SEQ ID NO: 289789 - protein, 8 aa, Influenza virus
CAVVMTDG

SEQ ID NO: 289790 - protein, 8 aa, Influenza virus
AVVMTDGS

SEQ ID NO: 289791 - protein, 8 aa, Influenza virus
VVMTDGNA

SEQ ID NO: 289792 - protein, 8 aa, Influenza virus
IMTDGSAS

SEQ ID NO: 289793 - protein, 8 aa, Influenza virus
MTDGSASR

SEQ ID NO: 289794 - protein, 8 aa, Influenza virus
TDGSASGK

SEQ ID NO: 289795 - protein, 8 aa, Influenza virus
DGSASGKA

SEQ ID NO: 289796 - protein, 8 aa, Influenza virus
SPLTGSAQ

SEQ ID NO: 289797 - protein, 8 aa, Influenza virus
PLTGSAQH

SEQ ID NO: 289798 - protein, 8 aa, Influenza virus
LTGSAQHI

SEQ ID NO: 289799 - protein, 8 aa, Influenza virus
TGSAQHIE

SEQ ID NO: 289800 - protein, 8 aa, Influenza virus
GSAQHVEE

SEQ ID NO: 289801 - protein, 8 aa, Influenza virus
SAQHVEEC

SEQ ID NO: 289802 - protein, 8 aa, Influenza virus
AQHVEECS

SEQ ID NO: 289803 - protein, 8 aa, Influenza virus
QHVEECSC

SEQ ID NO: 289804 - protein, 8 aa, Influenza virus
HVEECSCY

SEQ ID NO: 289805 - protein, 8 aa, Influenza virus
VEECSCYP

SEQ ID NO: 289806 - protein, 8 aa, Influenza virus
EECSCYPQ

SEQ ID NO: 289807 - protein, 8 aa, Influenza virus
SYLNVRCV

SEQ ID NO: 289808 - protein, 8 aa, Influenza virus
IRCVCRDN

SEQ ID NO: 289809 - protein, 8 aa, Influenza virus
RCICRDNW

SEQ ID NO: 289810 - protein, 8 aa, Influenza virus
CICRDNWK

SEQ ID NO: 289811 - protein, 8 aa, Influenza virus
ICRDNWKG

SEQ ID NO: 289812 - protein, 8 aa, Influenza virus
CRDNWMGS

SEQ ID NO: 289813 - protein, 8 aa, Influenza virus
RDNWMGSN

SEQ ID NO: 289814 - protein, 8 aa, Influenza virus
DNWMGSNR

SEQ ID NO: 289815 - protein, 8 aa, Influenza virus
NWMGSNRP

SEQ ID NO: 289816 - protein, 8 aa, Influenza virus
WKGSNRPI

SEQ ID NO: 289817 - protein, 8 aa, Influenza virus
SSYICSGL

SEQ ID NO: 289818 - protein, 8 aa, Influenza virus
SYICSGLV

SEQ ID NO: 289819 - protein, 8 aa, Influenza virus
YICSGLVG

SEQ ID NO: 289820 - protein, 8 aa, Influenza virus
ICSGLVGD

SEQ ID NO: 289821 - protein, 8 aa, Influenza virus
VGDTPRNN

SEQ ID NO: 289822 - protein, 8 aa, Influenza virus
GDTPRNND

SEQ ID NO: 289823 - protein, 8 aa, Influenza virus
DTPRNDDG

SEQ ID NO: 289824 - protein, 8 aa, Influenza virus
SNSNCKDP

SEQ ID NO: 289825 - protein, 8 aa, Influenza virus
NSNCKDPN

SEQ ID NO: 289826 - protein, 8 aa, Influenza virus
SNCKDPNN

SEQ ID NO: 289827 - protein, 8 aa, Influenza virus
NCKDPNNE

SEQ ID NO: 289828 - protein, 8 aa, Influenza virus
CKDPNNER

SEQ ID NO: 289829 - protein, 8 aa, Influenza virus
KDPNNERG

SEQ ID NO: 289830 - protein, 8 aa, Influenza virus
GNSGVKGW

SEQ ID NO: 289831 - protein, 8 aa, Influenza virus
NSGVKGWA

SEQ ID NO: 289832 - protein, 8 aa, Influenza virus
SGVKGWAF

SEQ ID NO: 289833 - protein, 8 aa, Influenza virus
VKGWAFDY

SEQ ID NO: 289834 - protein, 8 aa, Influenza virus
NDVWMGRT

SEQ ID NO: 289835 - protein, 8 aa, Influenza virus
DIWMGRTI

SEQ ID NO: 289836 - protein, 8 aa, Influenza virus
IWMGRTIS

SEQ ID NO: 289837 - protein, 8 aa, Influenza virus
WMGRTVSK

SEQ ID NO: 289838 - protein, 8 aa, Influenza virus
GRTISKNS

SEQ ID NO: 289839 - protein, 8 aa, Influenza virus
RTISKNSR

SEQ ID NO: 289840 - protein, 8 aa, Influenza virus
SKNSRSGY

SEQ ID NO: 289841 - protein, 8 aa, Influenza virus
KNSRSGYE

SEQ ID NO: 289842 - protein, 8 aa, Influenza virus
RSGYETFK

SEQ ID NO: 289843 - protein, 8 aa, Influenza virus
SGYETFKV

SEQ ID NO: 289844 - protein, 8 aa, Influenza virus
GYETFKVI

SEQ ID NO: 289845 - protein, 8 aa, Influenza virus
SNWSGYSG

SEQ ID NO: 289846 - protein, 8 aa, Influenza virus
NWSGYSGV

SEQ ID NO: 289847 - protein, 8 aa, Influenza virus
WSGYSGVF

SEQ ID NO: 289848 - protein, 8 aa, Influenza virus
SGYSGVFS

SEQ ID NO: 289849 - protein, 8 aa, Influenza virus
GYSGVFSV

SEQ ID NO: 289850 - protein, 8 aa, Influenza virus
YSGVFSVE

SEQ ID NO: 289851 - protein, 8 aa, Influenza virus
GCINRCFY

SEQ ID NO: 289852 - protein, 8 aa, Influenza virus
CVNRCFYV

SEQ ID NO: 289853 - protein, 8 aa, Influenza virus
VNRCFYVE

SEQ ID NO: 289854 - protein, 8 aa, Influenza virus
VEMIRGRP

SEQ ID NO: 289855 - protein, 8 aa, Influenza virus
ELIRGRPK

SEQ ID NO: 289856 - protein, 8 aa, Influenza virus
LIRGRPKE

SEQ ID NO: 289857 - protein, 8 aa, Influenza virus
RVWWTTNS

SEQ ID NO: 289858 - protein, 8 aa, Influenza virus
WWTSNSII

SEQ ID NO: 289859 - protein, 8 aa, Influenza virus
WTSNSIVA

SEQ ID NO: 289860 - protein, 8 aa, Influenza virus
TSNSIVAF

SEQ ID NO: 289861 - protein, 8 aa, Influenza virus
SNSIVAFC

SEQ ID NO: 289862 - protein, 8 aa, Influenza virus
NSIVAFCG

SEQ ID NO: 289863 - protein, 8 aa, Influenza virus
SIVAFCGT

SEQ ID NO: 289864 - protein, 8 aa, Influenza virus
IVAFCGTS

SEQ ID NO: 289865 - protein, 8 aa, Influenza virus
VAFCGTSG

SEQ ID NO: 289866 - protein, 8 aa, Influenza virus
AFCGTSGT

SEQ ID NO: 289867 - protein, 8 aa, Influenza virus
GSWPDGAD

SEQ ID NO: 289868 - protein, 8 aa, Influenza virus
SWPDGADI

SEQ ID NO: 289869 - protein, 8 aa, Influenza virus
WPDGADIN

SEQ ID NO: 289870 - protein, 8 aa, Influenza virus
PDGANINL

SEQ ID NO: 289871 - protein, 8 aa, Influenza virus
DGANINLM

SEQ ID NO: 289872 - protein, 8 aa, Influenza virus
GANINLMP

SEQ ID NO: 289873 - protein, 8 aa, Influenza virus
GRSDKICI

SEQ ID NO: 289874 - protein, 8 aa, Influenza virus
RSDKICIG

SEQ ID NO: 289875 - protein, 8 aa, Influenza virus
SDRICIGY

SEQ ID NO: 289876 - protein, 8 aa, Influenza virus
DRICIGYH

SEQ ID NO: 289877 - protein, 8 aa, Influenza virus
RICIGYHA

SEQ ID NO: 289878 - protein, 8 aa, Influenza virus
HANNSTTK

SEQ ID NO: 289879 - protein, 8 aa, Influenza virus
ANNSTTKV

SEQ ID NO: 289880 - protein, 8 aa, Influenza virus
NNSTTKVD

SEQ ID NO: 289881 - protein, 8 aa, Influenza virus
NSTTKVDT

SEQ ID NO: 289882 - protein, 8 aa, Influenza virus
STTKVDTI

SEQ ID NO: 289883 - protein, 8 aa, Influenza virus
TKVDTILE

SEQ ID NO: 289884 - protein, 8 aa, Influenza virus
VDTLLEKN

SEQ ID NO: 289885 - protein, 8 aa, Influenza virus
DTLLEKNV

SEQ ID NO: 289886 - protein, 8 aa, Influenza virus
TLLEKNVT

SEQ ID NO: 289887 - protein, 8 aa, Influenza virus
LLEKNVTV

SEQ ID NO: 289888 - protein, 8 aa, Influenza virus
LERNVTVT

SEQ ID NO: 289889 - protein, 8 aa, Influenza virus
ERNVTVTH

SEQ ID NO: 289890 - protein, 8 aa, Influenza virus
RNVTVTHS

SEQ ID NO: 289891 - protein, 8 aa, Influenza virus
NVTVTHSI

SEQ ID NO: 289892 - protein, 8 aa, Influenza virus
VTVTHSIE

SEQ ID NO: 289893 - protein, 8 aa, Influenza virus
TVTHSIEL

SEQ ID NO: 289894 - protein, 8 aa, Influenza virus
VTHSIELL

SEQ ID NO: 289895 - protein, 8 aa, Influenza virus
THSIELLE

SEQ ID NO: 289896 - protein, 8 aa, Influenza virus
HSVELLES

SEQ ID NO: 289897 - protein, 8 aa, Influenza virus
DGWILGNP

SEQ ID NO: 289898 - protein, 8 aa, Influenza virus
GWILGNPR

SEQ ID NO: 289899 - protein, 8 aa, Influenza virus
WILGNPRC

SEQ ID NO: 289900 - protein, 8 aa, Influenza virus
ILGNPRCD

SEQ ID NO: 289901 - protein, 8 aa, Influenza virus
RSWSYIVE

SEQ ID NO: 289902 - protein, 8 aa, Influenza virus
SWSYVVER

SEQ ID NO: 289903 - protein, 8 aa, Influenza virus
WSYVVERP

SEQ ID NO: 289904 - protein, 8 aa, Influenza virus
AQHGICYP

SEQ ID NO: 289905 - protein, 8 aa, Influenza virus
QHGICYPG

SEQ ID NO: 289906 - protein, 8 aa, Influenza virus
GICYPGTL

SEQ ID NO: 289907 - protein, 8 aa, Influenza virus
IQRFEMFP

SEQ ID NO: 289908 - protein, 8 aa, Influenza virus
QRFEMFPK

SEQ ID NO: 289909 - protein, 8 aa, Influenza virus
PSFYRNLL

SEQ ID NO: 289910 - protein, 8 aa, Influenza virus
SFYRNLVW

SEQ ID NO: 289911 - protein, 8 aa, Influenza virus
FYRNLVWI

SEQ ID NO: 289912 - protein, 8 aa, Influenza virus
SVLYFWGV

SEQ ID NO: 289913 - protein, 8 aa, Influenza virus
VLYFWGVH

SEQ ID NO: 289914 - protein, 8 aa, Influenza virus
LYFWGIHH

SEQ ID NO: 289915 - protein, 8 aa, Influenza virus
YFWGIHHP

SEQ ID NO: 289916 - protein, 8 aa, Influenza virus
RYVRLGTE

SEQ ID NO: 289917 - protein, 8 aa, Influenza virus
YVRMGTER

SEQ ID NO: 289918 - protein, 8 aa, Influenza virus
GQKGRIDY

SEQ ID NO: 289919 - protein, 8 aa, Influenza virus
RGRIDYFW

SEQ ID NO: 289920 - protein, 8 aa, Influenza virus
GRIDYFWS

SEQ ID NO: 289921 - protein, 8 aa, Influenza virus
RIDYFWSI

SEQ ID NO: 289922 - protein, 8 aa, Influenza virus
IDYFWSIL

SEQ ID NO: 289923 - protein, 8 aa, Influenza virus
WSILKPGE

SEQ ID NO: 289924 - protein, 8 aa, Influenza virus
SILKPGET

SEQ ID NO: 289925 - protein, 8 aa, Influenza virus
ILKPGETL

SEQ ID NO: 289926 - protein, 8 aa, Influenza virus
LRPGETLN

SEQ ID NO: 289927 - protein, 8 aa, Influenza virus
RPGETLNV

SEQ ID NO: 289928 - protein, 8 aa, Influenza virus
PGETLKVE

SEQ ID NO: 289929 - protein, 8 aa, Influenza virus
GETLKVES

SEQ ID NO: 289930 - protein, 8 aa, Influenza virus
ETLKVESN

SEQ ID NO: 289931 - protein, 8 aa, Influenza virus
TLKVESNG

SEQ ID NO: 289932 - protein, 8 aa, Influenza virus
LKVESNGN

SEQ ID NO: 289933 - protein, 8 aa, Influenza virus
KVESNGNL

SEQ ID NO: 289934 - protein, 8 aa, Influenza virus
VESNGNLV

SEQ ID NO: 289935 - protein, 8 aa, Influenza virus
ESNGNLVA

SEQ ID NO: 289936 - protein, 8 aa, Influenza virus
SNGNLVAP

SEQ ID NO: 289937 - protein, 8 aa, Influenza virus
NGNLVAPW

SEQ ID NO: 289938 - protein, 8 aa, Influenza virus
GNLVAPWY

SEQ ID NO: 289939 - protein, 8 aa, Influenza virus
NLVAPWYA

SEQ ID NO: 289940 - protein, 8 aa, Influenza virus
LVAPWYAY

SEQ ID NO: 289941 - protein, 8 aa, Influenza virus
IAPWYAYR

SEQ ID NO: 289942 - protein, 8 aa, Influenza virus
NTNKTFQN

SEQ ID NO: 289943 - protein, 8 aa, Influenza virus
TNKTFQNI

SEQ ID NO: 289944 - protein, 8 aa, Influenza virus
NKTFQNIS

SEQ ID NO: 289945 - protein, 8 aa, Influenza virus
KTFQNISP

SEQ ID NO: 289946 - protein, 8 aa, Influenza virus
TFQNISPV

SEQ ID NO: 289947 - protein, 8 aa, Influenza virus
FQNISPVW

SEQ ID NO: 289948 - protein, 8 aa, Influenza virus
QNISPVWI

SEQ ID NO: 289949 - protein, 8 aa, Influenza virus
NISPVWIG

SEQ ID NO: 289950 - protein, 8 aa, Influenza virus
WIGKCPKY

SEQ ID NO: 289951 - protein, 8 aa, Influenza virus
IGKCPKYV

SEQ ID NO: 289952 - protein, 8 aa, Influenza virus
GKCPKYVK

SEQ ID NO: 289953 - protein, 8 aa, Influenza virus
KCPKYVKS

SEQ ID NO: 289954 - protein, 8 aa, Influenza virus
SLKLATGL

SEQ ID NO: 289955 - protein, 8 aa, Influenza virus
LKLATGLR

SEQ ID NO: 289956 - protein, 8 aa, Influenza virus
KLATGLRN

SEQ ID NO: 289957 - protein, 8 aa, Influenza virus
LATGLRNI

SEQ ID NO: 289958 - protein, 8 aa, Influenza virus
ATGLRNIP

SEQ ID NO: 289959 - protein, 8 aa, Influenza virus
TGLRNIPQ

SEQ ID NO: 289960 - protein, 8 aa, Influenza virus
TRGIFGAI

SEQ ID NO: 289961 - protein, 8 aa, Influenza virus
RGIFGAIA

SEQ ID NO: 289962 - protein, 8 aa, Influenza virus
GIFGAIAG

SEQ ID NO: 289963 - protein, 8 aa, Influenza virus
IFGAIAGF

SEQ ID NO: 289964 - protein, 8 aa, Influenza virus
IEGGWTGL

SEQ ID NO: 289965 - protein, 8 aa, Influenza virus
EGGWTGMV

SEQ ID NO: 289966 - protein, 8 aa, Influenza virus
GGWTGMVD

SEQ ID NO: 289967 - protein, 8 aa, Influenza virus
GWTGMVDG

SEQ ID NO: 289968 - protein, 8 aa, Influenza virus
WTGMVDGW

SEQ ID NO: 289969 - protein, 8 aa, Influenza virus
TGMVDGWY

SEQ ID NO: 289970 - protein, 8 aa, Influenza virus
GMVDGWYG

SEQ ID NO: 289971 - protein, 8 aa, Influenza virus
MVDGWYGY

SEQ ID NO: 289972 - protein, 8 aa, Influenza virus
VDGWYGYH

SEQ ID NO: 289973 - protein, 8 aa, Influenza virus
GSGYAADR

SEQ ID NO: 289974 - protein, 8 aa, Influenza virus
SGYAADRE

SEQ ID NO: 289975 - protein, 8 aa, Influenza virus
GYAADRES

SEQ ID NO: 289976 - protein, 8 aa, Influenza virus
YAADREST

SEQ ID NO: 289977 - protein, 8 aa, Influenza virus
AADRESTQ

SEQ ID NO: 289978 - protein, 8 aa, Influenza virus
ADRESTQK

SEQ ID NO: 289979 - protein, 8 aa, Influenza virus
DRESTQKA

SEQ ID NO: 289980 - protein, 8 aa, Influenza virus
ESTQKAVN

SEQ ID NO: 289981 - protein, 8 aa, Influenza virus
ITTKVNSI

SEQ ID NO: 289982 - protein, 8 aa, Influenza virus
TTKVNSII

SEQ ID NO: 289983 - protein, 8 aa, Influenza virus
NSIINKMN

SEQ ID NO: 289984 - protein, 8 aa, Influenza virus
SIINKMNT

SEQ ID NO: 289985 - protein, 8 aa, Influenza virus
IINKMNTQ

SEQ ID NO: 289986 - protein, 8 aa, Influenza virus
INKMNTQF

SEQ ID NO: 289987 - protein, 8 aa, Influenza virus
NKMNTQFE

SEQ ID NO: 289988 - protein, 8 aa, Influenza virus
KVNTQFEA

SEQ ID NO: 289989 - protein, 8 aa, Influenza virus
VNTQFEAV

SEQ ID NO: 289990 - protein, 8 aa, Influenza virus
HEFSSLER

SEQ ID NO: 289991 - protein, 8 aa, Influenza virus
EFSSLERR

SEQ ID NO: 289992 - protein, 8 aa, Influenza virus
FSSLERRI

SEQ ID NO: 289993 - protein, 8 aa, Influenza virus
NLNKRMQD

SEQ ID NO: 289994 - protein, 8 aa, Influenza virus
LNKRMQDG

SEQ ID NO: 289995 - protein, 8 aa, Influenza virus
NKRMQDGF

SEQ ID NO: 289996 - protein, 8 aa, Influenza virus
KRMQDGFL

SEQ ID NO: 289997 - protein, 8 aa, Influenza virus
DGFLNVWT

SEQ ID NO: 289998 - protein, 8 aa, Influenza virus
GFLNVWTY

SEQ ID NO: 289999 - protein, 8 aa, Influenza virus
FLNVWTYN

SEQ ID NO: 290000 - protein, 8 aa, Influenza virus
LNVWTYNA

SEQ ID NO: 290001 - protein, 8 aa, Influenza virus
NVWTYNAE

SEQ ID NO: 290002 - protein, 8 aa, Influenza virus
TYNAELLI

SEQ ID NO: 290003 - protein, 8 aa, Influenza virus
YNAELLIL

SEQ ID NO: 290004 - protein, 8 aa, Influenza virus
NAELLILL

SEQ ID NO: 290005 - protein, 8 aa, Influenza virus
AELLILLE

SEQ ID NO: 290006 - protein, 8 aa, Influenza virus
ELLILLEN

SEQ ID NO: 290007 - protein, 8 aa, Influenza virus
LLILLENE

SEQ ID NO: 290008 - protein, 8 aa, Influenza virus
LILLENER

SEQ ID NO: 290009 - protein, 8 aa, Influenza virus
ILLENERT

SEQ ID NO: 290010 - protein, 8 aa, Influenza virus
LLENGRTL

SEQ ID NO: 290011 - protein, 8 aa, Influenza virus
LENGRTLD

SEQ ID NO: 290012 - protein, 8 aa, Influenza virus
ENERTLDM

SEQ ID NO: 290013 - protein, 8 aa, Influenza virus
NERTLDMH

SEQ ID NO: 290014 - protein, 8 aa, Influenza virus
ERTLDMHD

SEQ ID NO: 290015 - protein, 8 aa, Influenza virus
RTLDMHDA

SEQ ID NO: 290016 - protein, 8 aa, Influenza virus
TLDMHDAN

SEQ ID NO: 290017 - protein, 8 aa, Influenza virus
LDMHDANV

SEQ ID NO: 290018 - protein, 8 aa, Influenza virus
DMHDANVK

SEQ ID NO: 290019 - protein, 8 aa, Influenza virus
HDANVKSL

SEQ ID NO: 290020 - protein, 8 aa, Influenza virus
VRSQLRDN

SEQ ID NO: 290021 - protein, 8 aa, Influenza virus
RSQLRDNA

SEQ ID NO: 290022 - protein, 8 aa, Influenza virus
SQLRDNAK

SEQ ID NO: 290023 - protein, 8 aa, Influenza virus
QLRDNAKD

SEQ ID NO: 290024 - protein, 8 aa, Influenza virus
LRDNAKDL

SEQ ID NO: 290025 - protein, 8 aa, Influenza virus
RDNAKDLG

SEQ ID NO: 290026 - protein, 8 aa, Influenza virus
DNAKDLGN

SEQ ID NO: 290027 - protein, 8 aa, Influenza virus
NAKDLGNG

SEQ ID NO: 290028 - protein, 8 aa, Influenza virus
AKDLGNGC

SEQ ID NO: 290029 - protein, 8 aa, Influenza virus
KDLGNGCF

SEQ ID NO: 290030 - protein, 8 aa, Influenza virus
FEFWHKCN

SEQ ID NO: 290031 - protein, 8 aa, Influenza virus
EFWHKCDD

SEQ ID NO: 290032 - protein, 8 aa, Influenza virus
FWHKCDDE

SEQ ID NO: 290033 - protein, 8 aa, Influenza virus
WHKCDDEC

SEQ ID NO: 290034 - protein, 8 aa, Influenza virus
SVKNGTYN

SEQ ID NO: 290035 - protein, 8 aa, Influenza virus
VKNGTYNY

SEQ ID NO: 290036 - protein, 8 aa, Influenza virus
KNGTYNYP

SEQ ID NO: 290037 - protein, 8 aa, Influenza virus
NGTYNYPK

SEQ ID NO: 290038 - protein, 8 aa, Influenza virus
GTYNYPKY

SEQ ID NO: 290039 - protein, 8 aa, Influenza virus
TYNYPKYQ

SEQ ID NO: 290040 - protein, 8 aa, Influenza virus
FGVYQILA

SEQ ID NO: 290041 - protein, 8 aa, Influenza virus
DVYQILAI

SEQ ID NO: 290042 - protein, 8 aa, Influenza virus
IYQILAIY

SEQ ID NO: 290043 - protein, 8 aa, Influenza virus
ILSIYSTV

SEQ ID NO: 290044 - protein, 8 aa, Influenza virus
LAIYSTIS

SEQ ID NO: 290045 - protein, 8 aa, Influenza virus
SIYSTVSS

SEQ ID NO: 290046 - protein, 8 aa, Influenza virus
IYSTISSS

SEQ ID NO: 290047 - protein, 8 aa, Influenza virus
YSTISSSL

SEQ ID NO: 290048 - protein, 8 aa, Influenza virus
VSSSLVLA

SEQ ID NO: 290049 - protein, 8 aa, Influenza virus
SSSLVLMG

SEQ ID NO: 290050 - protein, 8 aa, Influenza virus
SSLVLMGL

SEQ ID NO: 290051 - protein, 8 aa, Influenza virus
SLVLVGLV

SEQ ID NO: 290052 - protein, 8 aa, Influenza virus
WMCSNSSM

SEQ ID NO: 290053 - protein, 8 aa, Influenza virus
MCSNSSMQ

SEQ ID NO: 290054 - protein, 8 aa, Influenza virus
CSNSSMQC

SEQ ID NO: 290055 - protein, 8 aa, Influenza virus
SNGSMQCK

SEQ ID NO: 290056 - protein, 8 aa, Influenza virus
NGSMQCKI

SEQ ID NO: 290057 - protein, 8 aa, Influenza virus
GSMQCKIC

SEQ ID NO: 290058 - protein, 8 aa, Influenza virus
SMQCKICI

SEQ ID NO: 290059 - protein, 8 aa, Influenza virus
MKSRGYKM

SEQ ID NO: 290060 - protein, 8 aa, Influenza virus
SRGYKMNN

SEQ ID NO: 290061 - protein, 8 aa, Influenza virus
RGYKMNNQ

SEQ ID NO: 290062 - protein, 8 aa, Influenza virus
GYKMNTRI

SEQ ID NO: 290063 - protein, 8 aa, Influenza virus
YKMNNQIL

SEQ ID NO: 290064 - protein, 8 aa, Influenza virus
ADKICLGH

SEQ ID NO: 290065 - protein, 8 aa, Influenza virus
NGTKVDTL

SEQ ID NO: 290066 - protein, 8 aa, Influenza virus
GTKVDTLT

SEQ ID NO: 290067 - protein, 8 aa, Influenza virus
TLTERGVE

SEQ ID NO: 290068 - protein, 8 aa, Influenza virus
LTERGVEV

SEQ ID NO: 290069 - protein, 8 aa, Influenza virus
TERGVEVV

SEQ ID NO: 290070 - protein, 8 aa, Influenza virus
ERGVEVVN

SEQ ID NO: 290071 - protein, 8 aa, Influenza virus
RGVEVVNA

SEQ ID NO: 290072 - protein, 8 aa, Influenza virus
GVEVVNAT

SEQ ID NO: 290073 - protein, 8 aa, Influenza virus
VEVVNATE

SEQ ID NO: 290074 - protein, 8 aa, Influenza virus
EVVDATET

SEQ ID NO: 290075 - protein, 8 aa, Influenza virus
VVDATETV

SEQ ID NO: 290076 - protein, 8 aa, Influenza virus
VDATETVE

SEQ ID NO: 290077 - protein, 8 aa, Influenza virus
NATETVER

SEQ ID NO: 290078 - protein, 8 aa, Influenza virus
GPPQCDLF

SEQ ID NO: 290079 - protein, 8 aa, Influenza virus
PPQCDLFL

SEQ ID NO: 290080 - protein, 8 aa, Influenza virus
PQCDLFLE

SEQ ID NO: 290081 - protein, 8 aa, Influenza virus
QCDLFLEF

SEQ ID NO: 290082 - protein, 8 aa, Influenza virus
DVCYPGRF

SEQ ID NO: 290083 - protein, 8 aa, Influenza virus
RSSFYAEM

SEQ ID NO: 290084 - protein, 8 aa, Influenza virus
PSFYAEMK

SEQ ID NO: 290085 - protein, 8 aa, Influenza virus
SFYAEMEW

SEQ ID NO: 290086 - protein, 8 aa, Influenza virus
FYAEMEWL

SEQ ID NO: 290087 - protein, 8 aa, Influenza virus
AEMEWLLS

SEQ ID NO: 290088 - protein, 8 aa, Influenza virus
EMKWLLSS

SEQ ID NO: 290089 - protein, 8 aa, Influenza virus
ALIIWGIH

SEQ ID NO: 290090 - protein, 8 aa, Influenza virus
LIIWGIHH

SEQ ID NO: 290091 - protein, 8 aa, Influenza virus
INGQSGRI

SEQ ID NO: 290092 - protein, 8 aa, Influenza virus
NGQSGRIN

SEQ ID NO: 290093 - protein, 8 aa, Influenza virus
GQFGRINF

SEQ ID NO: 290094 - protein, 8 aa, Influenza virus
QSGRIDFY

SEQ ID NO: 290095 - protein, 8 aa, Influenza virus
SGRIDFYW

SEQ ID NO: 290096 - protein, 8 aa, Influenza virus
GRIDFYWL

SEQ ID NO: 290097 - protein, 8 aa, Influenza virus
TFSFNGAF

SEQ ID NO: 290098 - protein, 8 aa, Influenza virus
FSFNGAFI

SEQ ID NO: 290099 - protein, 8 aa, Influenza virus
SFNGAFIA

SEQ ID NO: 290100 - protein, 8 aa, Influenza virus
FNGAFVAP

SEQ ID NO: 290101 - protein, 8 aa, Influenza virus
NGAFIAPN

SEQ ID NO: 290102 - protein, 8 aa, Influenza virus
GAFIAPNR

SEQ ID NO: 290103 - protein, 8 aa, Influenza virus
AFIAPDRV

SEQ ID NO: 290104 - protein, 8 aa, Influenza virus
FIAPDRVS

SEQ ID NO: 290105 - protein, 8 aa, Influenza virus
IAPDRVSF

SEQ ID NO: 290106 - protein, 8 aa, Influenza virus
LPFQNINP

SEQ ID NO: 290107 - protein, 8 aa, Influenza virus
VGRCPRYV

SEQ ID NO: 290108 - protein, 8 aa, Influenza virus
GRCPRYVK

SEQ ID NO: 290109 - protein, 8 aa, Influenza virus
RCPRYVKQ

SEQ ID NO: 290110 - protein, 8 aa, Influenza virus
SLMLATGM

SEQ ID NO: 290111 - protein, 8 aa, Influenza virus
LLLATGMK

SEQ ID NO: 290112 - protein, 8 aa, Influenza virus
LLATGMKN

SEQ ID NO: 290113 - protein, 8 aa, Influenza virus
LATGMKNV

SEQ ID NO: 290114 - protein, 8 aa, Influenza virus
ATGMKNVP

SEQ ID NO: 290115 - protein, 8 aa, Influenza virus
TGMKNVPE

SEQ ID NO: 290116 - protein, 8 aa, Influenza virus
AHKQLTHH

SEQ ID NO: 290117 - protein, 8 aa, Influenza virus
RETRGLFG

SEQ ID NO: 290118 - protein, 8 aa, Influenza virus
ETRGLFGA

SEQ ID NO: 290119 - protein, 8 aa, Influenza virus
TRGLFGAI

SEQ ID NO: 290120 - protein, 8 aa, Influenza virus
ENGWEGLV

SEQ ID NO: 290121 - protein, 8 aa, Influenza virus
NGWEGLIN

SEQ ID NO: 290122 - protein, 8 aa, Influenza virus
GWEGLING

SEQ ID NO: 290123 - protein, 8 aa, Influenza virus
WEGLINGW

SEQ ID NO: 290124 - protein, 8 aa, Influenza virus
EGLINGWY

SEQ ID NO: 290125 - protein, 8 aa, Influenza virus
GLINGWYG

SEQ ID NO: 290126 - protein, 8 aa, Influenza virus
LINGWYGF

SEQ ID NO: 290127 - protein, 8 aa, Influenza virus
INGWYGFR

SEQ ID NO: 290128 - protein, 8 aa, Influenza virus
NGWYGFRH

SEQ ID NO: 290129 - protein, 8 aa, Influenza virus
GWYGYRHQ

SEQ ID NO: 290130 - protein, 8 aa, Influenza virus
WYGYRHQN

SEQ ID NO: 290131 - protein, 8 aa, Influenza virus
YGYRHQNA

SEQ ID NO: 290132 - protein, 8 aa, Influenza virus
GYRHQNAQ

SEQ ID NO: 290133 - protein, 8 aa, Influenza virus
YRHQNAQG

SEQ ID NO: 290134 - protein, 8 aa, Influenza virus
KHQNAQGE

SEQ ID NO: 290135 - protein, 8 aa, Influenza virus
HQNSQGEG

SEQ ID NO: 290136 - protein, 8 aa, Influenza virus
QNAQGEGI

SEQ ID NO: 290137 - protein, 8 aa, Influenza virus
NAQGEGIA

SEQ ID NO: 290138 - protein, 8 aa, Influenza virus
AQGEGIAA

SEQ ID NO: 290139 - protein, 8 aa, Influenza virus
QGEGIAAD

SEQ ID NO: 290140 - protein, 8 aa, Influenza virus
GEGIAADY

SEQ ID NO: 290141 - protein, 8 aa, Influenza virus
EGIAADYK

SEQ ID NO: 290142 - protein, 8 aa, Influenza virus
GIAADYKS

SEQ ID NO: 290143 - protein, 8 aa, Influenza virus
IAADYKST

SEQ ID NO: 290144 - protein, 8 aa, Influenza virus
YKSTQSAV

SEQ ID NO: 290145 - protein, 8 aa, Influenza virus
KSTQSAIN

SEQ ID NO: 290146 - protein, 8 aa, Influenza virus
STQSAINQ

SEQ ID NO: 290147 - protein, 8 aa, Influenza virus
TQSAIDQV

SEQ ID NO: 290148 - protein, 8 aa, Influenza virus
QSAIDQVT

SEQ ID NO: 290149 - protein, 8 aa, Influenza virus
SAIDQVTG

SEQ ID NO: 290150 - protein, 8 aa, Influenza virus
AIDQVTGK

SEQ ID NO: 290151 - protein, 8 aa, Influenza virus
IDQVTGKL

SEQ ID NO: 290152 - protein, 8 aa, Influenza virus
DQVTGKLN

SEQ ID NO: 290153 - protein, 8 aa, Influenza virus
QVTGKLNR

SEQ ID NO: 290154 - protein, 8 aa, Influenza virus
VTGKLNRL

SEQ ID NO: 290155 - protein, 8 aa, Influenza virus
TGKLNRII

SEQ ID NO: 290156 - protein, 8 aa, Influenza virus
IGKTNQQF

SEQ ID NO: 290157 - protein, 8 aa, Influenza virus
KTNQQFEM

SEQ ID NO: 290158 - protein, 8 aa, Influenza virus
TNQQFEMI

SEQ ID NO: 290159 - protein, 8 aa, Influenza virus
EVEKQIGN

SEQ ID NO: 290160 - protein, 8 aa, Influenza virus
EKQIGNVI

SEQ ID NO: 290161 - protein, 8 aa, Influenza virus
KQIGNVIN

SEQ ID NO: 290162 - protein, 8 aa, Influenza virus
QLGNVINW

SEQ ID NO: 290163 - protein, 8 aa, Influenza virus
LGNVINWT

SEQ ID NO: 290164 - protein, 8 aa, Influenza virus
GNVINWTQ

SEQ ID NO: 290165 - protein, 8 aa, Influenza virus
NVINWTQD

SEQ ID NO: 290166 - protein, 8 aa, Influenza virus
VINWTRDA

SEQ ID NO: 290167 - protein, 8 aa, Influenza virus
TEIWSYNA

SEQ ID NO: 290168 - protein, 8 aa, Influenza virus
EIWSYNAE

SEQ ID NO: 290169 - protein, 8 aa, Influenza virus
WSYNAEFL

SEQ ID NO: 290170 - protein, 8 aa, Influenza virus
SYNAEFLV

SEQ ID NO: 290171 - protein, 8 aa, Influenza virus
YNAEFLVA

SEQ ID NO: 290172 - protein, 8 aa, Influenza virus
AEFLVAVE

SEQ ID NO: 290173 - protein, 8 aa, Influenza virus
EFLVAVEN

SEQ ID NO: 290174 - protein, 8 aa, Influenza virus
FLVAVENQ

SEQ ID NO: 290175 - protein, 8 aa, Influenza virus
LVAVENQH

SEQ ID NO: 290176 - protein, 8 aa, Influenza virus
VAVENQHT

SEQ ID NO: 290177 - protein, 8 aa, Influenza virus
AVENQHTI

SEQ ID NO: 290178 - protein, 8 aa, Influenza virus
VENQHTID

SEQ ID NO: 290179 - protein, 8 aa, Influenza virus
NQHTIDLT

SEQ ID NO: 290180 - protein, 8 aa, Influenza virus
QHTIDLTD

SEQ ID NO: 290181 - protein, 8 aa, Influenza virus
HTIDLTDS

SEQ ID NO: 290182 - protein, 8 aa, Influenza virus
TIDLTDSE

SEQ ID NO: 290183 - protein, 8 aa, Influenza virus
IDLTDSEM

SEQ ID NO: 290184 - protein, 8 aa, Influenza virus
DSEMSKLY

SEQ ID NO: 290185 - protein, 8 aa, Influenza virus
SEMSKLYE

SEQ ID NO: 290186 - protein, 8 aa, Influenza virus
EMSKLYER

SEQ ID NO: 290187 - protein, 8 aa, Influenza virus
MSKLYERV

SEQ ID NO: 290188 - protein, 8 aa, Influenza virus
KLYERVKK

SEQ ID NO: 290189 - protein, 8 aa, Influenza virus
VKKQLREN

SEQ ID NO: 290190 - protein, 8 aa, Influenza virus
KKQLRENA

SEQ ID NO: 290191 - protein, 8 aa, Influenza virus
RQLRENAE

SEQ ID NO: 290192 - protein, 8 aa, Influenza virus
LLRENAEE

SEQ ID NO: 290193 - protein, 8 aa, Influenza virus
ENAEEDGN

SEQ ID NO: 290194 - protein, 8 aa, Influenza virus
NAEEDGNG

SEQ ID NO: 290195 - protein, 8 aa, Influenza virus
AEEDGNGC

SEQ ID NO: 290196 - protein, 8 aa, Influenza virus
EEDGNGCF

SEQ ID NO: 290197 - protein, 8 aa, Influenza virus
EDGNGCFE

SEQ ID NO: 290198 - protein, 8 aa, Influenza virus
DGNGCFEI

SEQ ID NO: 290199 - protein, 8 aa, Influenza virus
GNGCFEIF

SEQ ID NO: 290200 - protein, 8 aa, Influenza virus
NGCFEIFH

SEQ ID NO: 290201 - protein, 8 aa, Influenza virus
GCFEIFHQ

SEQ ID NO: 290202 - protein, 8 aa, Influenza virus
CFEIFHQC

SEQ ID NO: 290203 - protein, 8 aa, Influenza virus
FEIFHQCD

SEQ ID NO: 290204 - protein, 8 aa, Influenza virus
EIFHQCDN

SEQ ID NO: 290205 - protein, 8 aa, Influenza virus
CMASIRNN

SEQ ID NO: 290206 - protein, 8 aa, Influenza virus
MASIRNNT

SEQ ID NO: 290207 - protein, 8 aa, Influenza virus
ASIRNNTY

SEQ ID NO: 290208 - protein, 8 aa, Influenza virus
SIRNNTYN

SEQ ID NO: 290209 - protein, 8 aa, Influenza virus
IRNNTYNH

SEQ ID NO: 290210 - protein, 8 aa, Influenza virus
YREEAMQN

SEQ ID NO: 290211 - protein, 8 aa, Influenza virus
REEAMQNR

SEQ ID NO: 290212 - protein, 8 aa, Influenza virus
VKLSGGYK

SEQ ID NO: 290213 - protein, 8 aa, Influenza virus
KLSSGYKE

SEQ ID NO: 290214 - protein, 8 aa, Influenza virus
SSGYKDVI

SEQ ID NO: 290215 - protein, 8 aa, Influenza virus
SGYKDVIL

SEQ ID NO: 290216 - protein, 8 aa, Influenza virus
GYKDVILW

SEQ ID NO: 290217 - protein, 8 aa, Influenza virus
YKDVILWF

SEQ ID NO: 290218 - protein, 8 aa, Influenza virus
KDVILWFS

SEQ ID NO: 290219 - protein, 8 aa, Influenza virus
DVILWFSF

SEQ ID NO: 290220 - protein, 8 aa, Influenza virus
VILWFSFG

SEQ ID NO: 290221 - protein, 8 aa, Influenza virus
SFGASCFI

SEQ ID NO: 290222 - protein, 8 aa, Influenza virus
FGASCFIL

SEQ ID NO: 290223 - protein, 8 aa, Influenza virus
GASCFILL

SEQ ID NO: 290224 - protein, 8 aa, Influenza virus
ASCFILLA

SEQ ID NO: 290225 - protein, 8 aa, Influenza virus
FICVKNGN

SEQ ID NO: 290226 - protein, 8 aa, Influenza virus
ICVKNGNM

SEQ ID NO: 290227 - protein, 8 aa, Influenza virus
CIKNGNMR

SEQ ID NO: 290228 - protein, 8 aa, Influenza virus
KNGNMQCT

SEQ ID NO: 290229 - protein, 8 aa, Influenza virus
NGNMQCTI

SEQ ID NO: 290230 - protein, 8 aa, Influenza virus
GNMQCTIC

SEQ ID NO: 290231 - protein, 8 aa, Influenza virus
NMQCTICI

SEQ ID NO: 290232 - protein, 8 aa, Influenza virus
GVKGDKIC

SEQ ID NO: 290233 - protein, 8 aa, Influenza virus
VKGDKICL

SEQ ID NO: 290234 - protein, 8 aa, Influenza virus
NADKICLG

SEQ ID NO: 290235 - protein, 8 aa, Influenza virus
ADKICLGH

SEQ ID NO: 290236 - protein, 8 aa, Influenza virus
CLGHHAVS

SEQ ID NO: 290237 - protein, 8 aa, Influenza virus
LGHHAVSN

SEQ ID NO: 290238 - protein, 8 aa, Influenza virus
GHHAVSNG

SEQ ID NO: 290239 - protein, 8 aa, Influenza virus
HHAVSNGT

SEQ ID NO: 290240 - protein, 8 aa, Influenza virus
HAVSNGTK

SEQ ID NO: 290241 - protein, 8 aa, Influenza virus
AVSNGTKV

SEQ ID NO: 290242 - protein, 8 aa, Influenza virus
VSNGTKVN

SEQ ID NO: 290243 - protein, 8 aa, Influenza virus
SNGTKVNT

SEQ ID NO: 290244 - protein, 8 aa, Influenza virus
NGTKINTL

SEQ ID NO: 290245 - protein, 8 aa, Influenza virus
GTKINTLT

SEQ ID NO: 290246 - protein, 8 aa, Influenza virus
TKINTLTE

SEQ ID NO: 290247 - protein, 8 aa, Influenza virus
KVNTLTEK

SEQ ID NO: 290248 - protein, 8 aa, Influenza virus
VNTLTEKG

SEQ ID NO: 290249 - protein, 8 aa, Influenza virus
NTLTEKGI

SEQ ID NO: 290250 - protein, 8 aa, Influenza virus
TLTEKGIE

SEQ ID NO: 290251 - protein, 8 aa, Influenza virus
LTEKGIEV

SEQ ID NO: 290252 - protein, 8 aa, Influenza virus
TEKGIEVV

SEQ ID NO: 290253 - protein, 8 aa, Influenza virus
EKGIEVVN

SEQ ID NO: 290254 - protein, 8 aa, Influenza virus
KGIEVVNA

SEQ ID NO: 290255 - protein, 8 aa, Influenza virus
GVEVVNAT

SEQ ID NO: 290256 - protein, 8 aa, Influenza virus
VEVVNATE

SEQ ID NO: 290257 - protein, 8 aa, Influenza virus
NATETVER

SEQ ID NO: 290258 - protein, 8 aa, Influenza virus
ATETVETT

SEQ ID NO: 290259 - protein, 8 aa, Influenza virus
DLGRCGLL

SEQ ID NO: 290260 - protein, 8 aa, Influenza virus
LGRCGLLG

SEQ ID NO: 290261 - protein, 8 aa, Influenza virus
GRCGLLGT

SEQ ID NO: 290262 - protein, 8 aa, Influenza virus
RCGLLGTL

SEQ ID NO: 290263 - protein, 8 aa, Influenza virus
CGLLGTLT

SEQ ID NO: 290264 - protein, 8 aa, Influenza virus
GLLGTLTG

SEQ ID NO: 290265 - protein, 8 aa, Influenza virus
LLGTLTGP

SEQ ID NO: 290266 - protein, 8 aa, Influenza virus
LGTLTGPP

SEQ ID NO: 290267 - protein, 8 aa, Influenza virus
LTGPPQCD

SEQ ID NO: 290268 - protein, 8 aa, Influenza virus
TGPPQCDQ

SEQ ID NO: 290269 - protein, 8 aa, Influenza virus
GPPQCDKF

SEQ ID NO: 290270 - protein, 8 aa, Influenza virus
PPQCDKFL

SEQ ID NO: 290271 - protein, 8 aa, Influenza virus
PQCDKFLE

SEQ ID NO: 290272 - protein, 8 aa, Influenza virus
QCDKFLEF

SEQ ID NO: 290273 - protein, 8 aa, Influenza virus
CDQFLEFY

SEQ ID NO: 290274 - protein, 8 aa, Influenza virus
ADLIIERR

SEQ ID NO: 290275 - protein, 8 aa, Influenza virus
DLIIERKE

SEQ ID NO: 290276 - protein, 8 aa, Influenza virus
LIIERKEG

SEQ ID NO: 290277 - protein, 8 aa, Influenza virus
IIERREGN

SEQ ID NO: 290278 - protein, 8 aa, Influenza virus
IERREGND

SEQ ID NO: 290279 - protein, 8 aa, Influenza virus
EGTDICYP

SEQ ID NO: 290280 - protein, 8 aa, Influenza virus
GTDICYPG

SEQ ID NO: 290281 - protein, 8 aa, Influenza virus
DVCYPGRF

SEQ ID NO: 290282 - protein, 8 aa, Influenza virus
CYPGRFTN

SEQ ID NO: 290283 - protein, 8 aa, Influenza virus
YPGRFTNE

SEQ ID NO: 290284 - protein, 8 aa, Influenza virus
PGRFTNEE

SEQ ID NO: 290285 - protein, 8 aa, Influenza virus
FVNEEALR

SEQ ID NO: 290286 - protein, 8 aa, Influenza virus
VNEEALRQ

SEQ ID NO: 290287 - protein, 8 aa, Influenza virus
NEEALRQI

SEQ ID NO: 290288 - protein, 8 aa, Influenza virus
EEALRQIL

SEQ ID NO: 290289 - protein, 8 aa, Influenza virus
EALRQILR

SEQ ID NO: 290290 - protein, 8 aa, Influenza virus
LRQILRGS

SEQ ID NO: 290291 - protein, 8 aa, Influenza virus
RQILRGSG

SEQ ID NO: 290292 - protein, 8 aa, Influenza virus
QILRGSGG

SEQ ID NO: 290293 - protein, 8 aa, Influenza virus
ILRGSGGI

SEQ ID NO: 290294 - protein, 8 aa, Influenza virus
RRSGGISK

SEQ ID NO: 290295 - protein, 8 aa, Influenza virus
RSGGISKE

SEQ ID NO: 290296 - protein, 8 aa, Influenza virus
GFTYNGIR

SEQ ID NO: 290297 - protein, 8 aa, Influenza virus
FTYNGIRT

SEQ ID NO: 290298 - protein, 8 aa, Influenza virus
TYNGIRTN

SEQ ID NO: 290299 - protein, 8 aa, Influenza virus
YNGIRTNG

SEQ ID NO: 290300 - protein, 8 aa, Influenza virus
NGIRTNGA

SEQ ID NO: 290301 - protein, 8 aa, Influenza virus
GIRTNGTT

SEQ ID NO: 290302 - protein, 8 aa, Influenza virus
IRTNGTTS

SEQ ID NO: 290303 - protein, 8 aa, Influenza virus
RLGSSFYA

SEQ ID NO: 290304 - protein, 8 aa, Influenza virus
LGSSFYAE

SEQ ID NO: 290305 - protein, 8 aa, Influenza virus
GPSFYAEM

SEQ ID NO: 290306 - protein, 8 aa, Influenza virus
EMKWLLSS

SEQ ID NO: 290307 - protein, 8 aa, Influenza virus
MKWLLSNT

SEQ ID NO: 290308 - protein, 8 aa, Influenza virus
KWLLSNTD

SEQ ID NO: 290309 - protein, 8 aa, Influenza virus
WLLSNTDN

SEQ ID NO: 290310 - protein, 8 aa, Influenza virus
ALIIWGIH

SEQ ID NO: 290311 - protein, 8 aa, Influenza virus
LIIWGIHH

SEQ ID NO: 290312 - protein, 8 aa, Influenza virus
IIWGIHHS

SEQ ID NO: 290313 - protein, 8 aa, Influenza virus
TEQTKLYG

SEQ ID NO: 290314 - protein, 8 aa, Influenza virus
EQTKLYGN

SEQ ID NO: 290315 - protein, 8 aa, Influenza virus
QTKLYGNG

SEQ ID NO: 290316 - protein, 8 aa, Influenza virus
TKLYGNGN

SEQ ID NO: 290317 - protein, 8 aa, Influenza virus
KLYGNGNK

SEQ ID NO: 290318 - protein, 8 aa, Influenza virus
LYGNGNKL

SEQ ID NO: 290319 - protein, 8 aa, Influenza virus
YGSGNKLV

SEQ ID NO: 290320 - protein, 8 aa, Influenza virus
SSKYRQSF

SEQ ID NO: 290321 - protein, 8 aa, Influenza virus
PGARPQVN

SEQ ID NO: 290322 - protein, 8 aa, Influenza virus
GARPQVNG

SEQ ID NO: 290323 - protein, 8 aa, Influenza virus
ARPQVNGQ

SEQ ID NO: 290324 - protein, 8 aa, Influenza virus
RPQVNGQS

SEQ ID NO: 290325 - protein, 8 aa, Influenza virus
PQVNGQFG

SEQ ID NO: 290326 - protein, 8 aa, Influenza virus
QVNGQFGR

SEQ ID NO: 290327 - protein, 8 aa, Influenza virus
VNGQFGRI

SEQ ID NO: 290328 - protein, 8 aa, Influenza virus
NGQFGRID

SEQ ID NO: 290329 - protein, 8 aa, Influenza virus
GQFGRIDF

SEQ ID NO: 290330 - protein, 8 aa, Influenza virus
QFGRIDFH

SEQ ID NO: 290331 - protein, 8 aa, Influenza virus
FGRIDFHW

SEQ ID NO: 290332 - protein, 8 aa, Influenza virus
RIDFHWLM

SEQ ID NO: 290333 - protein, 8 aa, Influenza virus
IDFHWLML

SEQ ID NO: 290334 - protein, 8 aa, Influenza virus
NDTVTFSF

SEQ ID NO: 290335 - protein, 8 aa, Influenza virus
DTVTFSFN

SEQ ID NO: 290336 - protein, 8 aa, Influenza virus
TVTFSFNG

SEQ ID NO: 290337 - protein, 8 aa, Influenza virus
VTFSFNGA

SEQ ID NO: 290338 - protein, 8 aa, Influenza virus
TFSFNGAF

SEQ ID NO: 290339 - protein, 8 aa, Influenza virus
FSFNGAFI

SEQ ID NO: 290340 - protein, 8 aa, Influenza virus
SFNGAFIA

SEQ ID NO: 290341 - protein, 8 aa, Influenza virus
NGAFIAPN

SEQ ID NO: 290342 - protein, 8 aa, Influenza virus
GAFIAPNR

SEQ ID NO: 290343 - protein, 8 aa, Influenza virus
AFIAPNRA

SEQ ID NO: 290344 - protein, 8 aa, Influenza virus
FIAPNRAS

SEQ ID NO: 290345 - protein, 8 aa, Influenza virus
IAPNRASF

SEQ ID NO: 290346 - protein, 8 aa, Influenza virus
APDRASFL

SEQ ID NO: 290347 - protein, 8 aa, Influenza virus
PDRASFLR

SEQ ID NO: 290348 - protein, 8 aa, Influenza virus
DRASFLRG

SEQ ID NO: 290349 - protein, 8 aa, Influenza virus
RASFLRGK

SEQ ID NO: 290350 - protein, 8 aa, Influenza virus
CFHNGGTI

SEQ ID NO: 290351 - protein, 8 aa, Influenza virus
GGTIISNL

SEQ ID NO: 290352 - protein, 8 aa, Influenza virus
GTIISNLP

SEQ ID NO: 290353 - protein, 8 aa, Influenza virus
TIISNLPF

SEQ ID NO: 290354 - protein, 8 aa, Influenza virus
IISNLPFQ

SEQ ID NO: 290355 - protein, 8 aa, Influenza virus
ISNLPFQN

SEQ ID NO: 290356 - protein, 8 aa, Influenza virus
SNLPFQNI

SEQ ID NO: 290357 - protein, 8 aa, Influenza virus
NLPFQNIN

SEQ ID NO: 290358 - protein, 8 aa, Influenza virus
LPFQNINP

SEQ ID NO: 290359 - protein, 8 aa, Influenza virus
PFQNINPR

SEQ ID NO: 290360 - protein, 8 aa, Influenza virus
FQNINPRT

SEQ ID NO: 290361 - protein, 8 aa, Influenza virus
RTVGRCPR

SEQ ID NO: 290362 - protein, 8 aa, Influenza virus
TVGRCPRY

SEQ ID NO: 290363 - protein, 8 aa, Influenza virus
VGRCPRYV

SEQ ID NO: 290364 - protein, 8 aa, Influenza virus
GRCPRYVK

SEQ ID NO: 290365 - protein, 8 aa, Influenza virus
RCPRYVKQ

SEQ ID NO: 290366 - protein, 8 aa, Influenza virus
CPRYVKQT

SEQ ID NO: 290367 - protein, 8 aa, Influenza virus
PRYVKQTS

SEQ ID NO: 290368 - protein, 8 aa, Influenza virus
VKQTSLLL

SEQ ID NO: 290369 - protein, 8 aa, Influenza virus
KQTSLLLA

SEQ ID NO: 290370 - protein, 8 aa, Influenza virus
QTSLLLAT

SEQ ID NO: 290371 - protein, 8 aa, Influenza virus
TSLLLATG

SEQ ID NO: 290372 - protein, 8 aa, Influenza virus
SLMLATGM

SEQ ID NO: 290373 - protein, 8 aa, Influenza virus
LLLATGMK

SEQ ID NO: 290374 - protein, 8 aa, Influenza virus
LLATGMKN

SEQ ID NO: 290375 - protein, 8 aa, Influenza virus
LATGMKNV

SEQ ID NO: 290376 - protein, 8 aa, Influenza virus
ATGMKNVP

SEQ ID NO: 290377 - protein, 8 aa, Influenza virus
TGMKNVPE

SEQ ID NO: 290378 - protein, 8 aa, Influenza virus
GMRNVPEN

SEQ ID NO: 290379 - protein, 8 aa, Influenza virus
MRNVPENP

SEQ ID NO: 290380 - protein, 8 aa, Influenza virus
RNVPENPK

SEQ ID NO: 290381 - protein, 8 aa, Influenza virus
PKKRGLFG

SEQ ID NO: 290382 - protein, 8 aa, Influenza virus
KKRGLFGA

SEQ ID NO: 290383 - protein, 8 aa, Influenza virus
KRGLFGAI

SEQ ID NO: 290384 - protein, 8 aa, Influenza virus
ENGWEGLV

SEQ ID NO: 290385 - protein, 8 aa, Influenza virus
NGWEGLID

SEQ ID NO: 290386 - protein, 8 aa, Influenza virus
GWEGLIDG

SEQ ID NO: 290387 - protein, 8 aa, Influenza virus
WEGLIDGW

SEQ ID NO: 290388 - protein, 8 aa, Influenza virus
EGLIDGWY

SEQ ID NO: 290389 - protein, 8 aa, Influenza virus
GLIDGWYG

SEQ ID NO: 290390 - protein, 8 aa, Influenza virus
LIDGWYGF

SEQ ID NO: 290391 - protein, 8 aa, Influenza virus
IDGWYGFR

SEQ ID NO: 290392 - protein, 8 aa, Influenza virus
DGWYGFRH

SEQ ID NO: 290393 - protein, 8 aa, Influenza virus
YGFRHQNT

SEQ ID NO: 290394 - protein, 8 aa, Influenza virus
GFRHQNTQ

SEQ ID NO: 290395 - protein, 8 aa, Influenza virus
QNTQGEGT

SEQ ID NO: 290396 - protein, 8 aa, Influenza virus
NTQGEGTA

SEQ ID NO: 290397 - protein, 8 aa, Influenza virus
TQGEGTAA

SEQ ID NO: 290398 - protein, 8 aa, Influenza virus
GKLNRLID

SEQ ID NO: 290399 - protein, 8 aa, Influenza virus
KLNRLIDK

SEQ ID NO: 290400 - protein, 8 aa, Influenza virus
LNRLIDKT

SEQ ID NO: 290401 - protein, 8 aa, Influenza virus
NRLIDKTN

SEQ ID NO: 290402 - protein, 8 aa, Influenza virus
RLIDKTNQ

SEQ ID NO: 290403 - protein, 8 aa, Influenza virus
LIDKTNQQ

SEQ ID NO: 290404 - protein, 8 aa, Influenza virus
IDKTNQQF

SEQ ID NO: 290405 - protein, 8 aa, Influenza virus
DKTNQQFE

SEQ ID NO: 290406 - protein, 8 aa, Influenza virus
RTNQQFEL

SEQ ID NO: 290407 - protein, 8 aa, Influenza virus
NQQFELIN

SEQ ID NO: 290408 - protein, 8 aa, Influenza virus
QQFELINN

SEQ ID NO: 290409 - protein, 8 aa, Influenza virus
QFELINNE

SEQ ID NO: 290410 - protein, 8 aa, Influenza virus
FELINNEF

SEQ ID NO: 290411 - protein, 8 aa, Influenza virus
ELINNEFN

SEQ ID NO: 290412 - protein, 8 aa, Influenza virus
LINNEFNE

SEQ ID NO: 290413 - protein, 8 aa, Influenza virus
NEFNEVEQ

SEQ ID NO: 290414 - protein, 8 aa, Influenza virus
EFNEVEQQ

SEQ ID NO: 290415 - protein, 8 aa, Influenza virus
FNEVEQQI

SEQ ID NO: 290416 - protein, 8 aa, Influenza virus
NEVEQQIG

SEQ ID NO: 290417 - protein, 8 aa, Influenza virus
EVEQQIGN

SEQ ID NO: 290418 - protein, 8 aa, Influenza virus
VEQQIGNV

SEQ ID NO: 290419 - protein, 8 aa, Influenza virus
EKQIGNVI

SEQ ID NO: 290420 - protein, 8 aa, Influenza virus
KQIGNVIN

SEQ ID NO: 290421 - protein, 8 aa, Influenza virus
GNVINWTQ

SEQ ID NO: 290422 - protein, 8 aa, Influenza virus
NVINWTQD

SEQ ID NO: 290423 - protein, 8 aa, Influenza virus
VINWTQDA

SEQ ID NO: 290424 - protein, 8 aa, Influenza virus
INWTQDAM

SEQ ID NO: 290425 - protein, 8 aa, Influenza virus
NWTQDAMT

SEQ ID NO: 290426 - protein, 8 aa, Influenza virus
WTQDAMTE

SEQ ID NO: 290427 - protein, 8 aa, Influenza virus
TQDAMTEV

SEQ ID NO: 290428 - protein, 8 aa, Influenza virus
QDAMTEVW

SEQ ID NO: 290429 - protein, 8 aa, Influenza virus
DAMTEVWS

SEQ ID NO: 290430 - protein, 8 aa, Influenza virus
AMTEVWSY

SEQ ID NO: 290431 - protein, 8 aa, Influenza virus
MTEVWSYN

SEQ ID NO: 290432 - protein, 8 aa, Influenza virus
TEVWSYNA

SEQ ID NO: 290433 - protein, 8 aa, Influenza virus
EVWSYNAE

SEQ ID NO: 290434 - protein, 8 aa, Influenza virus
VWSYNAEL

SEQ ID NO: 290435 - protein, 8 aa, Influenza virus
NAELLVAL

SEQ ID NO: 290436 - protein, 8 aa, Influenza virus
AELLVALE

SEQ ID NO: 290437 - protein, 8 aa, Influenza virus
ELLVALEN

SEQ ID NO: 290438 - protein, 8 aa, Influenza virus
LLVALENQ

SEQ ID NO: 290439 - protein, 8 aa, Influenza virus
LVALENQH

SEQ ID NO: 290440 - protein, 8 aa, Influenza virus
VALENQHT

SEQ ID NO: 290441 - protein, 8 aa, Influenza virus
ALENQHTI

SEQ ID NO: 290442 - protein, 8 aa, Influenza virus
LENQHTID

SEQ ID NO: 290443 - protein, 8 aa, Influenza virus
NQHTIDLT

SEQ ID NO: 290444 - protein, 8 aa, Influenza virus
QHTIDLTD

SEQ ID NO: 290445 - protein, 8 aa, Influenza virus
HTIDLTDS

SEQ ID NO: 290446 - protein, 8 aa, Influenza virus
TIDLTDSE

SEQ ID NO: 290447 - protein, 8 aa, Influenza virus
IDLTDSEM

SEQ ID NO: 290448 - protein, 8 aa, Influenza virus
DLADSEMN

SEQ ID NO: 290449 - protein, 8 aa, Influenza virus
LADSEMNK

SEQ ID NO: 290450 - protein, 8 aa, Influenza virus
ADSEMNKL

SEQ ID NO: 290451 - protein, 8 aa, Influenza virus
DSEMNKLY

SEQ ID NO: 290452 - protein, 8 aa, Influenza virus
SEMNKLYE

SEQ ID NO: 290453 - protein, 8 aa, Influenza virus
EMNKLYER

SEQ ID NO: 290454 - protein, 8 aa, Influenza virus
MNKLYERV

SEQ ID NO: 290455 - protein, 8 aa, Influenza virus
SKLYERVR

SEQ ID NO: 290456 - protein, 8 aa, Influenza virus
KLYERVRK

SEQ ID NO: 290457 - protein, 8 aa, Influenza virus
LYERVRKQ

SEQ ID NO: 290458 - protein, 8 aa, Influenza virus
YERVRKQL

SEQ ID NO: 290459 - protein, 8 aa, Influenza virus
ERVRKQLR

SEQ ID NO: 290460 - protein, 8 aa, Influenza virus
RVRKQLRE

SEQ ID NO: 290461 - protein, 8 aa, Influenza virus
VRKQLREN

SEQ ID NO: 290462 - protein, 8 aa, Influenza virus
RKQLRENA

SEQ ID NO: 290463 - protein, 8 aa, Influenza virus
RQLRENAE

SEQ ID NO: 290464 - protein, 8 aa, Influenza virus
EIFHKCDN

SEQ ID NO: 290465 - protein, 8 aa, Influenza virus
IFHKCDDH

SEQ ID NO: 290466 - protein, 8 aa, Influenza virus
FHKCDDHC

SEQ ID NO: 290467 - protein, 8 aa, Influenza virus
HKCDDHCM

SEQ ID NO: 290468 - protein, 8 aa, Influenza virus
KCDDHCME

SEQ ID NO: 290469 - protein, 8 aa, Influenza virus
CDDHCMES

SEQ ID NO: 290470 - protein, 8 aa, Influenza virus
DDHCMESI

SEQ ID NO: 290471 - protein, 8 aa, Influenza virus
DHCMESIR

SEQ ID NO: 290472 - protein, 8 aa, Influenza virus
HCMESIRN

SEQ ID NO: 290473 - protein, 8 aa, Influenza virus
CMASIRNN

SEQ ID NO: 290474 - protein, 8 aa, Influenza virus
MASIRNNT

SEQ ID NO: 290475 - protein, 8 aa, Influenza virus
ASIRNNTY

SEQ ID NO: 290476 - protein, 8 aa, Influenza virus
SIRNNTYN

SEQ ID NO: 290477 - protein, 8 aa, Influenza virus
IRNNTYNH

SEQ ID NO: 290478 - protein, 8 aa, Influenza virus
RNNTYDHS

SEQ ID NO: 290479 - protein, 8 aa, Influenza virus
NNTYDHSK

SEQ ID NO: 290480 - protein, 8 aa, Influenza virus
NTYDHSKY

SEQ ID NO: 290481 - protein, 8 aa, Influenza virus
TYDHSKYR

SEQ ID NO: 290482 - protein, 8 aa, Influenza virus
YDHSKYRE

SEQ ID NO: 290483 - protein, 8 aa, Influenza virus
HSKYREEA

SEQ ID NO: 290484 - protein, 8 aa, Influenza virus
SKYREEAM

SEQ ID NO: 290485 - protein, 8 aa, Influenza virus
KYREEAMQ

SEQ ID NO: 290486 - protein, 8 aa, Influenza virus
YREEAMQN

SEQ ID NO: 290487 - protein, 8 aa, Influenza virus
REEAMQNR

SEQ ID NO: 290488 - protein, 8 aa, Influenza virus
EEAMQNRI

SEQ ID NO: 290489 - protein, 8 aa, Influenza virus
EAMQNRIQ

SEQ ID NO: 290490 - protein, 8 aa, Influenza virus
AMQNRIQI

SEQ ID NO: 290491 - protein, 8 aa, Influenza virus
MQNRIQID

SEQ ID NO: 290492 - protein, 8 aa, Influenza virus
QNRIQIDS

SEQ ID NO: 290493 - protein, 8 aa, Influenza virus
NRIQIDSV

SEQ ID NO: 290494 - protein, 8 aa, Influenza virus
RIQIDSVK

SEQ ID NO: 290495 - protein, 8 aa, Influenza virus
IQIDSVKL

SEQ ID NO: 290496 - protein, 8 aa, Influenza virus
QIDSVKLS

SEQ ID NO: 290497 - protein, 8 aa, Influenza virus
IDSVKLSS

SEQ ID NO: 290498 - protein, 8 aa, Influenza virus
DSVKLSSG

SEQ ID NO: 290499 - protein, 8 aa, Influenza virus
SVKLSSGY

SEQ ID NO: 290500 - protein, 8 aa, Influenza virus
VKLSGGYK

SEQ ID NO: 290501 - protein, 8 aa, Influenza virus
KLSGGYKD

SEQ ID NO: 290502 - protein, 8 aa, Influenza virus
LSSGYKDV

SEQ ID NO: 290503 - protein, 8 aa, Influenza virus
SSGYKDVI

SEQ ID NO: 290504 - protein, 8 aa, Influenza virus
SGYKDVIL

SEQ ID NO: 290505 - protein, 8 aa, Influenza virus
GYKDVILW

SEQ ID NO: 290506 - protein, 8 aa, Influenza virus
YKDVILWF

SEQ ID NO: 290507 - protein, 8 aa, Influenza virus
KDVILWFS

SEQ ID NO: 290508 - protein, 8 aa, Influenza virus
DVILWFSF

SEQ ID NO: 290509 - protein, 8 aa, Influenza virus
VILWFSFG

SEQ ID NO: 290510 - protein, 8 aa, Influenza virus
SFGASCFI

SEQ ID NO: 290511 - protein, 8 aa, Influenza virus
FGASCFIL

SEQ ID NO: 290512 - protein, 8 aa, Influenza virus
GASCFILL

SEQ ID NO: 290513 - protein, 8 aa, Influenza virus
ASCFILLA

SEQ ID NO: 290514 - protein, 8 aa, Influenza virus
SCFILLAI

SEQ ID NO: 290515 - protein, 8 aa, Influenza virus
CFILLAIA

SEQ ID NO: 290516 - protein, 8 aa, Influenza virus
LLAIVMGL

SEQ ID NO: 290517 - protein, 8 aa, Influenza virus
LAIVMGLV

SEQ ID NO: 290518 - protein, 8 aa, Influenza virus
AIVMGLVF

SEQ ID NO: 290519 - protein, 8 aa, Influenza virus
IVMGLVFI

SEQ ID NO: 290520 - protein, 8 aa, Influenza virus
VMGLVFIC

SEQ ID NO: 290521 - protein, 8 aa, Influenza virus
MGLVFMCV

SEQ ID NO: 290522 - protein, 8 aa, Influenza virus
GLVFMCVK

SEQ ID NO: 290523 - protein, 8 aa, Influenza virus
LVFMCVKN

SEQ ID NO: 290524 - protein, 8 aa, Influenza virus
VFMCVKNG

SEQ ID NO: 290525 - protein, 8 aa, Influenza virus
FICVKNGN

SEQ ID NO: 290526 - protein, 8 aa, Influenza virus
ICVKNGNM

SEQ ID NO: 290527 - protein, 8 aa, Influenza virus
CIKNGNMR

SEQ ID NO: 290528 - protein, 8 aa, Influenza virus
IKNGNMRC

SEQ ID NO: 290529 - protein, 8 aa, Influenza virus
KNGNMRCT

SEQ ID NO: 290530 - protein, 8 aa, Influenza virus
NGNMRCTI

SEQ ID NO: 290531 - protein, 8 aa, Influenza virus
GNMRCTIC

SEQ ID NO: 290532 - protein, 8 aa, Influenza virus
NMRCTICI

SEQ ID NO: 290533 - protein, 8 aa, Influenza virus
KIITIGSI

SEQ ID NO: 290534 - protein, 8 aa, Influenza virus
TIGSVSLI

SEQ ID NO: 290535 - protein, 8 aa, Influenza virus
IGSVSLII

SEQ ID NO: 290536 - protein, 8 aa, Influenza virus
GSVSLTIT

SEQ ID NO: 290537 - protein, 8 aa, Influenza virus
SVSLTITT

SEQ ID NO: 290538 - protein, 8 aa, Influenza virus
AVCFLMQI

SEQ ID NO: 290539 - protein, 8 aa, Influenza virus
VCFFMQIA

SEQ ID NO: 290540 - protein, 8 aa, Influenza virus
CFLMQIAV

SEQ ID NO: 290541 - protein, 8 aa, Influenza virus
FLMQIAVL

SEQ ID NO: 290542 - protein, 8 aa, Influenza virus
EKNITEIV

SEQ ID NO: 290543 - protein, 8 aa, Influenza virus
KNITEIVY

SEQ ID NO: 290544 - protein, 8 aa, Influenza virus
NVTETLYL

SEQ ID NO: 290545 - protein, 8 aa, Influenza virus
VTETLYLN

SEQ ID NO: 290546 - protein, 8 aa, Influenza virus
TKIVYLNS

SEQ ID NO: 290547 - protein, 8 aa, Influenza virus
EIVYLNST

SEQ ID NO: 290548 - protein, 8 aa, Influenza virus
YRNWSKPQ

SEQ ID NO: 290549 - protein, 8 aa, Influenza virus
RNWSKPQC

SEQ ID NO: 290550 - protein, 8 aa, Influenza virus
NWSKPQCQ

SEQ ID NO: 290551 - protein, 8 aa, Influenza virus
SKPQCQIS

SEQ ID NO: 290552 - protein, 8 aa, Influenza virus
KPQCQISG

SEQ ID NO: 290553 - protein, 8 aa, Influenza virus
QCQISGFA

SEQ ID NO: 290554 - protein, 8 aa, Influenza virus
CQISGFAP

SEQ ID NO: 290555 - protein, 8 aa, Influenza virus
GFAPFAKD

SEQ ID NO: 290556 - protein, 8 aa, Influenza virus
FAPFAKDN

SEQ ID NO: 290557 - protein, 8 aa, Influenza virus
APFAKDNS

SEQ ID NO: 290558 - protein, 8 aa, Influenza virus
PFAKDNSI

SEQ ID NO: 290559 - protein, 8 aa, Influenza virus
FAKDNSIR

SEQ ID NO: 290560 - protein, 8 aa, Influenza virus
AKDNSIRL

SEQ ID NO: 290561 - protein, 8 aa, Influenza virus
KDNSVRLS

SEQ ID NO: 290562 - protein, 8 aa, Influenza virus
DNSVRLSA

SEQ ID NO: 290563 - protein, 8 aa, Influenza virus
NSVRLSAG

SEQ ID NO: 290564 - protein, 8 aa, Influenza virus
SVRLSASG

SEQ ID NO: 290565 - protein, 8 aa, Influenza virus
IRLSAGGH

SEQ ID NO: 290566 - protein, 8 aa, Influenza virus
RLSAGGHI

SEQ ID NO: 290567 - protein, 8 aa, Influenza virus
LSAGGHIW

SEQ ID NO: 290568 - protein, 8 aa, Influenza virus
SAGGHIWV

SEQ ID NO: 290569 - protein, 8 aa, Influenza virus
AGGHIWVT

SEQ ID NO: 290570 - protein, 8 aa, Influenza virus
GGHIWVTR

SEQ ID NO: 290571 - protein, 8 aa, Influenza virus
GHIWVTRE

SEQ ID NO: 290572 - protein, 8 aa, Influenza virus
HIWVTREP

SEQ ID NO: 290573 - protein, 8 aa, Influenza virus
IWVTREPY

SEQ ID NO: 290574 - protein, 8 aa, Influenza virus
WVTREPYV

SEQ ID NO: 290575 - protein, 8 aa, Influenza virus
VTREPYVS

SEQ ID NO: 290576 - protein, 8 aa, Influenza virus
REPYVSCS

SEQ ID NO: 290577 - protein, 8 aa, Influenza virus
EPYVSCGP

SEQ ID NO: 290578 - protein, 8 aa, Influenza virus
NKCYQFAL

SEQ ID NO: 290579 - protein, 8 aa, Influenza virus
RCYQFALG

SEQ ID NO: 290580 - protein, 8 aa, Influenza virus
LGQGTTLY

SEQ ID NO: 290581 - protein, 8 aa, Influenza virus
GQGTTLYN

SEQ ID NO: 290582 - protein, 8 aa, Influenza virus
QGTTLDNE

SEQ ID NO: 290583 - protein, 8 aa, Influenza virus
GTTLDNEH

SEQ ID NO: 290584 - protein, 8 aa, Influenza virus
TTLDNEHS

SEQ ID NO: 290585 - protein, 8 aa, Influenza virus
TLDNEHSN

SEQ ID NO: 290586 - protein, 8 aa, Influenza virus
LDNEHSNG

SEQ ID NO: 290587 - protein, 8 aa, Influenza virus
DNEHSNGT

SEQ ID NO: 290588 - protein, 8 aa, Influenza virus
NEHSNGTI

SEQ ID NO: 290589 - protein, 8 aa, Influenza virus
EHSNGTIH

SEQ ID NO: 290590 - protein, 8 aa, Influenza virus
HSNGTTHD

SEQ ID NO: 290591 - protein, 8 aa, Influenza virus
SNGTTHDR

SEQ ID NO: 290592 - protein, 8 aa, Influenza virus
NGTIHDRT

SEQ ID NO: 290593 - protein, 8 aa, Influenza virus
HDRTPHRT

SEQ ID NO: 290594 - protein, 8 aa, Influenza virus
DRTPHRTL

SEQ ID NO: 290595 - protein, 8 aa, Influenza virus
RTPHRTLL

SEQ ID NO: 290596 - protein, 8 aa, Influenza virus
TPHRTLLM

SEQ ID NO: 290597 - protein, 8 aa, Influenza virus
SHRTLLMN

SEQ ID NO: 290598 - protein, 8 aa, Influenza virus
VPFHLGTR

SEQ ID NO: 290599 - protein, 8 aa, Influenza virus
PFHLGTRQ

SEQ ID NO: 290600 - protein, 8 aa, Influenza virus
FHLGTRQV

SEQ ID NO: 290601 - protein, 8 aa, Influenza virus
HLGTRQVC

SEQ ID NO: 290602 - protein, 8 aa, Influenza virus
LGTRQVCI

SEQ ID NO: 290603 - protein, 8 aa, Influenza virus
GTRQVCIA

SEQ ID NO: 290604 - protein, 8 aa, Influenza virus
TRQVCIAW

SEQ ID NO: 290605 - protein, 8 aa, Influenza virus
RQVCIAWS

SEQ ID NO: 290606 - protein, 8 aa, Influenza virus
VCMAWSSS

SEQ ID NO: 290607 - protein, 8 aa, Influenza virus
CMAWSSSS

SEQ ID NO: 290608 - protein, 8 aa, Influenza virus
MAWSSSSC

SEQ ID NO: 290609 - protein, 8 aa, Influenza virus
DGKAWLHI

SEQ ID NO: 290610 - protein, 8 aa, Influenza virus
GKAWLHIC

SEQ ID NO: 290611 - protein, 8 aa, Influenza virus
KAWLHVCI

SEQ ID NO: 290612 - protein, 8 aa, Influenza virus
AWLHICVT

SEQ ID NO: 290613 - protein, 8 aa, Influenza virus
WLHVCITG

SEQ ID NO: 290614 - protein, 8 aa, Influenza virus
LHICVTGD

SEQ ID NO: 290615 - protein, 8 aa, Influenza virus
HVCITGDD

SEQ ID NO: 290616 - protein, 8 aa, Influenza virus
ICVTGDDR

SEQ ID NO: 290617 - protein, 8 aa, Influenza virus
CITGDDRN

SEQ ID NO: 290618 - protein, 8 aa, Influenza virus
ITGDDRNA

SEQ ID NO: 290619 - protein, 8 aa, Influenza virus
TGDDKNAT

SEQ ID NO: 290620 - protein, 8 aa, Influenza virus
GDDKNATA

SEQ ID NO: 290621 - protein, 8 aa, Influenza virus
DDKNATAS

SEQ ID NO: 290622 - protein, 8 aa, Influenza virus
DKNATASF

SEQ ID NO: 290623 - protein, 8 aa, Influenza virus
KNATASFI

SEQ ID NO: 290624 - protein, 8 aa, Influenza virus
ATASFIYD

SEQ ID NO: 290625 - protein, 8 aa, Influenza virus
TASFIYDG

SEQ ID NO: 290626 - protein, 8 aa, Influenza virus
LVDSIVSW

SEQ ID NO: 290627 - protein, 8 aa, Influenza virus
VDSIVSWS

SEQ ID NO: 290628 - protein, 8 aa, Influenza virus
DSIVSWSQ

SEQ ID NO: 290629 - protein, 8 aa, Influenza virus
SIVSWSQN

SEQ ID NO: 290630 - protein, 8 aa, Influenza virus
IVSWSQNI

SEQ ID NO: 290631 - protein, 8 aa, Influenza virus
VSWSQNIL

SEQ ID NO: 290632 - protein, 8 aa, Influenza virus
ECVCINGT

SEQ ID NO: 290633 - protein, 8 aa, Influenza virus
CVCINGTC

SEQ ID NO: 290634 - protein, 8 aa, Influenza virus
VCINGTCT

SEQ ID NO: 290635 - protein, 8 aa, Influenza virus
CINGTCTV

SEQ ID NO: 290636 - protein, 8 aa, Influenza virus
INGTCTVV

SEQ ID NO: 290637 - protein, 8 aa, Influenza virus
NGTCTVVM

SEQ ID NO: 290638 - protein, 8 aa, Influenza virus
GTCTVVMT

SEQ ID NO: 290639 - protein, 8 aa, Influenza virus
TCTVVMTD

SEQ ID NO: 290640 - protein, 8 aa, Influenza virus
CAVVMTDG

SEQ ID NO: 290641 - protein, 8 aa, Influenza virus
TVVMTDGN

SEQ ID NO: 290642 - protein, 8 aa, Influenza virus
VVMTDGNA

SEQ ID NO: 290643 - protein, 8 aa, Influenza virus
VMTDGNAS

SEQ ID NO: 290644 - protein, 8 aa, Influenza virus
MTDGNASG

SEQ ID NO: 290645 - protein, 8 aa, Influenza virus
TDGNASGK

SEQ ID NO: 290646 - protein, 8 aa, Influenza virus
DGNASGKA

SEQ ID NO: 290647 - protein, 8 aa, Influenza virus
GNASGKAD

SEQ ID NO: 290648 - protein, 8 aa, Influenza virus
NASGKADT

SEQ ID NO: 290649 - protein, 8 aa, Influenza virus
ASGKAETR

SEQ ID NO: 290650 - protein, 8 aa, Influenza virus
SGKAETRI

SEQ ID NO: 290651 - protein, 8 aa, Influenza virus
ADTRILFI

SEQ ID NO: 290652 - protein, 8 aa, Influenza virus
ILFIKEGK

SEQ ID NO: 290653 - protein, 8 aa, Influenza virus
LFIKEGKI

SEQ ID NO: 290654 - protein, 8 aa, Influenza virus
EGKIIHIS

SEQ ID NO: 290655 - protein, 8 aa, Influenza virus
GKIIHISP

SEQ ID NO: 290656 - protein, 8 aa, Influenza virus
KIIHISPL

SEQ ID NO: 290657 - protein, 8 aa, Influenza virus
IIHISPLS

SEQ ID NO: 290658 - protein, 8 aa, Influenza virus
IHISPLSG

SEQ ID NO: 290659 - protein, 8 aa, Influenza virus
EECSCYPQ

SEQ ID NO: 290660 - protein, 8 aa, Influenza virus
ECSCYPQY

SEQ ID NO: 290661 - protein, 8 aa, Influenza virus
CSCYPQYP

SEQ ID NO: 290662 - protein, 8 aa, Influenza virus
SCYPQYPN

SEQ ID NO: 290663 - protein, 8 aa, Influenza virus
CYPQYPNV

SEQ ID NO: 290664 - protein, 8 aa, Influenza virus
YPQYPNVR

SEQ ID NO: 290665 - protein, 8 aa, Influenza virus
PQYPNVRC

SEQ ID NO: 290666 - protein, 8 aa, Influenza virus
QYPNVRCV

SEQ ID NO: 290667 - protein, 8 aa, Influenza virus
YPDVRCVC

SEQ ID NO: 290668 - protein, 8 aa, Influenza virus
PDVRCVCR

SEQ ID NO: 290669 - protein, 8 aa, Influenza virus
DVRCVCRD

SEQ ID NO: 290670 - protein, 8 aa, Influenza virus
WKGSNRPI

SEQ ID NO: 290671 - protein, 8 aa, Influenza virus
KGSNRPII

SEQ ID NO: 290672 - protein, 8 aa, Influenza virus
GSNRPIID

SEQ ID NO: 290673 - protein, 8 aa, Influenza virus
SNRPVIDV

SEQ ID NO: 290674 - protein, 8 aa, Influenza virus
NRPVIDVN

SEQ ID NO: 290675 - protein, 8 aa, Influenza virus
RPVIDVNM

SEQ ID NO: 290676 - protein, 8 aa, Influenza virus
DYNIDSSY

SEQ ID NO: 290677 - protein, 8 aa, Influenza virus
INSSYVCS

SEQ ID NO: 290678 - protein, 8 aa, Influenza virus
NSSYVCSG

SEQ ID NO: 290679 - protein, 8 aa, Influenza virus
SSYMCSGL

SEQ ID NO: 290680 - protein, 8 aa, Influenza virus
SYLCSGLV

SEQ ID NO: 290681 - protein, 8 aa, Influenza virus
VGDTPRND

SEQ ID NO: 290682 - protein, 8 aa, Influenza virus
GDTPRNDD

SEQ ID NO: 290683 - protein, 8 aa, Influenza virus
DTPRNEDG

SEQ ID NO: 290684 - protein, 8 aa, Influenza virus
TPRNEDSS

SEQ ID NO: 290685 - protein, 8 aa, Influenza virus
PRNEDSSS

SEQ ID NO: 290686 - protein, 8 aa, Influenza virus
RNEDSSSS

SEQ ID NO: 290687 - protein, 8 aa, Influenza virus
NEDSSSSS

SEQ ID NO: 290688 - protein, 8 aa, Influenza virus
EDSSSSSN

SEQ ID NO: 290689 - protein, 8 aa, Influenza virus
DGSSSSNC

SEQ ID NO: 290690 - protein, 8 aa, Influenza virus
SSSNCKDP

SEQ ID NO: 290691 - protein, 8 aa, Influenza virus
SSNCKDPN

SEQ ID NO: 290692 - protein, 8 aa, Influenza virus
SNCRDPNN

SEQ ID NO: 290693 - protein, 8 aa, Influenza virus
NCRDPNNE

SEQ ID NO: 290694 - protein, 8 aa, Influenza virus
DPNDERGN

SEQ ID NO: 290695 - protein, 8 aa, Influenza virus
PNDERGNP

SEQ ID NO: 290696 - protein, 8 aa, Influenza virus
NDERGNPG

SEQ ID NO: 290697 - protein, 8 aa, Influenza virus
DERGNPGV

SEQ ID NO: 290698 - protein, 8 aa, Influenza virus
EKGNPGVK

SEQ ID NO: 290699 - protein, 8 aa, Influenza virus
KGNPGVKG

SEQ ID NO: 290700 - protein, 8 aa, Influenza virus
GSPGVKGW

SEQ ID NO: 290701 - protein, 8 aa, Influenza virus
SPGVKGWA

SEQ ID NO: 290702 - protein, 8 aa, Influenza virus
VKGWAFDN

SEQ ID NO: 290703 - protein, 8 aa, Influenza virus
KGWAFDNG

SEQ ID NO: 290704 - protein, 8 aa, Influenza virus
GWAFDNGD

SEQ ID NO: 290705 - protein, 8 aa, Influenza virus
WAFDNGDD

SEQ ID NO: 290706 - protein, 8 aa, Influenza virus
NGDDVWMG

SEQ ID NO: 290707 - protein, 8 aa, Influenza virus
GNDVWMGR

SEQ ID NO: 290708 - protein, 8 aa, Influenza virus
NDVWMGRT

SEQ ID NO: 290709 - protein, 8 aa, Influenza virus
WMGRTISK

SEQ ID NO: 290710 - protein, 8 aa, Influenza virus
MGRTISKD

SEQ ID NO: 290711 - protein, 8 aa, Influenza virus
GRTISKDS

SEQ ID NO: 290712 - protein, 8 aa, Influenza virus
RTISKDSR

SEQ ID NO: 290713 - protein, 8 aa, Influenza virus
TISKDSRS

SEQ ID NO: 290714 - protein, 8 aa, Influenza virus
ISKDSRSG

SEQ ID NO: 290715 - protein, 8 aa, Influenza virus
SKDSRSGY

SEQ ID NO: 290716 - protein, 8 aa, Influenza virus
KDSRSGYE

SEQ ID NO: 290717 - protein, 8 aa, Influenza virus
RSGYETFK

SEQ ID NO: 290718 - protein, 8 aa, Influenza virus
SGYETFKV

SEQ ID NO: 290719 - protein, 8 aa, Influenza virus
GYETFKVI

SEQ ID NO: 290720 - protein, 8 aa, Influenza virus
YETFRVIS

SEQ ID NO: 290721 - protein, 8 aa, Influenza virus
ETFRVISG

SEQ ID NO: 290722 - protein, 8 aa, Influenza virus
TFRVISGW

SEQ ID NO: 290723 - protein, 8 aa, Influenza virus
FRVIGGWA

SEQ ID NO: 290724 - protein, 8 aa, Influenza virus
VIGGWATA

SEQ ID NO: 290725 - protein, 8 aa, Influenza virus
IGGWATAN

SEQ ID NO: 290726 - protein, 8 aa, Influenza virus
GGWATANS

SEQ ID NO: 290727 - protein, 8 aa, Influenza virus
GWATANSK

SEQ ID NO: 290728 - protein, 8 aa, Influenza virus
WATANSKS

SEQ ID NO: 290729 - protein, 8 aa, Influenza virus
ATANSKSQ

SEQ ID NO: 290730 - protein, 8 aa, Influenza virus
IANSKSQT

SEQ ID NO: 290731 - protein, 8 aa, Influenza virus
RQVIVDNS

SEQ ID NO: 290732 - protein, 8 aa, Influenza virus
QVIVDNSN

SEQ ID NO: 290733 - protein, 8 aa, Influenza virus
VIVDNSNW

SEQ ID NO: 290734 - protein, 8 aa, Influenza virus
IVDNNNWF

SEQ ID NO: 290735 - protein, 8 aa, Influenza virus
VDNNNWFG

SEQ ID NO: 290736 - protein, 8 aa, Influenza virus
DNNNWFGY

SEQ ID NO: 290737 - protein, 8 aa, Influenza virus
NNNWFGYF

SEQ ID NO: 290738 - protein, 8 aa, Influenza virus
NNWFGYFG

SEQ ID NO: 290739 - protein, 8 aa, Influenza virus
NWFGYFGI

SEQ ID NO: 290740 - protein, 8 aa, Influenza virus
WFGYFGIF

SEQ ID NO: 290741 - protein, 8 aa, Influenza virus
FGYFGIFF

SEQ ID NO: 290742 - protein, 8 aa, Influenza virus
GYFGIFFV

SEQ ID NO: 290743 - protein, 8 aa, Influenza virus
YFGIFFVE

SEQ ID NO: 290744 - protein, 8 aa, Influenza virus
GIFSVENK

SEQ ID NO: 290745 - protein, 8 aa, Influenza virus
KSCVNRCF

SEQ ID NO: 290746 - protein, 8 aa, Influenza virus
SCVNRCFY

SEQ ID NO: 290747 - protein, 8 aa, Influenza virus
CVNRCFYV

SEQ ID NO: 290748 - protein, 8 aa, Influenza virus
VNRCFYVE

SEQ ID NO: 290749 - protein, 8 aa, Influenza virus
YVELIRGM

SEQ ID NO: 290750 - protein, 8 aa, Influenza virus
VELIRGMP

SEQ ID NO: 290751 - protein, 8 aa, Influenza virus
ELIRGRPQ

SEQ ID NO: 290752 - protein, 8 aa, Influenza virus
LIRGRPQE

SEQ ID NO: 290753 - protein, 8 aa, Influenza virus
IRGRPQET

SEQ ID NO: 290754 - protein, 8 aa, Influenza virus
PQETRVWW

SEQ ID NO: 290755 - protein, 8 aa, Influenza virus
QETRVWWT

SEQ ID NO: 290756 - protein, 8 aa, Influenza virus
ENRVWWTS

SEQ ID NO: 290757 - protein, 8 aa, Influenza virus
NRVWWTSN

SEQ ID NO: 290758 - protein, 8 aa, Influenza virus
WWTSNSII

SEQ ID NO: 290759 - protein, 8 aa, Influenza virus
WTSNSIIV

SEQ ID NO: 290760 - protein, 8 aa, Influenza virus
TSNSIIVF

SEQ ID NO: 290761 - protein, 8 aa, Influenza virus
SNSIIVFC

SEQ ID NO: 290762 - protein, 8 aa, Influenza virus
NSIIVFCG

SEQ ID NO: 290763 - protein, 8 aa, Influenza virus
SIIVFCGT

SEQ ID NO: 290764 - protein, 8 aa, Influenza virus
IIVFCGTS

SEQ ID NO: 290765 - protein, 8 aa, Influenza virus
IVFCGTSG

SEQ ID NO: 290766 - protein, 8 aa, Influenza virus
VFCGTSAT

SEQ ID NO: 290767 - protein, 8 aa, Influenza virus
WPDGANIS

SEQ ID NO: 290768 - protein, 8 aa, Influenza virus
PDGANISF

SEQ ID NO: 290769 - protein, 8 aa, Influenza virus
DGANISFM

SEQ ID NO: 290770 - protein, 8 aa, Influenza virus
GANISFMP

SEQ ID NO: 290771 - protein, 8 aa, Influenza virus
SRGYKMNN

SEQ ID NO: 290772 - protein, 8 aa, Influenza virus
RGYKMNNQ

SEQ ID NO: 290773 - protein, 8 aa, Influenza virus
GYKMNTRI

SEQ ID NO: 290774 - protein, 8 aa, Influenza virus
YKMNNQIL

SEQ ID NO: 290775 - protein, 8 aa, Influenza virus
KMNTRILI

SEQ ID NO: 290776 - protein, 8 aa, Influenza virus
ADKICLGH

SEQ ID NO: 290777 - protein, 8 aa, Influenza virus
CLGHHAVS

SEQ ID NO: 290778 - protein, 8 aa, Influenza virus
LGHHAVSN

SEQ ID NO: 290779 - protein, 8 aa, Influenza virus
GHHAVSNG

SEQ ID NO: 290780 - protein, 8 aa, Influenza virus
HHAVSNGT

SEQ ID NO: 290781 - protein, 8 aa, Influenza virus
HAVSNGTK

SEQ ID NO: 290782 - protein, 8 aa, Influenza virus
AVSNGTKV

SEQ ID NO: 290783 - protein, 8 aa, Influenza virus
NGTRVNTL

SEQ ID NO: 290784 - protein, 8 aa, Influenza virus
GTRVNTLT

SEQ ID NO: 290785 - protein, 8 aa, Influenza virus
TRVNTLTE

SEQ ID NO: 290786 - protein, 8 aa, Influenza virus
VNTLTEKG

SEQ ID NO: 290787 - protein, 8 aa, Influenza virus
NTLTERGV

SEQ ID NO: 290788 - protein, 8 aa, Influenza virus
TLTERGVE

SEQ ID NO: 290789 - protein, 8 aa, Influenza virus
LTERGVEV

SEQ ID NO: 290790 - protein, 8 aa, Influenza virus
TERGVEVV

SEQ ID NO: 290791 - protein, 8 aa, Influenza virus
ERGVEVVN

SEQ ID NO: 290792 - protein, 8 aa, Influenza virus
RGVEVVNA

SEQ ID NO: 290793 - protein, 8 aa, Influenza virus
GVEVVNAT

SEQ ID NO: 290794 - protein, 8 aa, Influenza virus
VEVVNATE

SEQ ID NO: 290795 - protein, 8 aa, Influenza virus
EVVDATET

SEQ ID NO: 290796 - protein, 8 aa, Influenza virus
VVDATETV

SEQ ID NO: 290797 - protein, 8 aa, Influenza virus
VDATETVE

SEQ ID NO: 290798 - protein, 8 aa, Influenza virus
NATETVER

SEQ ID NO: 290799 - protein, 8 aa, Influenza virus
VDLGQCGL

SEQ ID NO: 290800 - protein, 8 aa, Influenza virus
DLGQCGIL

SEQ ID NO: 290801 - protein, 8 aa, Influenza virus
LGQCGILG

SEQ ID NO: 290802 - protein, 8 aa, Influenza virus
GQCGILGI

SEQ ID NO: 290803 - protein, 8 aa, Influenza virus
QCGLLGTI

SEQ ID NO: 290804 - protein, 8 aa, Influenza virus
CGLLGTIT

SEQ ID NO: 290805 - protein, 8 aa, Influenza virus
GLLGTITG

SEQ ID NO: 290806 - protein, 8 aa, Influenza virus
LLGTITGP

SEQ ID NO: 290807 - protein, 8 aa, Influenza virus
LGTITGPP

SEQ ID NO: 290808 - protein, 8 aa, Influenza virus
GTITGPPQ

SEQ ID NO: 290809 - protein, 8 aa, Influenza virus
TITGPPQC

SEQ ID NO: 290810 - protein, 8 aa, Influenza virus
ITGPPQCD

SEQ ID NO: 290811 - protein, 8 aa, Influenza virus
TGPPQCDQ

SEQ ID NO: 290812 - protein, 8 aa, Influenza virus
GPPQCDLF

SEQ ID NO: 290813 - protein, 8 aa, Influenza virus
PPQCDLFL

SEQ ID NO: 290814 - protein, 8 aa, Influenza virus
PQCDLFLE

SEQ ID NO: 290815 - protein, 8 aa, Influenza virus
QCDLFLEF

SEQ ID NO: 290816 - protein, 8 aa, Influenza virus
SDLIIERR

SEQ ID NO: 290817 - protein, 8 aa, Influenza virus
NLIIERRE

SEQ ID NO: 290818 - protein, 8 aa, Influenza virus
LIVERQEG

SEQ ID NO: 290819 - protein, 8 aa, Influenza virus
GNDVCYPG

SEQ ID NO: 290820 - protein, 8 aa, Influenza virus
DICYPGKF

SEQ ID NO: 290821 - protein, 8 aa, Influenza virus
VCYPGKFV

SEQ ID NO: 290822 - protein, 8 aa, Influenza virus
CYPGKFVN

SEQ ID NO: 290823 - protein, 8 aa, Influenza virus
EALRQILR

SEQ ID NO: 290824 - protein, 8 aa, Influenza virus
LRQILRES

SEQ ID NO: 290825 - protein, 8 aa, Influenza virus
RQILRESG

SEQ ID NO: 290826 - protein, 8 aa, Influenza virus
QILRESGG

SEQ ID NO: 290827 - protein, 8 aa, Influenza virus
ILRESGGI

SEQ ID NO: 290828 - protein, 8 aa, Influenza virus
KETMGFTY

SEQ ID NO: 290829 - protein, 8 aa, Influenza virus
GFTYSGIM

SEQ ID NO: 290830 - protein, 8 aa, Influenza virus
FTYSGIMT

SEQ ID NO: 290831 - protein, 8 aa, Influenza virus
ESSFYAEM

SEQ ID NO: 290832 - protein, 8 aa, Influenza virus
PSFYAEMK

SEQ ID NO: 290833 - protein, 8 aa, Influenza virus
MKWLLSNT

SEQ ID NO: 290834 - protein, 8 aa, Influenza virus
KWLLSNTD

SEQ ID NO: 290835 - protein, 8 aa, Influenza virus
WLLSNTDN

SEQ ID NO: 290836 - protein, 8 aa, Influenza virus
FPQTTKSY

SEQ ID NO: 290837 - protein, 8 aa, Influenza virus
PALIIWGI

SEQ ID NO: 290838 - protein, 8 aa, Influenza virus
ALIIWGIH

SEQ ID NO: 290839 - protein, 8 aa, Influenza virus
LIIWGIHH

SEQ ID NO: 290840 - protein, 8 aa, Influenza virus
IIWGIHHS

SEQ ID NO: 290841 - protein, 8 aa, Influenza virus
WGIHHSGS

SEQ ID NO: 290842 - protein, 8 aa, Influenza virus
EQTRLYGS

SEQ ID NO: 290843 - protein, 8 aa, Influenza virus
QTRLYGSG

SEQ ID NO: 290844 - protein, 8 aa, Influenza virus
RLYGSGNK

SEQ ID NO: 290845 - protein, 8 aa, Influenza virus
LYGSGAKL

SEQ ID NO: 290846 - protein, 8 aa, Influenza virus
YGSGAKLI

SEQ ID NO: 290847 - protein, 8 aa, Influenza virus
GSGAKLIT

SEQ ID NO: 290848 - protein, 8 aa, Influenza virus
SGAKLITV

SEQ ID NO: 290849 - protein, 8 aa, Influenza virus
KLITVESS

SEQ ID NO: 290850 - protein, 8 aa, Influenza virus
SSNYQQSF

SEQ ID NO: 290851 - protein, 8 aa, Influenza virus
SNYQQSFV

SEQ ID NO: 290852 - protein, 8 aa, Influenza virus
NYQQSFVP

SEQ ID NO: 290853 - protein, 8 aa, Influenza virus
YQQSFVPS

SEQ ID NO: 290854 - protein, 8 aa, Influenza virus
QQSFVPSP

SEQ ID NO: 290855 - protein, 8 aa, Influenza virus
QSFVPSPG

SEQ ID NO: 290856 - protein, 8 aa, Influenza virus
SFVPSPGA

SEQ ID NO: 290857 - protein, 8 aa, Influenza virus
FVPSPGAR

SEQ ID NO: 290858 - protein, 8 aa, Influenza virus
QVNGQFGR

SEQ ID NO: 290859 - protein, 8 aa, Influenza virus
VNGQFGRI

SEQ ID NO: 290860 - protein, 8 aa, Influenza virus
NGQFGRIN

SEQ ID NO: 290861 - protein, 8 aa, Influenza virus
GQFGRINF

SEQ ID NO: 290862 - protein, 8 aa, Influenza virus
QFGRINFH

SEQ ID NO: 290863 - protein, 8 aa, Influenza virus
FGRINFHW

SEQ ID NO: 290864 - protein, 8 aa, Influenza virus
GRINFHWL

SEQ ID NO: 290865 - protein, 8 aa, Influenza virus
FHWLMLNP

SEQ ID NO: 290866 - protein, 8 aa, Influenza virus
HWLMLNPN

SEQ ID NO: 290867 - protein, 8 aa, Influenza virus
WLMLNPND

SEQ ID NO: 290868 - protein, 8 aa, Influenza virus
LMLNPNDT

SEQ ID NO: 290869 - protein, 8 aa, Influenza virus
MLNPNDTV

SEQ ID NO: 290870 - protein, 8 aa, Influenza virus
LNPNDTVT

SEQ ID NO: 290871 - protein, 8 aa, Influenza virus
NPNDTVTF

SEQ ID NO: 290872 - protein, 8 aa, Influenza virus
NDTVTFSF

SEQ ID NO: 290873 - protein, 8 aa, Influenza virus
DTVTFSFN

SEQ ID NO: 290874 - protein, 8 aa, Influenza virus
TVTFSFNG

SEQ ID NO: 290875 - protein, 8 aa, Influenza virus
TFSFNGAF

SEQ ID NO: 290876 - protein, 8 aa, Influenza virus
FSFNGAFI

SEQ ID NO: 290877 - protein, 8 aa, Influenza virus
SFNGAFIA

SEQ ID NO: 290878 - protein, 8 aa, Influenza virus
FNGAFVAP

SEQ ID NO: 290879 - protein, 8 aa, Influenza virus
NGAFVAPD

SEQ ID NO: 290880 - protein, 8 aa, Influenza virus
GAFVAPDR

SEQ ID NO: 290881 - protein, 8 aa, Influenza virus
AFIAPDRV

SEQ ID NO: 290882 - protein, 8 aa, Influenza virus
FIAPDRVS

SEQ ID NO: 290883 - protein, 8 aa, Influenza virus
IAPDRVSF

SEQ ID NO: 290884 - protein, 8 aa, Influenza virus
APDRASFL

SEQ ID NO: 290885 - protein, 8 aa, Influenza virus
CYHSGGTI

SEQ ID NO: 290886 - protein, 8 aa, Influenza virus
GGTIISNL

SEQ ID NO: 290887 - protein, 8 aa, Influenza virus
GTIISNLP

SEQ ID NO: 290888 - protein, 8 aa, Influenza virus
TIISNLPF

SEQ ID NO: 290889 - protein, 8 aa, Influenza virus
IISNLPFQ

SEQ ID NO: 290890 - protein, 8 aa, Influenza virus
ISNLPFQN

SEQ ID NO: 290891 - protein, 8 aa, Influenza virus
SNLPFQNI

SEQ ID NO: 290892 - protein, 8 aa, Influenza virus
NLPFQNIN

SEQ ID NO: 290893 - protein, 8 aa, Influenza virus
LPFQNINS

SEQ ID NO: 290894 - protein, 8 aa, Influenza virus
PFQNINSR

SEQ ID NO: 290895 - protein, 8 aa, Influenza virus
FQNINSRA

SEQ ID NO: 290896 - protein, 8 aa, Influenza virus
IGKCPRYV

SEQ ID NO: 290897 - protein, 8 aa, Influenza virus
GKCPRYVR

SEQ ID NO: 290898 - protein, 8 aa, Influenza virus
KCPRYVRQ

SEQ ID NO: 290899 - protein, 8 aa, Influenza virus
SLMLATGM

SEQ ID NO: 290900 - protein, 8 aa, Influenza virus
LLLATGMK

SEQ ID NO: 290901 - protein, 8 aa, Influenza virus
LLATGMKN

SEQ ID NO: 290902 - protein, 8 aa, Influenza virus
LATGMKNV

SEQ ID NO: 290903 - protein, 8 aa, Influenza virus
ATGMKNVP

SEQ ID NO: 290904 - protein, 8 aa, Influenza virus
TGMKNVPE

SEQ ID NO: 290905 - protein, 8 aa, Influenza virus
GMKNVPEI

SEQ ID NO: 290906 - protein, 8 aa, Influenza virus
MKNVPEIP

SEQ ID NO: 290907 - protein, 8 aa, Influenza virus
KNVPEIPK

SEQ ID NO: 290908 - protein, 8 aa, Influenza virus
KRKRGLFG

SEQ ID NO: 290909 - protein, 8 aa, Influenza virus
SPLSRCRE

SEQ ID NO: 290910 - protein, 8 aa, Influenza virus
AYRKRMTR

SEQ ID NO: 290911 - protein, 8 aa, Influenza virus
YRKRMTRG

SEQ ID NO: 290912 - protein, 8 aa, Influenza virus
RKRMTRGL

SEQ ID NO: 290913 - protein, 8 aa, Influenza virus
CRETRGLF

SEQ ID NO: 290914 - protein, 8 aa, Influenza virus
RETRGLFG

SEQ ID NO: 290915 - protein, 8 aa, Influenza virus
ETRGLFGA

SEQ ID NO: 290916 - protein, 8 aa, Influenza virus
ARGLFGAI

SEQ ID NO: 290917 - protein, 8 aa, Influenza virus
ENGWEGLV

SEQ ID NO: 290918 - protein, 8 aa, Influenza virus
NGWEGLVD

SEQ ID NO: 290919 - protein, 8 aa, Influenza virus
GWEGLVDG

SEQ ID NO: 290920 - protein, 8 aa, Influenza virus
WEGLVDGW

SEQ ID NO: 290921 - protein, 8 aa, Influenza virus
EGLVDGWY

SEQ ID NO: 290922 - protein, 8 aa, Influenza virus
GLVDGWYG

SEQ ID NO: 290923 - protein, 8 aa, Influenza virus
LVDGWYGF

SEQ ID NO: 290924 - protein, 8 aa, Influenza virus
VDGWYGFR

SEQ ID NO: 290925 - protein, 8 aa, Influenza virus
NGWYGFRH

SEQ ID NO: 290926 - protein, 8 aa, Influenza virus
GWYGFKHQ

SEQ ID NO: 290927 - protein, 8 aa, Influenza virus
WYGFKHQN

SEQ ID NO: 290928 - protein, 8 aa, Influenza virus
YGFKHQNA

SEQ ID NO: 290929 - protein, 8 aa, Influenza virus
GFKHQNAQ

SEQ ID NO: 290930 - protein, 8 aa, Influenza virus
FKHQNAQG

SEQ ID NO: 290931 - protein, 8 aa, Influenza virus
KHQNAQGE

SEQ ID NO: 290932 - protein, 8 aa, Influenza virus
QNAQGEGI

SEQ ID NO: 290933 - protein, 8 aa, Influenza virus
NAQGEGIA

SEQ ID NO: 290934 - protein, 8 aa, Influenza virus
AQGEGIAA

SEQ ID NO: 290935 - protein, 8 aa, Influenza virus
QGEGIAAD

SEQ ID NO: 290936 - protein, 8 aa, Influenza virus
GEGIAADY

SEQ ID NO: 290937 - protein, 8 aa, Influenza virus
EGIAADYK

SEQ ID NO: 290938 - protein, 8 aa, Influenza virus
GIAADYKS

SEQ ID NO: 290939 - protein, 8 aa, Influenza virus
IAADYKST

SEQ ID NO: 290940 - protein, 8 aa, Influenza virus
AADYKSTP

SEQ ID NO: 290941 - protein, 8 aa, Influenza virus
ADYKSTPS

SEQ ID NO: 290942 - protein, 8 aa, Influenza virus
DYKSTPSA

SEQ ID NO: 290943 - protein, 8 aa, Influenza virus
YKSTQSAV

SEQ ID NO: 290944 - protein, 8 aa, Influenza virus
KSTQSAIN

SEQ ID NO: 290945 - protein, 8 aa, Influenza virus
STQSAINQ

SEQ ID NO: 290946 - protein, 8 aa, Influenza virus
TQSAINQI

SEQ ID NO: 290947 - protein, 8 aa, Influenza virus
QSAINQIT

SEQ ID NO: 290948 - protein, 8 aa, Influenza virus
SAINQITG

SEQ ID NO: 290949 - protein, 8 aa, Influenza virus
AINQITGK

SEQ ID NO: 290950 - protein, 8 aa, Influenza virus
INQITGKL

SEQ ID NO: 290951 - protein, 8 aa, Influenza virus
NQITGKLN

SEQ ID NO: 290952 - protein, 8 aa, Influenza virus
ITGKLNRI

SEQ ID NO: 290953 - protein, 8 aa, Influenza virus
TGKLNRII

SEQ ID NO: 290954 - protein, 8 aa, Influenza virus
GKLNRLIE

SEQ ID NO: 290955 - protein, 8 aa, Influenza virus
KLNRLIEK

SEQ ID NO: 290956 - protein, 8 aa, Influenza virus
LNRLIEKT

SEQ ID NO: 290957 - protein, 8 aa, Influenza virus
NRLIEKTN

SEQ ID NO: 290958 - protein, 8 aa, Influenza virus
RLIEKTNQ

SEQ ID NO: 290959 - protein, 8 aa, Influenza virus
LIEKTNQQ

SEQ ID NO: 290960 - protein, 8 aa, Influenza virus
IEKTNQQF

SEQ ID NO: 290961 - protein, 8 aa, Influenza virus
EKTNQQFE

SEQ ID NO: 290962 - protein, 8 aa, Influenza virus
KTNQQFEM

SEQ ID NO: 290963 - protein, 8 aa, Influenza virus
TNQQFEMI

SEQ ID NO: 290964 - protein, 8 aa, Influenza virus
NQQFEMID

SEQ ID NO: 290965 - protein, 8 aa, Influenza virus
QQFEMIDN

SEQ ID NO: 290966 - protein, 8 aa, Influenza virus
QFEMIDNE

SEQ ID NO: 290967 - protein, 8 aa, Influenza virus
FEMIDNEF

SEQ ID NO: 290968 - protein, 8 aa, Influenza virus
LIDNEFSE

SEQ ID NO: 290969 - protein, 8 aa, Influenza virus
IDNEFTEV

SEQ ID NO: 290970 - protein, 8 aa, Influenza virus
DNEFTEVE

SEQ ID NO: 290971 - protein, 8 aa, Influenza virus
FTEVEKQI

SEQ ID NO: 290972 - protein, 8 aa, Influenza virus
TEVEKQIG

SEQ ID NO: 290973 - protein, 8 aa, Influenza virus
EVEKQIGN

SEQ ID NO: 290974 - protein, 8 aa, Influenza virus
VEKQIGNV

SEQ ID NO: 290975 - protein, 8 aa, Influenza virus
EKQIGNVI

SEQ ID NO: 290976 - protein, 8 aa, Influenza virus
KQIGNVIN

SEQ ID NO: 290977 - protein, 8 aa, Influenza virus
VINWTRDA

SEQ ID NO: 290978 - protein, 8 aa, Influenza virus
INWTRDSI

SEQ ID NO: 290979 - protein, 8 aa, Influenza virus
NWTRDSIT

SEQ ID NO: 290980 - protein, 8 aa, Influenza virus
WTRDSITE

SEQ ID NO: 290981 - protein, 8 aa, Influenza virus
TRDSMTEI

SEQ ID NO: 290982 - protein, 8 aa, Influenza virus
RDSMTEIW

SEQ ID NO: 290983 - protein, 8 aa, Influenza virus
DSMTEIWS

SEQ ID NO: 290984 - protein, 8 aa, Influenza virus
SMTEIWSY

SEQ ID NO: 290985 - protein, 8 aa, Influenza virus
MTEIWSYN

SEQ ID NO: 290986 - protein, 8 aa, Influenza virus
TEIWSYNA

SEQ ID NO: 290987 - protein, 8 aa, Influenza virus
EIWSYNAE

SEQ ID NO: 290988 - protein, 8 aa, Influenza virus
IWSYNAEL

SEQ ID NO: 290989 - protein, 8 aa, Influenza virus
VVYAELLV

SEQ ID NO: 290990 - protein, 8 aa, Influenza virus
VYAELLVA

SEQ ID NO: 290991 - protein, 8 aa, Influenza virus
NAELLIAM

SEQ ID NO: 290992 - protein, 8 aa, Influenza virus
DLADSEMD

SEQ ID NO: 290993 - protein, 8 aa, Influenza virus
LADSEMDK

SEQ ID NO: 290994 - protein, 8 aa, Influenza virus
ADSEMDKL

SEQ ID NO: 290995 - protein, 8 aa, Influenza virus
DSEMDKLY

SEQ ID NO: 290996 - protein, 8 aa, Influenza virus
SEMDKLYE

SEQ ID NO: 290997 - protein, 8 aa, Influenza virus
EMDKLYER

SEQ ID NO: 290998 - protein, 8 aa, Influenza virus
MDKLYERV

SEQ ID NO: 290999 - protein, 8 aa, Influenza virus
KLYERVRR

SEQ ID NO: 291000 - protein, 8 aa, Influenza virus
LYERVRRQ

SEQ ID NO: 291001 - protein, 8 aa, Influenza virus
YERVRRQL

SEQ ID NO: 291002 - protein, 8 aa, Influenza virus
ERVRRQLR

SEQ ID NO: 291003 - protein, 8 aa, Influenza virus
RVRRQLRE

SEQ ID NO: 291004 - protein, 8 aa, Influenza virus
VRRQLREN

SEQ ID NO: 291005 - protein, 8 aa, Influenza virus
RRQLRENA

SEQ ID NO: 291006 - protein, 8 aa, Influenza virus
RQLRENAE

SEQ ID NO: 291007 - protein, 8 aa, Influenza virus
EIFHKCDN

SEQ ID NO: 291008 - protein, 8 aa, Influenza virus
DCMASIRN

SEQ ID NO: 291009 - protein, 8 aa, Influenza virus
CMASIRNN

SEQ ID NO: 291010 - protein, 8 aa, Influenza virus
MASIRNNT

SEQ ID NO: 291011 - protein, 8 aa, Influenza virus
ASIRNNTY

SEQ ID NO: 291012 - protein, 8 aa, Influenza virus
SIRNSTYD

SEQ ID NO: 291013 - protein, 8 aa, Influenza virus
IRNSTYDH

SEQ ID NO: 291014 - protein, 8 aa, Influenza virus
RNNTYDHS

SEQ ID NO: 291015 - protein, 8 aa, Influenza virus
TYDHSKYR

SEQ ID NO: 291016 - protein, 8 aa, Influenza virus
KYREEAMQ

SEQ ID NO: 291017 - protein, 8 aa, Influenza virus
YREEAMQN

SEQ ID NO: 291018 - protein, 8 aa, Influenza virus
REEAMQNR

SEQ ID NO: 291019 - protein, 8 aa, Influenza virus
EEAMQNRI

SEQ ID NO: 291020 - protein, 8 aa, Influenza virus
EAMQNRIQ

SEQ ID NO: 291021 - protein, 8 aa, Influenza virus
AMQNRIQI

SEQ ID NO: 291022 - protein, 8 aa, Influenza virus
QNRIQINP

SEQ ID NO: 291023 - protein, 8 aa, Influenza virus
NRIQINPV

SEQ ID NO: 291024 - protein, 8 aa, Influenza virus
RIQINPVK

SEQ ID NO: 291025 - protein, 8 aa, Influenza virus
IQINPVKL

SEQ ID NO: 291026 - protein, 8 aa, Influenza virus
NPVKLSSG

SEQ ID NO: 291027 - protein, 8 aa, Influenza virus
PVKLSGGY

SEQ ID NO: 291028 - protein, 8 aa, Influenza virus
VKLSGGYK

SEQ ID NO: 291029 - protein, 8 aa, Influenza virus
KLSSGYKE

SEQ ID NO: 291030 - protein, 8 aa, Influenza virus
SSGYKDVI

SEQ ID NO: 291031 - protein, 8 aa, Influenza virus
SGYKDVIL

SEQ ID NO: 291032 - protein, 8 aa, Influenza virus
GYKDVILW

SEQ ID NO: 291033 - protein, 8 aa, Influenza virus
YKDVILWF

SEQ ID NO: 291034 - protein, 8 aa, Influenza virus
KDVILWFS

SEQ ID NO: 291035 - protein, 8 aa, Influenza virus
DVILWFSF

SEQ ID NO: 291036 - protein, 8 aa, Influenza virus
VILWFSFG

SEQ ID NO: 291037 - protein, 8 aa, Influenza virus
SFGASCFI

SEQ ID NO: 291038 - protein, 8 aa, Influenza virus
FGASCFIL

SEQ ID NO: 291039 - protein, 8 aa, Influenza virus
GASCFILL

SEQ ID NO: 291040 - protein, 8 aa, Influenza virus
ASCFILLA

SEQ ID NO: 291041 - protein, 8 aa, Influenza virus
SCFILLAI

SEQ ID NO: 291042 - protein, 8 aa, Influenza virus
FICVKNGN

SEQ ID NO: 291043 - protein, 8 aa, Influenza virus
ICVKNGNM

SEQ ID NO: 291044 - protein, 8 aa, Influenza virus
CVKNGNMR

SEQ ID NO: 291045 - protein, 8 aa, Influenza virus
VKNGNMRC

SEQ ID NO: 291046 - protein, 8 aa, Influenza virus
KNGNHAVH

SEQ ID NO: 291047 - protein, 8 aa, Influenza virus
NGNHAVHY

SEQ ID NO: 291048 - protein, 8 aa, Influenza virus
GIVNTTLS

SEQ ID NO: 291049 - protein, 8 aa, Influenza virus
IVNTTLST

SEQ ID NO: 291050 - protein, 8 aa, Influenza virus
VNTVLSII

SEQ ID NO: 291051 - protein, 8 aa, Influenza virus
NTVLSIIA

SEQ ID NO: 291052 - protein, 8 aa, Influenza virus
TALSTIAL

SEQ ID NO: 291053 - protein, 8 aa, Influenza virus
TLSTIALI

SEQ ID NO: 291054 - protein, 8 aa, Influenza virus
LSTIALII

SEQ ID NO: 291055 - protein, 8 aa, Influenza virus
STIALIIG

SEQ ID NO: 291056 - protein, 8 aa, Influenza virus
TIALLIGI

SEQ ID NO: 291057 - protein, 8 aa, Influenza virus
IALLIGIG

SEQ ID NO: 291058 - protein, 8 aa, Influenza virus
ALLIGIGN

SEQ ID NO: 291059 - protein, 8 aa, Influenza virus
LLIGIGNL

SEQ ID NO: 291060 - protein, 8 aa, Influenza virus
IGVGNLIF

SEQ ID NO: 291061 - protein, 8 aa, Influenza virus
GVGNLIFN

SEQ ID NO: 291062 - protein, 8 aa, Influenza virus
VGNLIFNT

SEQ ID NO: 291063 - protein, 8 aa, Influenza virus
GNLIFNTV

SEQ ID NO: 291064 - protein, 8 aa, Influenza virus
NLIFNTVI

SEQ ID NO: 291065 - protein, 8 aa, Influenza virus
LIFNTVIH

SEQ ID NO: 291066 - protein, 8 aa, Influenza virus
IFNTVIHG

SEQ ID NO: 291067 - protein, 8 aa, Influenza virus
FNTVIHGK

SEQ ID NO: 291068 - protein, 8 aa, Influenza virus
ITYNSTVV

SEQ ID NO: 291069 - protein, 8 aa, Influenza virus
TYNSTVVN

SEQ ID NO: 291070 - protein, 8 aa, Influenza virus
YNSTVVNN

SEQ ID NO: 291071 - protein, 8 aa, Influenza virus
NSTVVNNI

SEQ ID NO: 291072 - protein, 8 aa, Influenza virus
STVVNNIT

SEQ ID NO: 291073 - protein, 8 aa, Influenza virus
TVVNNITT

SEQ ID NO: 291074 - protein, 8 aa, Influenza virus
VVNNITTT

SEQ ID NO: 291075 - protein, 8 aa, Influenza virus
VNNITTTI

SEQ ID NO: 291076 - protein, 8 aa, Influenza virus
NNITTTIV

SEQ ID NO: 291077 - protein, 8 aa, Influenza virus
NITTTIVT

SEQ ID NO: 291078 - protein, 8 aa, Influenza virus
FKSSLPLC

SEQ ID NO: 291079 - protein, 8 aa, Influenza virus
KSSLPLCP

SEQ ID NO: 291080 - protein, 8 aa, Influenza virus
SSLPLCPF

SEQ ID NO: 291081 - protein, 8 aa, Influenza virus
SLPLCPFR

SEQ ID NO: 291082 - protein, 8 aa, Influenza virus
LPLCPFQG

SEQ ID NO: 291083 - protein, 8 aa, Influenza virus
PLCPFQGF

SEQ ID NO: 291084 - protein, 8 aa, Influenza virus
LCPFQGFF

SEQ ID NO: 291085 - protein, 8 aa, Influenza virus
CPFQGFFP

SEQ ID NO: 291086 - protein, 8 aa, Influenza virus
PFQGFFPF

SEQ ID NO: 291087 - protein, 8 aa, Influenza virus
FQGFFPFH

SEQ ID NO: 291088 - protein, 8 aa, Influenza virus
QGFFPFHK

SEQ ID NO: 291089 - protein, 8 aa, Influenza virus
PFHKGNSA

SEQ ID NO: 291090 - protein, 8 aa, Influenza virus
FHKGNSAR

SEQ ID NO: 291091 - protein, 8 aa, Influenza virus
HKDNAIRP

SEQ ID NO: 291092 - protein, 8 aa, Influenza virus
KGNSARLI

SEQ ID NO: 291093 - protein, 8 aa, Influenza virus
DNALRLAE

SEQ ID NO: 291094 - protein, 8 aa, Influenza virus
NAIRPGEN

SEQ ID NO: 291095 - protein, 8 aa, Influenza virus
SARLIHHT

SEQ ID NO: 291096 - protein, 8 aa, Influenza virus
DVIITREP

SEQ ID NO: 291097 - protein, 8 aa, Influenza virus
VIITREPY

SEQ ID NO: 291098 - protein, 8 aa, Influenza virus
IVTREPYI

SEQ ID NO: 291099 - protein, 8 aa, Influenza virus
VTREPYIS

SEQ ID NO: 291100 - protein, 8 aa, Influenza virus
TREPYISC

SEQ ID NO: 291101 - protein, 8 aa, Influenza virus
REPYISCD

SEQ ID NO: 291102 - protein, 8 aa, Influenza virus
EPYVSCDY

SEQ ID NO: 291103 - protein, 8 aa, Influenza virus
DCWSFALA

SEQ ID NO: 291104 - protein, 8 aa, Influenza virus
SFALAQGV

SEQ ID NO: 291105 - protein, 8 aa, Influenza virus
FALAQGVL

SEQ ID NO: 291106 - protein, 8 aa, Influenza virus
ALAQGALV

SEQ ID NO: 291107 - protein, 8 aa, Influenza virus
LAQGALVG

SEQ ID NO: 291108 - protein, 8 aa, Influenza virus
AQGALVGT

SEQ ID NO: 291109 - protein, 8 aa, Influenza virus
QGALVGTK

SEQ ID NO: 291110 - protein, 8 aa, Influenza virus
GALLGTNH

SEQ ID NO: 291111 - protein, 8 aa, Influenza virus
ALVGTKHS

SEQ ID NO: 291112 - protein, 8 aa, Influenza virus
LVGTKHSN

SEQ ID NO: 291113 - protein, 8 aa, Influenza virus
LGTNHSNG

SEQ ID NO: 291114 - protein, 8 aa, Influenza virus
GTNHSNGT

SEQ ID NO: 291115 - protein, 8 aa, Influenza virus
HSNGTVKD

SEQ ID NO: 291116 - protein, 8 aa, Influenza virus
SNGTVKDR

SEQ ID NO: 291117 - protein, 8 aa, Influenza virus
KDRTSYRS

SEQ ID NO: 291118 - protein, 8 aa, Influenza virus
DRTSYRSL

SEQ ID NO: 291119 - protein, 8 aa, Influenza virus
RTSYRSLI

SEQ ID NO: 291120 - protein, 8 aa, Influenza virus
TPYRSLIQ

SEQ ID NO: 291121 - protein, 8 aa, Influenza virus
PYRSLIQF

SEQ ID NO: 291122 - protein, 8 aa, Influenza virus
YRSLIQFP

SEQ ID NO: 291123 - protein, 8 aa, Influenza virus
RSLIQFPM

SEQ ID NO: 291124 - protein, 8 aa, Influenza virus
SLIQFPIG

SEQ ID NO: 291125 - protein, 8 aa, Influenza virus
LIRFPIGV

SEQ ID NO: 291126 - protein, 8 aa, Influenza virus
IRFPIGVA

SEQ ID NO: 291127 - protein, 8 aa, Influenza virus
RFPIGVAP

SEQ ID NO: 291128 - protein, 8 aa, Influenza virus
FPIGVAPV

SEQ ID NO: 291129 - protein, 8 aa, Influenza virus
PIGVAPVL

SEQ ID NO: 291130 - protein, 8 aa, Influenza virus
IGVAPVLG

SEQ ID NO: 291131 - protein, 8 aa, Influenza virus
GVAPVLGN

SEQ ID NO: 291132 - protein, 8 aa, Influenza virus
VAPVLGNY

SEQ ID NO: 291133 - protein, 8 aa, Influenza virus
APVLGNYR

SEQ ID NO: 291134 - protein, 8 aa, Influenza virus
PVLGNYRE

SEQ ID NO: 291135 - protein, 8 aa, Influenza virus
VLGNYREI

SEQ ID NO: 291136 - protein, 8 aa, Influenza virus
LGNYREIC

SEQ ID NO: 291137 - protein, 8 aa, Influenza virus
GNYKEICV

SEQ ID NO: 291138 - protein, 8 aa, Influenza virus
NYKEICVA

SEQ ID NO: 291139 - protein, 8 aa, Influenza virus
YKEICVAW

SEQ ID NO: 291140 - protein, 8 aa, Influenza virus
KEICVAWS

SEQ ID NO: 291141 - protein, 8 aa, Influenza virus
EICVAWSS

SEQ ID NO: 291142 - protein, 8 aa, Influenza virus
ICVAWSSS

SEQ ID NO: 291143 - protein, 8 aa, Influenza virus
CVAWSSSS

SEQ ID NO: 291144 - protein, 8 aa, Influenza virus
VAWSSSSC

SEQ ID NO: 291145 - protein, 8 aa, Influenza virus
AWSSTSCF

SEQ ID NO: 291146 - protein, 8 aa, Influenza virus
WSSTSCFD

SEQ ID NO: 291147 - protein, 8 aa, Influenza virus
SSTSCFDG

SEQ ID NO: 291148 - protein, 8 aa, Influenza virus
STSCFDGK

SEQ ID NO: 291149 - protein, 8 aa, Influenza virus
TSCFDGKE

SEQ ID NO: 291150 - protein, 8 aa, Influenza virus
DGKEWMHI

SEQ ID NO: 291151 - protein, 8 aa, Influenza virus
GKEWMHVS

SEQ ID NO: 291152 - protein, 8 aa, Influenza virus
KEWMHVCI

SEQ ID NO: 291153 - protein, 8 aa, Influenza virus
EWMHVCIT

SEQ ID NO: 291154 - protein, 8 aa, Influenza virus
WMHVCITG

SEQ ID NO: 291155 - protein, 8 aa, Influenza virus
HVCITGND

SEQ ID NO: 291156 - protein, 8 aa, Influenza virus
GKMTDSIK

SEQ ID NO: 291157 - protein, 8 aa, Influenza virus
KMTDSIKS

SEQ ID NO: 291158 - protein, 8 aa, Influenza virus
MADSIKSW

SEQ ID NO: 291159 - protein, 8 aa, Influenza virus
SDSIKSWR

SEQ ID NO: 291160 - protein, 8 aa, Influenza virus
DSIKSWRR

SEQ ID NO: 291161 - protein, 8 aa, Influenza virus
SIKSWRRD

SEQ ID NO: 291162 - protein, 8 aa, Influenza virus
IKSWRRDI

SEQ ID NO: 291163 - protein, 8 aa, Influenza virus
KSWRRDIL

SEQ ID NO: 291164 - protein, 8 aa, Influenza virus
SWRRDILR

SEQ ID NO: 291165 - protein, 8 aa, Influenza virus
WRRDILRT

SEQ ID NO: 291166 - protein, 8 aa, Influenza virus
RRDILRTQ

SEQ ID NO: 291167 - protein, 8 aa, Influenza virus
RDILRTQE

SEQ ID NO: 291168 - protein, 8 aa, Influenza virus
TQESECLC

SEQ ID NO: 291169 - protein, 8 aa, Influenza virus
QESECQRI

SEQ ID NO: 291170 - protein, 8 aa, Influenza virus
ESECQCIG

SEQ ID NO: 291171 - protein, 8 aa, Influenza virus
SECQCIGG

SEQ ID NO: 291172 - protein, 8 aa, Influenza virus
GTCVVTVT

SEQ ID NO: 291173 - protein, 8 aa, Influenza virus
TCVVTVTD

SEQ ID NO: 291174 - protein, 8 aa, Influenza virus
CVVTVTDG

SEQ ID NO: 291175 - protein, 8 aa, Influenza virus
VVTVTDGP

SEQ ID NO: 291176 - protein, 8 aa, Influenza virus
VTVTDGPA

SEQ ID NO: 291177 - protein, 8 aa, Influenza virus
TVTDGPAA

SEQ ID NO: 291178 - protein, 8 aa, Influenza virus
TDGPAANN

SEQ ID NO: 291179 - protein, 8 aa, Influenza virus
DGPAANNA

SEQ ID NO: 291180 - protein, 8 aa, Influenza virus
GPAANNAD

SEQ ID NO: 291181 - protein, 8 aa, Influenza virus
PAANNADH

SEQ ID NO: 291182 - protein, 8 aa, Influenza virus
AANNADHR

SEQ ID NO: 291183 - protein, 8 aa, Influenza virus
ANSADHRI

SEQ ID NO: 291184 - protein, 8 aa, Influenza virus
NSADHRIY

SEQ ID NO: 291185 - protein, 8 aa, Influenza virus
SADHRIYW

SEQ ID NO: 291186 - protein, 8 aa, Influenza virus
ADHRIYWI

SEQ ID NO: 291187 - protein, 8 aa, Influenza virus
DHRIYWIR

SEQ ID NO: 291188 - protein, 8 aa, Influenza virus
HRIYWIRE

SEQ ID NO: 291189 - protein, 8 aa, Influenza virus
RIYWIREG

SEQ ID NO: 291190 - protein, 8 aa, Influenza virus
VYWIREGK

SEQ ID NO: 291191 - protein, 8 aa, Influenza virus
KIKHLEEC

SEQ ID NO: 291192 - protein, 8 aa, Influenza virus
IKHLEECS

SEQ ID NO: 291193 - protein, 8 aa, Influenza virus
KHLEECSC

SEQ ID NO: 291194 - protein, 8 aa, Influenza virus
LEECSCYM

SEQ ID NO: 291195 - protein, 8 aa, Influenza virus
EECSCYMD

SEQ ID NO: 291196 - protein, 8 aa, Influenza virus
ECSCYMDI

SEQ ID NO: 291197 - protein, 8 aa, Influenza virus
CSCYMDID

SEQ ID NO: 291198 - protein, 8 aa, Influenza virus
SCYVDIDI

SEQ ID NO: 291199 - protein, 8 aa, Influenza virus
CYVDIDIY

SEQ ID NO: 291200 - protein, 8 aa, Influenza virus
YVDIDIYC

SEQ ID NO: 291201 - protein, 8 aa, Influenza virus
DIDIYCIC

SEQ ID NO: 291202 - protein, 8 aa, Influenza virus
IDIYCICR

SEQ ID NO: 291203 - protein, 8 aa, Influenza virus
DIYCICRD

SEQ ID NO: 291204 - protein, 8 aa, Influenza virus
IYCICRDN

SEQ ID NO: 291205 - protein, 8 aa, Influenza virus
YCVCRDNW

SEQ ID NO: 291206 - protein, 8 aa, Influenza virus
CVCRDNWK

SEQ ID NO: 291207 - protein, 8 aa, Influenza virus
VCRDNWKG

SEQ ID NO: 291208 - protein, 8 aa, Influenza virus
KGSNRPWI

SEQ ID NO: 291209 - protein, 8 aa, Influenza virus
GSNRPWIR

SEQ ID NO: 291210 - protein, 8 aa, Influenza virus
SNRPWIRI

SEQ ID NO: 291211 - protein, 8 aa, Influenza virus
NRPWIRIN

SEQ ID NO: 291212 - protein, 8 aa, Influenza virus
RPWIRINN

SEQ ID NO: 291213 - protein, 8 aa, Influenza virus
PWIRINNE

SEQ ID NO: 291214 - protein, 8 aa, Influenza virus
WIRINNET

SEQ ID NO: 291215 - protein, 8 aa, Influenza virus
IRINNETI

SEQ ID NO: 291216 - protein, 8 aa, Influenza virus
RISNETIL

SEQ ID NO: 291217 - protein, 8 aa, Influenza virus
ISNETILE

SEQ ID NO: 291218 - protein, 8 aa, Influenza virus
SNETILET

SEQ ID NO: 291219 - protein, 8 aa, Influenza virus
NETIVETG

SEQ ID NO: 291220 - protein, 8 aa, Influenza virus
ETIVETGY

SEQ ID NO: 291221 - protein, 8 aa, Influenza virus
TILETRYV

SEQ ID NO: 291222 - protein, 8 aa, Influenza virus
IVETGYVC

SEQ ID NO: 291223 - protein, 8 aa, Influenza virus
LETGYICS

SEQ ID NO: 291224 - protein, 8 aa, Influenza virus
ETGYICSK

SEQ ID NO: 291225 - protein, 8 aa, Influenza virus
TGYICSKF

SEQ ID NO: 291226 - protein, 8 aa, Influenza virus
RYVCSKFH

SEQ ID NO: 291227 - protein, 8 aa, Influenza virus
HSDTPRPD

SEQ ID NO: 291228 - protein, 8 aa, Influenza virus
SDTPRPDD

SEQ ID NO: 291229 - protein, 8 aa, Influenza virus
DTPRPDDP

SEQ ID NO: 291230 - protein, 8 aa, Influenza virus
TPRPDDPS

SEQ ID NO: 291231 - protein, 8 aa, Influenza virus
DPSTMSCD

SEQ ID NO: 291232 - protein, 8 aa, Influenza virus
PSTMSCDS

SEQ ID NO: 291233 - protein, 8 aa, Influenza virus
STMSCDSP

SEQ ID NO: 291234 - protein, 8 aa, Influenza virus
TMSCDSPS

SEQ ID NO: 291235 - protein, 8 aa, Influenza virus
MSCDSPSN

SEQ ID NO: 291236 - protein, 8 aa, Influenza virus
SCDSPSNI

SEQ ID NO: 291237 - protein, 8 aa, Influenza virus
CDSPSNIN

SEQ ID NO: 291238 - protein, 8 aa, Influenza virus
DSPSNING

SEQ ID NO: 291239 - protein, 8 aa, Influenza virus
SPSNINGG

SEQ ID NO: 291240 - protein, 8 aa, Influenza virus
NGGLGVKG

SEQ ID NO: 291241 - protein, 8 aa, Influenza virus
GGLGVKGF

SEQ ID NO: 291242 - protein, 8 aa, Influenza virus
GLGVKGFG

SEQ ID NO: 291243 - protein, 8 aa, Influenza virus
LGVKGFGF

SEQ ID NO: 291244 - protein, 8 aa, Influenza virus
VKGFGFKT

SEQ ID NO: 291245 - protein, 8 aa, Influenza virus
KGFGFKTG

SEQ ID NO: 291246 - protein, 8 aa, Influenza virus
GDDVWLGR

SEQ ID NO: 291247 - protein, 8 aa, Influenza virus
DDVWLGRT

SEQ ID NO: 291248 - protein, 8 aa, Influenza virus
WLGRTVSN

SEQ ID NO: 291249 - protein, 8 aa, Influenza virus
LGRTVSNS

SEQ ID NO: 291250 - protein, 8 aa, Influenza virus
GRTVSNSG

SEQ ID NO: 291251 - protein, 8 aa, Influenza virus
RTVSNSGR

SEQ ID NO: 291252 - protein, 8 aa, Influenza virus
TVSNSGRS

SEQ ID NO: 291253 - protein, 8 aa, Influenza virus
SGRSGFEV

SEQ ID NO: 291254 - protein, 8 aa, Influenza virus
GRSGFEVI

SEQ ID NO: 291255 - protein, 8 aa, Influenza virus
RSGFEVIK

SEQ ID NO: 291256 - protein, 8 aa, Influenza virus
SGFEVIKV

SEQ ID NO: 291257 - protein, 8 aa, Influenza virus
IRVAEGWI

SEQ ID NO: 291258 - protein, 8 aa, Influenza virus
VAEGWINS

SEQ ID NO: 291259 - protein, 8 aa, Influenza virus
AEGWINSP

SEQ ID NO: 291260 - protein, 8 aa, Influenza virus
EGWINSPS

SEQ ID NO: 291261 - protein, 8 aa, Influenza virus
GWINSPSQ

SEQ ID NO: 291262 - protein, 8 aa, Influenza virus
WINSPNHV

SEQ ID NO: 291263 - protein, 8 aa, Influenza virus
INSPNHVK

SEQ ID NO: 291264 - protein, 8 aa, Influenza virus
NSPNHVKS

SEQ ID NO: 291265 - protein, 8 aa, Influenza virus
AKSITQTL

SEQ ID NO: 291266 - protein, 8 aa, Influenza virus
KSVTQTLV

SEQ ID NO: 291267 - protein, 8 aa, Influenza virus
SVTQTLVS

SEQ ID NO: 291268 - protein, 8 aa, Influenza virus
VTQTLVSN

SEQ ID NO: 291269 - protein, 8 aa, Influenza virus
TQTLVSNS

SEQ ID NO: 291270 - protein, 8 aa, Influenza virus
QTLVSNSD

SEQ ID NO: 291271 - protein, 8 aa, Influenza virus
TLVSNSDW

SEQ ID NO: 291272 - protein, 8 aa, Influenza virus
LVSNDDWS

SEQ ID NO: 291273 - protein, 8 aa, Influenza virus
VSNDDWSG

SEQ ID NO: 291274 - protein, 8 aa, Influenza virus
SNDDWSGY

SEQ ID NO: 291275 - protein, 8 aa, Influenza virus
NSDWSGYS

SEQ ID NO: 291276 - protein, 8 aa, Influenza virus
SDWSGYSG

SEQ ID NO: 291277 - protein, 8 aa, Influenza virus
SGYSGSFV

SEQ ID NO: 291278 - protein, 8 aa, Influenza virus
GYSGSFII

SEQ ID NO: 291279 - protein, 8 aa, Influenza virus
NGCFQPCF

SEQ ID NO: 291280 - protein, 8 aa, Influenza virus
GCFQPCFY

SEQ ID NO: 291281 - protein, 8 aa, Influenza virus
CFQPCFYI

SEQ ID NO: 291282 - protein, 8 aa, Influenza virus
FQPCFYIE

SEQ ID NO: 291283 - protein, 8 aa, Influenza virus
QPCFYIEL

SEQ ID NO: 291284 - protein, 8 aa, Influenza virus
PCFYIELI

SEQ ID NO: 291285 - protein, 8 aa, Influenza virus
CFYIELIR

SEQ ID NO: 291286 - protein, 8 aa, Influenza virus
FYIELIRG

SEQ ID NO: 291287 - protein, 8 aa, Influenza virus
YIELIRGR

SEQ ID NO: 291288 - protein, 8 aa, Influenza virus
IELIRGRP

SEQ ID NO: 291289 - protein, 8 aa, Influenza virus
ELIRGKPN

SEQ ID NO: 291290 - protein, 8 aa, Influenza virus
NDNVSWTS

SEQ ID NO: 291291 - protein, 8 aa, Influenza virus
DNVSWTSN

SEQ ID NO: 291292 - protein, 8 aa, Influenza virus
NVSWTSNS

SEQ ID NO: 291293 - protein, 8 aa, Influenza virus
VSWASNSI

SEQ ID NO: 291294 - protein, 8 aa, Influenza virus
SWASNSIV

SEQ ID NO: 291295 - protein, 8 aa, Influenza virus
WASNSIVT

SEQ ID NO: 291296 - protein, 8 aa, Influenza virus
ASNSIVTF

SEQ ID NO: 291297 - protein, 8 aa, Influenza virus
IVTFCGLN

SEQ ID NO: 291298 - protein, 8 aa, Influenza virus
VTFCGLNN

SEQ ID NO: 291299 - protein, 8 aa, Influenza virus
TFCGLNNE

SEQ ID NO: 291300 - protein, 8 aa, Influenza virus
FCGLNNEP

SEQ ID NO: 291301 - protein, 8 aa, Influenza virus
CGLNNEPG

SEQ ID NO: 291302 - protein, 8 aa, Influenza virus
GLNNEPGS

SEQ ID NO: 291303 - protein, 8 aa, Influenza virus
LNNEPGSG

SEQ ID NO: 291304 - protein, 8 aa, Influenza virus
NNEPGSGN

SEQ ID NO: 291305 - protein, 8 aa, Influenza virus
NEPGSGHW

SEQ ID NO: 291306 - protein, 8 aa, Influenza virus
SGNWPDGA

SEQ ID NO: 291307 - protein, 8 aa, Influenza virus
GHWPDGSN

SEQ ID NO: 291308 - protein, 8 aa, Influenza virus
HWPDGSNI

SEQ ID NO: 291309 - protein, 8 aa, Influenza virus
WPDGSDIG

SEQ ID NO: 291310 - protein, 8 aa, Influenza virus
PDGANIGF

SEQ ID NO: 291311 - protein, 8 aa, Influenza virus
DGANIGFM

SEQ ID NO: 291312 - protein, 8 aa, Influenza virus
GSDIGFMP

SEQ ID NO: 291313 - protein, 8 aa, Influenza virus
SDIGFMPK

SEQ ID NO: 291314 - protein, 8 aa, Influenza virus
MKSRGYKM

SEQ ID NO: 291315 - protein, 8 aa, Influenza virus
SRGYKMNI

SEQ ID NO: 291316 - protein, 8 aa, Influenza virus
RGYKMNTK

SEQ ID NO: 291317 - protein, 8 aa, Influenza virus
GYKMNIQI

SEQ ID NO: 291318 - protein, 8 aa, Influenza virus
YKMNIQIL

SEQ ID NO: 291319 - protein, 8 aa, Influenza virus
KMNTKILV

SEQ ID NO: 291320 - protein, 8 aa, Influenza virus
RADKICLG

SEQ ID NO: 291321 - protein, 8 aa, Influenza virus
GDKICLGH

SEQ ID NO: 291322 - protein, 8 aa, Influenza virus
DKICLGRH

SEQ ID NO: 291323 - protein, 8 aa, Influenza virus
KICLGRHA

SEQ ID NO: 291324 - protein, 8 aa, Influenza virus
ICLGRHAV

SEQ ID NO: 291325 - protein, 8 aa, Influenza virus
NGTKVDTL

SEQ ID NO: 291326 - protein, 8 aa, Influenza virus
GTKVDTLT

SEQ ID NO: 291327 - protein, 8 aa, Influenza virus
TKVDTLTE

SEQ ID NO: 291328 - protein, 8 aa, Influenza virus
KVDTLTEK

SEQ ID NO: 291329 - protein, 8 aa, Influenza virus
VDTLTEKG

SEQ ID NO: 291330 - protein, 8 aa, Influenza virus
DTLTEKGI

SEQ ID NO: 291331 - protein, 8 aa, Influenza virus
TLTEKGIE

SEQ ID NO: 291332 - protein, 8 aa, Influenza virus
LTEKGIEV

SEQ ID NO: 291333 - protein, 8 aa, Influenza virus
TEKGIEVV

SEQ ID NO: 291334 - protein, 8 aa, Influenza virus
EKGIEVVN

SEQ ID NO: 291335 - protein, 8 aa, Influenza virus
KGIEVVNA

SEQ ID NO: 291336 - protein, 8 aa, Influenza virus
GIEVVNAT

SEQ ID NO: 291337 - protein, 8 aa, Influenza virus
IEVVNATE

SEQ ID NO: 291338 - protein, 8 aa, Influenza virus
NATETVEQ

SEQ ID NO: 291339 - protein, 8 aa, Influenza virus
DLGQCGFL

SEQ ID NO: 291340 - protein, 8 aa, Influenza virus
LGQCGFLG

SEQ ID NO: 291341 - protein, 8 aa, Influenza virus
GQCGLLGI

SEQ ID NO: 291342 - protein, 8 aa, Influenza virus
TIGPPQCD

SEQ ID NO: 291343 - protein, 8 aa, Influenza virus
IGPPQCDQ

SEQ ID NO: 291344 - protein, 8 aa, Influenza virus
GPPQCDLF

SEQ ID NO: 291345 - protein, 8 aa, Influenza virus
PPQCDLFL

SEQ ID NO: 291346 - protein, 8 aa, Influenza virus
PQCDLFLE

SEQ ID NO: 291347 - protein, 8 aa, Influenza virus
QCDLFLEF

SEQ ID NO: 291348 - protein, 8 aa, Influenza virus
NLIIERRE

SEQ ID NO: 291349 - protein, 8 aa, Influenza virus
LIVERREG

SEQ ID NO: 291350 - protein, 8 aa, Influenza virus
DICYPGKF

SEQ ID NO: 291351 - protein, 8 aa, Influenza virus
EETLRQIL

SEQ ID NO: 291352 - protein, 8 aa, Influenza virus
ETLRQILR

SEQ ID NO: 291353 - protein, 8 aa, Influenza virus
LRQILRKS

SEQ ID NO: 291354 - protein, 8 aa, Influenza virus
RQILRKSG

SEQ ID NO: 291355 - protein, 8 aa, Influenza virus
QILRKSGG

SEQ ID NO: 291356 - protein, 8 aa, Influenza virus
ILRKSGGI

SEQ ID NO: 291357 - protein, 8 aa, Influenza virus
MGFTYTGV

SEQ ID NO: 291358 - protein, 8 aa, Influenza virus
GFTYTGVR

SEQ ID NO: 291359 - protein, 8 aa, Influenza virus
FTYTGVRT

SEQ ID NO: 291360 - protein, 8 aa, Influenza virus
TYTGVRTN

SEQ ID NO: 291361 - protein, 8 aa, Influenza virus
YTGVRTNG

SEQ ID NO: 291362 - protein, 8 aa, Influenza virus
RSRSSFYA

SEQ ID NO: 291363 - protein, 8 aa, Influenza virus
SRSSFYAE

SEQ ID NO: 291364 - protein, 8 aa, Influenza virus
RSSFYAEM

SEQ ID NO: 291365 - protein, 8 aa, Influenza virus
SSFYAEME

SEQ ID NO: 291366 - protein, 8 aa, Influenza virus
SFYAEMEW

SEQ ID NO: 291367 - protein, 8 aa, Influenza virus
FYAEMEWL

SEQ ID NO: 291368 - protein, 8 aa, Influenza virus
YAEMEWLL

SEQ ID NO: 291369 - protein, 8 aa, Influenza virus
AEMEWLLS

SEQ ID NO: 291370 - protein, 8 aa, Influenza virus
EMKWLLSS

SEQ ID NO: 291371 - protein, 8 aa, Influenza virus
FPQTTKSY

SEQ ID NO: 291372 - protein, 8 aa, Influenza virus
PQTTKSYK

SEQ ID NO: 291373 - protein, 8 aa, Influenza virus
QTTKSYKN

SEQ ID NO: 291374 - protein, 8 aa, Influenza virus
TKSYKNTK

SEQ ID NO: 291375 - protein, 8 aa, Influenza virus
PALIVWGI

SEQ ID NO: 291376 - protein, 8 aa, Influenza virus
ALIVWGIH

SEQ ID NO: 291377 - protein, 8 aa, Influenza virus
LIVWGIHH

SEQ ID NO: 291378 - protein, 8 aa, Influenza virus
WGVHHSGS

SEQ ID NO: 291379 - protein, 8 aa, Influenza virus
EQTRLYGS

SEQ ID NO: 291380 - protein, 8 aa, Influenza virus
QTRLYGSG

SEQ ID NO: 291381 - protein, 8 aa, Influenza virus
LYGSGSKL

SEQ ID NO: 291382 - protein, 8 aa, Influenza virus
ITVGSSKY

SEQ ID NO: 291383 - protein, 8 aa, Influenza virus
TVWSSKYQ

SEQ ID NO: 291384 - protein, 8 aa, Influenza virus
VGSSKYQQ

SEQ ID NO: 291385 - protein, 8 aa, Influenza virus
GSSKYQQS

SEQ ID NO: 291386 - protein, 8 aa, Influenza virus
SSKYQQSF

SEQ ID NO: 291387 - protein, 8 aa, Influenza virus
RPQINGQS

SEQ ID NO: 291388 - protein, 8 aa, Influenza virus
PQINGQSG

SEQ ID NO: 291389 - protein, 8 aa, Influenza virus
QINGQSGR

SEQ ID NO: 291390 - protein, 8 aa, Influenza virus
INGQSGRI

SEQ ID NO: 291391 - protein, 8 aa, Influenza virus
QSGRIDFY

SEQ ID NO: 291392 - protein, 8 aa, Influenza virus
SGRIDFYW

SEQ ID NO: 291393 - protein, 8 aa, Influenza virus
GRIDFYWL

SEQ ID NO: 291394 - protein, 8 aa, Influenza virus
NDTVTFTF

SEQ ID NO: 291395 - protein, 8 aa, Influenza virus
DTVTFTFN

SEQ ID NO: 291396 - protein, 8 aa, Influenza virus
TVTFTFNG

SEQ ID NO: 291397 - protein, 8 aa, Influenza virus
VTFTFNGA

SEQ ID NO: 291398 - protein, 8 aa, Influenza virus
TFTFNGAF

SEQ ID NO: 291399 - protein, 8 aa, Influenza virus
FTFNGAFI

SEQ ID NO: 291400 - protein, 8 aa, Influenza virus
TFNGAFIA

SEQ ID NO: 291401 - protein, 8 aa, Influenza virus
FNGAFVAP

SEQ ID NO: 291402 - protein, 8 aa, Influenza virus
NGAFVAPD

SEQ ID NO: 291403 - protein, 8 aa, Influenza virus
GAFVAPDR

SEQ ID NO: 291404 - protein, 8 aa, Influenza virus
AFVAPDRV

SEQ ID NO: 291405 - protein, 8 aa, Influenza virus
FVAPDRVS

SEQ ID NO: 291406 - protein, 8 aa, Influenza virus
VAPDRVSF

SEQ ID NO: 291407 - protein, 8 aa, Influenza virus
CYHNGGTI

SEQ ID NO: 291408 - protein, 8 aa, Influenza virus
SSLPFQNI

SEQ ID NO: 291409 - protein, 8 aa, Influenza virus
SLPFQNIN

SEQ ID NO: 291410 - protein, 8 aa, Influenza virus
LPFQNINP

SEQ ID NO: 291411 - protein, 8 aa, Influenza virus
PFQNINPR

SEQ ID NO: 291412 - protein, 8 aa, Influenza virus
FQNINSRT

SEQ ID NO: 291413 - protein, 8 aa, Influenza virus
IGKCPRYV

SEQ ID NO: 291414 - protein, 8 aa, Influenza virus
GKCPKYVK

SEQ ID NO: 291415 - protein, 8 aa, Influenza virus
KCPKYVKQ

SEQ ID NO: 291416 - protein, 8 aa, Influenza virus
SLMLATGM

SEQ ID NO: 291417 - protein, 8 aa, Influenza virus
LMLATGMK

SEQ ID NO: 291418 - protein, 8 aa, Influenza virus
MLATGMKN

SEQ ID NO: 291419 - protein, 8 aa, Influenza virus
LATGMRNV

SEQ ID NO: 291420 - protein, 8 aa, Influenza virus
ATGMRNVP

SEQ ID NO: 291421 - protein, 8 aa, Influenza virus
TGMRNVPE

SEQ ID NO: 291422 - protein, 8 aa, Influenza virus
AHKQLTHH

SEQ ID NO: 291423 - protein, 8 aa, Influenza virus
KKKKKRGL

SEQ ID NO: 291424 - protein, 8 aa, Influenza virus
KRKKRGLF

SEQ ID NO: 291425 - protein, 8 aa, Influenza virus
KKREKRGL

SEQ ID NO: 291426 - protein, 8 aa, Influenza virus
RRRGLFGA

SEQ ID NO: 291427 - protein, 8 aa, Influenza virus
KGLFGAIA

SEQ ID NO: 291428 - protein, 8 aa, Influenza virus
ENGWEGLV

SEQ ID NO: 291429 - protein, 8 aa, Influenza virus
NGWEGLVD

SEQ ID NO: 291430 - protein, 8 aa, Influenza virus
GWEGLVDG

SEQ ID NO: 291431 - protein, 8 aa, Influenza virus
WEGLVDGW

SEQ ID NO: 291432 - protein, 8 aa, Influenza virus
EGLVDGWY

SEQ ID NO: 291433 - protein, 8 aa, Influenza virus
GLVDGWYG

SEQ ID NO: 291434 - protein, 8 aa, Influenza virus
LVDGWYGF

SEQ ID NO: 291435 - protein, 8 aa, Influenza virus
VDGWYGFR

SEQ ID NO: 291436 - protein, 8 aa, Influenza virus
DGWYGYRH

SEQ ID NO: 291437 - protein, 8 aa, Influenza virus
GWYGYRHQ

SEQ ID NO: 291438 - protein, 8 aa, Influenza virus
WYGYRHQN

SEQ ID NO: 291439 - protein, 8 aa, Influenza virus
YGYRHQNA

SEQ ID NO: 291440 - protein, 8 aa, Influenza virus
GYRHQNAQ

SEQ ID NO: 291441 - protein, 8 aa, Influenza virus
YRHQNAQG

SEQ ID NO: 291442 - protein, 8 aa, Influenza virus
KHQNAQGE

SEQ ID NO: 291443 - protein, 8 aa, Influenza virus
HQNSQGEG

SEQ ID NO: 291444 - protein, 8 aa, Influenza virus
QNSQGEGT

SEQ ID NO: 291445 - protein, 8 aa, Influenza virus
NSQGEGTA

SEQ ID NO: 291446 - protein, 8 aa, Influenza virus
SQGEGTAA

SEQ ID NO: 291447 - protein, 8 aa, Influenza virus
YKSTQSAV

SEQ ID NO: 291448 - protein, 8 aa, Influenza virus
KSTQSAIN

SEQ ID NO: 291449 - protein, 8 aa, Influenza virus
STQSAINQ

SEQ ID NO: 291450 - protein, 8 aa, Influenza virus
TQSAINQI

SEQ ID NO: 291451 - protein, 8 aa, Influenza virus
QSAINQIT

SEQ ID NO: 291452 - protein, 8 aa, Influenza virus
SAINQITG

SEQ ID NO: 291453 - protein, 8 aa, Influenza virus
AINQITGK

SEQ ID NO: 291454 - protein, 8 aa, Influenza virus
INQITGKL

SEQ ID NO: 291455 - protein, 8 aa, Influenza virus
NQITGKLN

SEQ ID NO: 291456 - protein, 8 aa, Influenza virus
QITRKLNR

SEQ ID NO: 291457 - protein, 8 aa, Influenza virus
ITGTLNRL

SEQ ID NO: 291458 - protein, 8 aa, Influenza virus
TRKLNRLI

SEQ ID NO: 291459 - protein, 8 aa, Influenza virus
GKLNRLID

SEQ ID NO: 291460 - protein, 8 aa, Influenza virus
KLNRLIDK

SEQ ID NO: 291461 - protein, 8 aa, Influenza virus
LNRLIDKT

SEQ ID NO: 291462 - protein, 8 aa, Influenza virus
NRLIDKTN

SEQ ID NO: 291463 - protein, 8 aa, Influenza virus
RLIDKTNQ

SEQ ID NO: 291464 - protein, 8 aa, Influenza virus
LIDKTNQQ

SEQ ID NO: 291465 - protein, 8 aa, Influenza virus
IDKTNQQF

SEQ ID NO: 291466 - protein, 8 aa, Influenza virus
DKTNQQFE

SEQ ID NO: 291467 - protein, 8 aa, Influenza virus
RTNQQFEL

SEQ ID NO: 291468 - protein, 8 aa, Influenza virus
TNQQFEMI

SEQ ID NO: 291469 - protein, 8 aa, Influenza virus
NQQFEMID

SEQ ID NO: 291470 - protein, 8 aa, Influenza virus
QQFEMIDN

SEQ ID NO: 291471 - protein, 8 aa, Influenza virus
QFEMIDNE

SEQ ID NO: 291472 - protein, 8 aa, Influenza virus
FEMIDNEF

SEQ ID NO: 291473 - protein, 8 aa, Influenza virus
ELIDNEFN

SEQ ID NO: 291474 - protein, 8 aa, Influenza virus
LIDNEFNE

SEQ ID NO: 291475 - protein, 8 aa, Influenza virus
IDNEFNEI

SEQ ID NO: 291476 - protein, 8 aa, Influenza virus
DNEFNEIE

SEQ ID NO: 291477 - protein, 8 aa, Influenza virus
EIEKQIGN

SEQ ID NO: 291478 - protein, 8 aa, Influenza virus
IEKQIGNV

SEQ ID NO: 291479 - protein, 8 aa, Influenza virus
EQQIGNVI

SEQ ID NO: 291480 - protein, 8 aa, Influenza virus
QQIGNVIN

SEQ ID NO: 291481 - protein, 8 aa, Influenza virus
QLGNVINW

SEQ ID NO: 291482 - protein, 8 aa, Influenza virus
LGNVINWT

SEQ ID NO: 291483 - protein, 8 aa, Influenza virus
INWTRDSI

SEQ ID NO: 291484 - protein, 8 aa, Influenza virus
NWTRDSIT

SEQ ID NO: 291485 - protein, 8 aa, Influenza virus
WTRDSITE

SEQ ID NO: 291486 - protein, 8 aa, Influenza virus
IEVWSYNA

SEQ ID NO: 291487 - protein, 8 aa, Influenza virus
EIWSYNAE

SEQ ID NO: 291488 - protein, 8 aa, Influenza virus
VWSYNAEF

SEQ ID NO: 291489 - protein, 8 aa, Influenza virus
WSYNAEFL

SEQ ID NO: 291490 - protein, 8 aa, Influenza virus
SYNAEFLV

SEQ ID NO: 291491 - protein, 8 aa, Influenza virus
YNAEFLVA

SEQ ID NO: 291492 - protein, 8 aa, Influenza virus
NAEFLVAV

SEQ ID NO: 291493 - protein, 8 aa, Influenza virus
AEFLVAVE

SEQ ID NO: 291494 - protein, 8 aa, Influenza virus
EFLVAVEN

SEQ ID NO: 291495 - protein, 8 aa, Influenza virus
FLVAVENQ

SEQ ID NO: 291496 - protein, 8 aa, Influenza virus
LVAVENQH

SEQ ID NO: 291497 - protein, 8 aa, Influenza virus
VAVENQHT

SEQ ID NO: 291498 - protein, 8 aa, Influenza virus
AVENQHTI

SEQ ID NO: 291499 - protein, 8 aa, Influenza virus
VENQHTID

SEQ ID NO: 291500 - protein, 8 aa, Influenza virus
ENQHIIDL

SEQ ID NO: 291501 - protein, 8 aa, Influenza virus
NQHTIDLT

SEQ ID NO: 291502 - protein, 8 aa, Influenza virus
QHTIDLTD

SEQ ID NO: 291503 - protein, 8 aa, Influenza virus
HTIDLTDS

SEQ ID NO: 291504 - protein, 8 aa, Influenza virus
TIDLTDSE

SEQ ID NO: 291505 - protein, 8 aa, Influenza virus
IDLTDSEM

SEQ ID NO: 291506 - protein, 8 aa, Influenza virus
DLTDSEMN

SEQ ID NO: 291507 - protein, 8 aa, Influenza virus
LTDSEMNK

SEQ ID NO: 291508 - protein, 8 aa, Influenza virus
TDSEMNKL

SEQ ID NO: 291509 - protein, 8 aa, Influenza virus
ESEMNKLY

SEQ ID NO: 291510 - protein, 8 aa, Influenza virus
EMNKLYEK

SEQ ID NO: 291511 - protein, 8 aa, Influenza virus
MNKLYEKV

SEQ ID NO: 291512 - protein, 8 aa, Influenza virus
NKLYERVK

SEQ ID NO: 291513 - protein, 8 aa, Influenza virus
KLYERVRR

SEQ ID NO: 291514 - protein, 8 aa, Influenza virus
LYERVRRQ

SEQ ID NO: 291515 - protein, 8 aa, Influenza virus
YERVRRQL

SEQ ID NO: 291516 - protein, 8 aa, Influenza virus
ERVRRQLR

SEQ ID NO: 291517 - protein, 8 aa, Influenza virus
RVRRQLRE

SEQ ID NO: 291518 - protein, 8 aa, Influenza virus
VKRQLREN

SEQ ID NO: 291519 - protein, 8 aa, Influenza virus
KRQLRENA

SEQ ID NO: 291520 - protein, 8 aa, Influenza virus
KQLRENAE

SEQ ID NO: 291521 - protein, 8 aa, Influenza virus
RENAEEDC

SEQ ID NO: 291522 - protein, 8 aa, Influenza virus
ENAEEDGN

SEQ ID NO: 291523 - protein, 8 aa, Influenza virus
NAEEDGNG

SEQ ID NO: 291524 - protein, 8 aa, Influenza virus
AEEDGNGC

SEQ ID NO: 291525 - protein, 8 aa, Influenza virus
EEDGNGCF

SEQ ID NO: 291526 - protein, 8 aa, Influenza virus
EDGNGCFE

SEQ ID NO: 291527 - protein, 8 aa, Influenza virus
DGNGCFEI

SEQ ID NO: 291528 - protein, 8 aa, Influenza virus
GNGCFEIF

SEQ ID NO: 291529 - protein, 8 aa, Influenza virus
NGCFEIFH

SEQ ID NO: 291530 - protein, 8 aa, Influenza virus
GCFEIFHQ

SEQ ID NO: 291531 - protein, 8 aa, Influenza virus
CFEIFHQC

SEQ ID NO: 291532 - protein, 8 aa, Influenza virus
FEIFHQCD

SEQ ID NO: 291533 - protein, 8 aa, Influenza virus
EIFHQCDN

SEQ ID NO: 291534 - protein, 8 aa, Influenza virus
IFHQCDND

SEQ ID NO: 291535 - protein, 8 aa, Influenza virus
FHQCDNDC

SEQ ID NO: 291536 - protein, 8 aa, Influenza virus
HQCDNDCM

SEQ ID NO: 291537 - protein, 8 aa, Influenza virus
CMESIRNN

SEQ ID NO: 291538 - protein, 8 aa, Influenza virus
MESIRNNT

SEQ ID NO: 291539 - protein, 8 aa, Influenza virus
ESIRNNTY

SEQ ID NO: 291540 - protein, 8 aa, Influenza virus
NIRNNTYD

SEQ ID NO: 291541 - protein, 8 aa, Influenza virus
RNNTYDHK

SEQ ID NO: 291542 - protein, 8 aa, Influenza virus
NNTYDHKK

SEQ ID NO: 291543 - protein, 8 aa, Influenza virus
NTYDHKKY

SEQ ID NO: 291544 - protein, 8 aa, Influenza virus
TYDHKKYR

SEQ ID NO: 291545 - protein, 8 aa, Influenza virus
AIQNRIQI

SEQ ID NO: 291546 - protein, 8 aa, Influenza virus
QNRIQIDA

SEQ ID NO: 291547 - protein, 8 aa, Influenza virus
NRIQIDAV

SEQ ID NO: 291548 - protein, 8 aa, Influenza virus
IQIDAVKL

SEQ ID NO: 291549 - protein, 8 aa, Influenza virus
QIDAVKLS

SEQ ID NO: 291550 - protein, 8 aa, Influenza virus
IDAVKLSS

SEQ ID NO: 291551 - protein, 8 aa, Influenza virus
DAVKLSSG

SEQ ID NO: 291552 - protein, 8 aa, Influenza virus
AVKLSSGY

SEQ ID NO: 291553 - protein, 8 aa, Influenza virus
VKLSGGYK

SEQ ID NO: 291554 - protein, 8 aa, Influenza virus
KLSSGYKE

SEQ ID NO: 291555 - protein, 8 aa, Influenza virus
LSSGYKDI

SEQ ID NO: 291556 - protein, 8 aa, Influenza virus
SSGYKDII

SEQ ID NO: 291557 - protein, 8 aa, Influenza virus
SGYKDIIL

SEQ ID NO: 291558 - protein, 8 aa, Influenza virus
GYKDIILW

SEQ ID NO: 291559 - protein, 8 aa, Influenza virus
YKDIILWF

SEQ ID NO: 291560 - protein, 8 aa, Influenza virus
KDIILWFS

SEQ ID NO: 291561 - protein, 8 aa, Influenza virus
DIILWFSF

SEQ ID NO: 291562 - protein, 8 aa, Influenza virus
IILWFSFG

SEQ ID NO: 291563 - protein, 8 aa, Influenza virus
ILWFSLGA

SEQ ID NO: 291564 - protein, 8 aa, Influenza virus
LWFSLGAS

SEQ ID NO: 291565 - protein, 8 aa, Influenza virus
WFSLGASC

SEQ ID NO: 291566 - protein, 8 aa, Influenza virus
FSLGASCF

SEQ ID NO: 291567 - protein, 8 aa, Influenza virus
SFGASCFL

SEQ ID NO: 291568 - protein, 8 aa, Influenza virus
FGASCFLL

SEQ ID NO: 291569 - protein, 8 aa, Influenza virus
GASCFLLL

SEQ ID NO: 291570 - protein, 8 aa, Influenza virus
ASCFLLLA

SEQ ID NO: 291571 - protein, 8 aa, Influenza virus
SCFLLLAI

SEQ ID NO: 291572 - protein, 8 aa, Influenza virus
LVFMCVKN

SEQ ID NO: 291573 - protein, 8 aa, Influenza virus
VFMCVKNG

SEQ ID NO: 291574 - protein, 8 aa, Influenza virus
FMCVKNGN

SEQ ID NO: 291575 - protein, 8 aa, Influenza virus
MCVKNGNM

SEQ ID NO: 291576 - protein, 8 aa, Influenza virus
CIKNGNMR

SEQ ID NO: 291577 - protein, 8 aa, Influenza virus
IKNGNMRC

SEQ ID NO: 291578 - protein, 8 aa, Influenza virus
KNGNMQCT

SEQ ID NO: 291579 - protein, 8 aa, Influenza virus
NGNMQCTI

SEQ ID NO: 291580 - protein, 8 aa, Influenza virus
GNMQCTIC

SEQ ID NO: 291581 - protein, 8 aa, Influenza virus
NMQCTICI

SEQ ID NO: 291582 - protein, 8 aa, Influenza virus
MNPSQKLF

SEQ ID NO: 291583 - protein, 8 aa, Influenza virus
NPSQKLFA

SEQ ID NO: 291584 - protein, 8 aa, Influenza virus
PNQKLFAS

SEQ ID NO: 291585 - protein, 8 aa, Influenza virus
NQKLFASS

SEQ ID NO: 291586 - protein, 8 aa, Influenza virus
QKLFASSG

SEQ ID NO: 291587 - protein, 8 aa, Influenza virus
KLFASSGI

SEQ ID NO: 291588 - protein, 8 aa, Influenza virus
LFASSGIA

SEQ ID NO: 291589 - protein, 8 aa, Influenza virus
FASSGIAI

SEQ ID NO: 291590 - protein, 8 aa, Influenza virus
ASSGIAIV

SEQ ID NO: 291591 - protein, 8 aa, Influenza virus
SSGIAIVL

SEQ ID NO: 291592 - protein, 8 aa, Influenza virus
SGIAIVLG

SEQ ID NO: 291593 - protein, 8 aa, Influenza virus
GVAIALSI

SEQ ID NO: 291594 - protein, 8 aa, Influenza virus
VAIALSIL

SEQ ID NO: 291595 - protein, 8 aa, Influenza virus
AIALSILN

SEQ ID NO: 291596 - protein, 8 aa, Influenza virus
IALSILNL

SEQ ID NO: 291597 - protein, 8 aa, Influenza virus
ALSILNLL

SEQ ID NO: 291598 - protein, 8 aa, Influenza virus
LSILNLLI

SEQ ID NO: 291599 - protein, 8 aa, Influenza virus
SILNLLIG

SEQ ID NO: 291600 - protein, 8 aa, Influenza virus
ILNLLIGI

SEQ ID NO: 291601 - protein, 8 aa, Influenza virus
INLLIGIS

SEQ ID NO: 291602 - protein, 8 aa, Influenza virus
NLLIGVSN

SEQ ID NO: 291603 - protein, 8 aa, Influenza virus
LLIGISNM

SEQ ID NO: 291604 - protein, 8 aa, Influenza virus
LIGISNMS

SEQ ID NO: 291605 - protein, 8 aa, Influenza virus
IGISNMSL

SEQ ID NO: 291606 - protein, 8 aa, Influenza virus
GISNMSLN

SEQ ID NO: 291607 - protein, 8 aa, Influenza virus
SNMSLNIS

SEQ ID NO: 291608 - protein, 8 aa, Influenza virus
NMSLNISL

SEQ ID NO: 291609 - protein, 8 aa, Influenza virus
MSLNISLY

SEQ ID NO: 291610 - protein, 8 aa, Influenza virus
SLNISLYS

SEQ ID NO: 291611 - protein, 8 aa, Influenza virus
LNISLYSK

SEQ ID NO: 291612 - protein, 8 aa, Influenza virus
KNTYVNNT

SEQ ID NO: 291613 - protein, 8 aa, Influenza virus
NTYINNAT

SEQ ID NO: 291614 - protein, 8 aa, Influenza virus
TYVNNTTV

SEQ ID NO: 291615 - protein, 8 aa, Influenza virus
YVNNTTVI

SEQ ID NO: 291616 - protein, 8 aa, Influenza virus
NYLMLNKS

SEQ ID NO: 291617 - protein, 8 aa, Influenza virus
YLMLNKSL

SEQ ID NO: 291618 - protein, 8 aa, Influenza virus
LMLNKSLC

SEQ ID NO: 291619 - protein, 8 aa, Influenza virus
MLNKSLCK

SEQ ID NO: 291620 - protein, 8 aa, Influenza virus
LNKSLCKV

SEQ ID NO: 291621 - protein, 8 aa, Influenza virus
NKSLCKVE

SEQ ID NO: 291622 - protein, 8 aa, Influenza virus
KSLCKVEG

SEQ ID NO: 291623 - protein, 8 aa, Influenza virus
SLCKVEGW

SEQ ID NO: 291624 - protein, 8 aa, Influenza virus
LCKVEGWV

SEQ ID NO: 291625 - protein, 8 aa, Influenza virus
CKVEGWVV

SEQ ID NO: 291626 - protein, 8 aa, Influenza virus
KVEGWVVV

SEQ ID NO: 291627 - protein, 8 aa, Influenza virus
VEGWVVVA

SEQ ID NO: 291628 - protein, 8 aa, Influenza virus
EGWVVVAK

SEQ ID NO: 291629 - protein, 8 aa, Influenza virus
GWVVVAKD

SEQ ID NO: 291630 - protein, 8 aa, Influenza virus
WVVVAKDN

SEQ ID NO: 291631 - protein, 8 aa, Influenza virus
VVVAKDNA

SEQ ID NO: 291632 - protein, 8 aa, Influenza virus
VVAKDNAI

SEQ ID NO: 291633 - protein, 8 aa, Influenza virus
VAKDNAIR

SEQ ID NO: 291634 - protein, 8 aa, Influenza virus
AKDNAIRF

SEQ ID NO: 291635 - protein, 8 aa, Influenza virus
KDNAIRFG

SEQ ID NO: 291636 - protein, 8 aa, Influenza virus
DNAIRFGE

SEQ ID NO: 291637 - protein, 8 aa, Influenza virus
NAIRFGES

SEQ ID NO: 291638 - protein, 8 aa, Influenza virus
AIRFGESE

SEQ ID NO: 291639 - protein, 8 aa, Influenza virus
IRFGESEQ

SEQ ID NO: 291640 - protein, 8 aa, Influenza virus
RFGESEQV

SEQ ID NO: 291641 - protein, 8 aa, Influenza virus
FGESEQVI

SEQ ID NO: 291642 - protein, 8 aa, Influenza virus
GESEQVIV

SEQ ID NO: 291643 - protein, 8 aa, Influenza virus
ESEQVIVT

SEQ ID NO: 291644 - protein, 8 aa, Influenza virus
SEQVIVTR

SEQ ID NO: 291645 - protein, 8 aa, Influenza virus
EQVIVTRE

SEQ ID NO: 291646 - protein, 8 aa, Influenza virus
QVIVTREP

SEQ ID NO: 291647 - protein, 8 aa, Influenza virus
VIVTREPY

SEQ ID NO: 291648 - protein, 8 aa, Influenza virus
VVTREPYV

SEQ ID NO: 291649 - protein, 8 aa, Influenza virus
PYVSCDPL

SEQ ID NO: 291650 - protein, 8 aa, Influenza virus
SCKMYALH

SEQ ID NO: 291651 - protein, 8 aa, Influenza virus
CRMYALHQ

SEQ ID NO: 291652 - protein, 8 aa, Influenza virus
RMYALHQG

SEQ ID NO: 291653 - protein, 8 aa, Influenza virus
IRNKHSNS

SEQ ID NO: 291654 - protein, 8 aa, Influenza virus
RNKHSNST

SEQ ID NO: 291655 - protein, 8 aa, Influenza virus
NKHSNSTT

SEQ ID NO: 291656 - protein, 8 aa, Influenza virus
KHSNSTTH

SEQ ID NO: 291657 - protein, 8 aa, Influenza virus
HSNSTTHD

SEQ ID NO: 291658 - protein, 8 aa, Influenza virus
SNSTTHDR

SEQ ID NO: 291659 - protein, 8 aa, Influenza virus
NSTTHDRT

SEQ ID NO: 291660 - protein, 8 aa, Influenza virus
STTHDRTA

SEQ ID NO: 291661 - protein, 8 aa, Influenza virus
TTHDRTAF

SEQ ID NO: 291662 - protein, 8 aa, Influenza virus
THDRTAFR

SEQ ID NO: 291663 - protein, 8 aa, Influenza virus
HDRTTFRG

SEQ ID NO: 291664 - protein, 8 aa, Influenza virus
DRTTFRGL

SEQ ID NO: 291665 - protein, 8 aa, Influenza virus
RTTFRGLL

SEQ ID NO: 291666 - protein, 8 aa, Influenza virus
AAFRGLIS

SEQ ID NO: 291667 - protein, 8 aa, Influenza virus
TFRGLIST

SEQ ID NO: 291668 - protein, 8 aa, Influenza virus
FRGLISTH

SEQ ID NO: 291669 - protein, 8 aa, Influenza virus
RGLISTHL

SEQ ID NO: 291670 - protein, 8 aa, Influenza virus
GLISTHLG

SEQ ID NO: 291671 - protein, 8 aa, Influenza virus
SNSDFICV

SEQ ID NO: 291672 - protein, 8 aa, Influenza virus
NSDFICVG

SEQ ID NO: 291673 - protein, 8 aa, Influenza virus
SDFICVGW

SEQ ID NO: 291674 - protein, 8 aa, Influenza virus
DFICVGWS

SEQ ID NO: 291675 - protein, 8 aa, Influenza virus
FICVGWSS

SEQ ID NO: 291676 - protein, 8 aa, Influenza virus
ICVGWSST

SEQ ID NO: 291677 - protein, 8 aa, Influenza virus
CVGWSSTS

SEQ ID NO: 291678 - protein, 8 aa, Influenza virus
VGWSSTSC

SEQ ID NO: 291679 - protein, 8 aa, Influenza virus
GWSSTSCH

SEQ ID NO: 291680 - protein, 8 aa, Influenza virus
WSSTSCHD

SEQ ID NO: 291681 - protein, 8 aa, Influenza virus
SSTSCHDG

SEQ ID NO: 291682 - protein, 8 aa, Influenza virus
STSCHDGI

SEQ ID NO: 291683 - protein, 8 aa, Influenza virus
CHDGVGRM

SEQ ID NO: 291684 - protein, 8 aa, Influenza virus
HDGVGRMT

SEQ ID NO: 291685 - protein, 8 aa, Influenza virus
DGVGRMTI

SEQ ID NO: 291686 - protein, 8 aa, Influenza virus
GVGRMTIC

SEQ ID NO: 291687 - protein, 8 aa, Influenza virus
GRMTICVQ

SEQ ID NO: 291688 - protein, 8 aa, Influenza virus
RMTICVQG

SEQ ID NO: 291689 - protein, 8 aa, Influenza virus
MTICVQGN

SEQ ID NO: 291690 - protein, 8 aa, Influenza virus
TICVQGNN

SEQ ID NO: 291691 - protein, 8 aa, Influenza virus
QGDNENAT

SEQ ID NO: 291692 - protein, 8 aa, Influenza virus
GDNENATA

SEQ ID NO: 291693 - protein, 8 aa, Influenza virus
DNENATAT

SEQ ID NO: 291694 - protein, 8 aa, Influenza virus
NENATATV

SEQ ID NO: 291695 - protein, 8 aa, Influenza virus
ENATATVY

SEQ ID NO: 291696 - protein, 8 aa, Influenza virus
ATATVYYD

SEQ ID NO: 291697 - protein, 8 aa, Influenza virus
TATVYYDR

SEQ ID NO: 291698 - protein, 8 aa, Influenza virus
ATVYYDRR

SEQ ID NO: 291699 - protein, 8 aa, Influenza virus
TVYYDRRL

SEQ ID NO: 291700 - protein, 8 aa, Influenza virus
VYYDRRLT

SEQ ID NO: 291701 - protein, 8 aa, Influenza virus
YYDRRLTT

SEQ ID NO: 291702 - protein, 8 aa, Influenza virus
YDRRLTTT

SEQ ID NO: 291703 - protein, 8 aa, Influenza virus
DRRLTTTI

SEQ ID NO: 291704 - protein, 8 aa, Influenza virus
KRLTTTIK

SEQ ID NO: 291705 - protein, 8 aa, Influenza virus
RLTTTIRT

SEQ ID NO: 291706 - protein, 8 aa, Influenza virus
LTTTIRTW

SEQ ID NO: 291707 - protein, 8 aa, Influenza virus
TTTVKTWA

SEQ ID NO: 291708 - protein, 8 aa, Influenza virus
TTIKTWAK

SEQ ID NO: 291709 - protein, 8 aa, Influenza virus
TIKTWAKN

SEQ ID NO: 291710 - protein, 8 aa, Influenza virus
IKTWAKNI

SEQ ID NO: 291711 - protein, 8 aa, Influenza virus
KTWAKNIL

SEQ ID NO: 291712 - protein, 8 aa, Influenza virus
TWAKNILR

SEQ ID NO: 291713 - protein, 8 aa, Influenza virus
WAKNILRT

SEQ ID NO: 291714 - protein, 8 aa, Influenza virus
AKNILRTQ

SEQ ID NO: 291715 - protein, 8 aa, Influenza virus
KNILRTQE

SEQ ID NO: 291716 - protein, 8 aa, Influenza virus
NILRTQDS

SEQ ID NO: 291717 - protein, 8 aa, Influenza virus
ILRTQDSE

SEQ ID NO: 291718 - protein, 8 aa, Influenza virus
LRTQDSEC

SEQ ID NO: 291719 - protein, 8 aa, Influenza virus
RTQDSECV

SEQ ID NO: 291720 - protein, 8 aa, Influenza virus
TQESECVR

SEQ ID NO: 291721 - protein, 8 aa, Influenza virus
QESECVRH

SEQ ID NO: 291722 - protein, 8 aa, Influenza virus
ESECVRHN

SEQ ID NO: 291723 - protein, 8 aa, Influenza virus
SECVCHNS

SEQ ID NO: 291724 - protein, 8 aa, Influenza virus
ECVCHNST

SEQ ID NO: 291725 - protein, 8 aa, Influenza virus
CVCHNSTC

SEQ ID NO: 291726 - protein, 8 aa, Influenza virus
VCHNGTCV

SEQ ID NO: 291727 - protein, 8 aa, Influenza virus
CHNGTCVV

SEQ ID NO: 291728 - protein, 8 aa, Influenza virus
HNSTCVVV

SEQ ID NO: 291729 - protein, 8 aa, Influenza virus
NSTCVVVM

SEQ ID NO: 291730 - protein, 8 aa, Influenza virus
STCVVVMT

SEQ ID NO: 291731 - protein, 8 aa, Influenza virus
TCVVVMTD

SEQ ID NO: 291732 - protein, 8 aa, Influenza virus
CVVVMTDG

SEQ ID NO: 291733 - protein, 8 aa, Influenza virus
VVVMTDGP

SEQ ID NO: 291734 - protein, 8 aa, Influenza virus
VVMTDGPA

SEQ ID NO: 291735 - protein, 8 aa, Influenza virus
VMTDGPAN

SEQ ID NO: 291736 - protein, 8 aa, Influenza virus
MTDGPANN

SEQ ID NO: 291737 - protein, 8 aa, Influenza virus
TDGPANNQ

SEQ ID NO: 291738 - protein, 8 aa, Influenza virus
DGPANNQA

SEQ ID NO: 291739 - protein, 8 aa, Influenza virus
ANNQAFTK

SEQ ID NO: 291740 - protein, 8 aa, Influenza virus
LKGSAKHI

SEQ ID NO: 291741 - protein, 8 aa, Influenza virus
KGSAKHIE

SEQ ID NO: 291742 - protein, 8 aa, Influenza virus
GSAKHIEE

SEQ ID NO: 291743 - protein, 8 aa, Influenza virus
SAKHIEEC

SEQ ID NO: 291744 - protein, 8 aa, Influenza virus
AKHIEECS

SEQ ID NO: 291745 - protein, 8 aa, Influenza virus
KHIEECSC

SEQ ID NO: 291746 - protein, 8 aa, Influenza virus
HIEEWSCY

SEQ ID NO: 291747 - protein, 8 aa, Influenza virus
IEEWSCYG

SEQ ID NO: 291748 - protein, 8 aa, Influenza virus
EEWSCYGH

SEQ ID NO: 291749 - protein, 8 aa, Influenza virus
ECSCYGHS

SEQ ID NO: 291750 - protein, 8 aa, Influenza virus
ATCVCRDN

SEQ ID NO: 291751 - protein, 8 aa, Influenza virus
SCVCRDNW

SEQ ID NO: 291752 - protein, 8 aa, Influenza virus
CGCRDNWQ

SEQ ID NO: 291753 - protein, 8 aa, Influenza virus
GCRDNWQG

SEQ ID NO: 291754 - protein, 8 aa, Influenza virus
WQGANRPV

SEQ ID NO: 291755 - protein, 8 aa, Influenza virus
QGANRPVI

SEQ ID NO: 291756 - protein, 8 aa, Influenza virus
GANRPVIE

SEQ ID NO: 291757 - protein, 8 aa, Influenza virus
ANRPVIEI

SEQ ID NO: 291758 - protein, 8 aa, Influenza virus
NRPVIEID

SEQ ID NO: 291759 - protein, 8 aa, Influenza virus
RPVIEIDM

SEQ ID NO: 291760 - protein, 8 aa, Influenza virus
PVIEIDMN

SEQ ID NO: 291761 - protein, 8 aa, Influenza virus
LEHTSRYI

SEQ ID NO: 291762 - protein, 8 aa, Influenza virus
EHTSRYIC

SEQ ID NO: 291763 - protein, 8 aa, Influenza virus
HTSQYLCT

SEQ ID NO: 291764 - protein, 8 aa, Influenza virus
TSRYICTG

SEQ ID NO: 291765 - protein, 8 aa, Influenza virus
YLCTGVLT

SEQ ID NO: 291766 - protein, 8 aa, Influenza virus
LCTGVLTD

SEQ ID NO: 291767 - protein, 8 aa, Influenza virus
CTGVLTDT

SEQ ID NO: 291768 - protein, 8 aa, Influenza virus
TGVLTDTS

SEQ ID NO: 291769 - protein, 8 aa, Influenza virus
GVLTDTSR

SEQ ID NO: 291770 - protein, 8 aa, Influenza virus
VLTDTSRP

SEQ ID NO: 291771 - protein, 8 aa, Influenza virus
LTDTSRPS

SEQ ID NO: 291772 - protein, 8 aa, Influenza virus
TDTSRPSD

SEQ ID NO: 291773 - protein, 8 aa, Influenza virus
DTSRPSDK

SEQ ID NO: 291774 - protein, 8 aa, Influenza virus
GDCNNPIT

SEQ ID NO: 291775 - protein, 8 aa, Influenza virus
DCNNPITG

SEQ ID NO: 291776 - protein, 8 aa, Influenza virus
CNNPITGS

SEQ ID NO: 291777 - protein, 8 aa, Influenza virus
NNPITGSP

SEQ ID NO: 291778 - protein, 8 aa, Influenza virus
NPITGSPC

SEQ ID NO: 291779 - protein, 8 aa, Influenza virus
PITGSPGV

SEQ ID NO: 291780 - protein, 8 aa, Influenza virus
ITGSPGVP

SEQ ID NO: 291781 - protein, 8 aa, Influenza virus
TGSPGVPG

SEQ ID NO: 291782 - protein, 8 aa, Influenza virus
APGIKGFG

SEQ ID NO: 291783 - protein, 8 aa, Influenza virus
PGIKGFGF

SEQ ID NO: 291784 - protein, 8 aa, Influenza virus
GIKGFGFL

SEQ ID NO: 291785 - protein, 8 aa, Influenza virus
VKGFGFLD

SEQ ID NO: 291786 - protein, 8 aa, Influenza virus
KGFGFLDS

SEQ ID NO: 291787 - protein, 8 aa, Influenza virus
GNTWLGRT

SEQ ID NO: 291788 - protein, 8 aa, Influenza virus
STWLGRTI

SEQ ID NO: 291789 - protein, 8 aa, Influenza virus
LGRTISPK

SEQ ID NO: 291790 - protein, 8 aa, Influenza virus
GRTISPRL

SEQ ID NO: 291791 - protein, 8 aa, Influenza virus
RTISPRLR

SEQ ID NO: 291792 - protein, 8 aa, Influenza virus
TISPRLRS

SEQ ID NO: 291793 - protein, 8 aa, Influenza virus
ISPRLRSG

SEQ ID NO: 291794 - protein, 8 aa, Influenza virus
SPRLRSGF

SEQ ID NO: 291795 - protein, 8 aa, Influenza virus
PRLRSGFE

SEQ ID NO: 291796 - protein, 8 aa, Influenza virus
RLRSGFEM

SEQ ID NO: 291797 - protein, 8 aa, Influenza virus
LRSGFEML

SEQ ID NO: 291798 - protein, 8 aa, Influenza virus
RSGFEMLR

SEQ ID NO: 291799 - protein, 8 aa, Influenza virus
NGFEMLKI

SEQ ID NO: 291800 - protein, 8 aa, Influenza virus
GFEMLKIH

SEQ ID NO: 291801 - protein, 8 aa, Influenza virus
FEMLKIHN

SEQ ID NO: 291802 - protein, 8 aa, Influenza virus
EMLKIHNA

SEQ ID NO: 291803 - protein, 8 aa, Influenza virus
MLKIPNAE

SEQ ID NO: 291804 - protein, 8 aa, Influenza virus
LKIPNAET

SEQ ID NO: 291805 - protein, 8 aa, Influenza virus
KIPNAETD

SEQ ID NO: 291806 - protein, 8 aa, Influenza virus
IPNAGIDP

SEQ ID NO: 291807 - protein, 8 aa, Influenza virus
NAGTDPES

SEQ ID NO: 291808 - protein, 8 aa, Influenza virus
ERQEIVSN

SEQ ID NO: 291809 - protein, 8 aa, Influenza virus
RQEIVSND

SEQ ID NO: 291810 - protein, 8 aa, Influenza virus
QEIVSNDN

SEQ ID NO: 291811 - protein, 8 aa, Influenza virus
EIVSNDNW

SEQ ID NO: 291812 - protein, 8 aa, Influenza virus
IVSNDNWS

SEQ ID NO: 291813 - protein, 8 aa, Influenza virus
VSNDNWSG

SEQ ID NO: 291814 - protein, 8 aa, Influenza virus
SNDNWSGY

SEQ ID NO: 291815 - protein, 8 aa, Influenza virus
NDNWSGYS

SEQ ID NO: 291816 - protein, 8 aa, Influenza virus
DNWSGYSG

SEQ ID NO: 291817 - protein, 8 aa, Influenza virus
NRSGYSGS

SEQ ID NO: 291818 - protein, 8 aa, Influenza virus
RSGYSGSF

SEQ ID NO: 291819 - protein, 8 aa, Influenza virus
GSFIDYWD

SEQ ID NO: 291820 - protein, 8 aa, Influenza virus
SFIDYWDE

SEQ ID NO: 291821 - protein, 8 aa, Influenza virus
NECYNPCF

SEQ ID NO: 291822 - protein, 8 aa, Influenza virus
PEEAKYVE

SEQ ID NO: 291823 - protein, 8 aa, Influenza virus
EEAKYVEW

SEQ ID NO: 291824 - protein, 8 aa, Influenza virus
EAKYVEWT

SEQ ID NO: 291825 - protein, 8 aa, Influenza virus
AKYVEWTS

SEQ ID NO: 291826 - protein, 8 aa, Influenza virus
KYVEWTSN

SEQ ID NO: 291827 - protein, 8 aa, Influenza virus
YVEWTSNS

SEQ ID NO: 291828 - protein, 8 aa, Influenza virus
VEWTSNSL

SEQ ID NO: 291829 - protein, 8 aa, Influenza virus
WWTSNSLV

SEQ ID NO: 291830 - protein, 8 aa, Influenza virus
WTSNSLVA

SEQ ID NO: 291831 - protein, 8 aa, Influenza virus
TSNSLVAL

SEQ ID NO: 291832 - protein, 8 aa, Influenza virus
SNSLVALC

SEQ ID NO: 291833 - protein, 8 aa, Influenza virus
NSLVALCG

SEQ ID NO: 291834 - protein, 8 aa, Influenza virus
SLVALCGS

SEQ ID NO: 291835 - protein, 8 aa, Influenza virus
LVALCGSP

SEQ ID NO: 291836 - protein, 8 aa, Influenza virus
SVGSGSFP

SEQ ID NO: 291837 - protein, 8 aa, Influenza virus
VGPGSFPD

SEQ ID NO: 291838 - protein, 8 aa, Influenza virus
GPGSFPDG

SEQ ID NO: 291839 - protein, 8 aa, Influenza virus
PGSFPDGA

SEQ ID NO: 291840 - protein, 8 aa, Influenza virus
GFFPDGPQ

SEQ ID NO: 291841 - protein, 8 aa, Influenza virus
FFPDGPQI

SEQ ID NO: 291842 - protein, 8 aa, Influenza virus
FPDGAQIK

SEQ ID NO: 291843 - protein, 8 aa, Influenza virus
PDGAQIKY

SEQ ID NO: 291844 - protein, 8 aa, Influenza virus
DGAQIKYF

SEQ ID NO: 291845 - protein, 8 aa, Influenza virus
GAQIKYFS

SEQ ID NO: 291846 - protein, 8 aa, Influenza virus
MLLVSTNA

SEQ ID NO: 291847 - protein, 8 aa, Influenza virus
LLVSTNAY

SEQ ID NO: 291848 - protein, 8 aa, Influenza virus
LVSTNAYD

SEQ ID NO: 291849 - protein, 8 aa, Influenza virus
VSTNAYDR

SEQ ID NO: 291850 - protein, 8 aa, Influenza virus
STNAHDRI

SEQ ID NO: 291851 - protein, 8 aa, Influenza virus
TNAHDRIC

SEQ ID NO: 291852 - protein, 8 aa, Influenza virus
NAHDRICI

SEQ ID NO: 291853 - protein, 8 aa, Influenza virus
AHDRICIG

SEQ ID NO: 291854 - protein, 8 aa, Influenza virus
HDRICIGY

SEQ ID NO: 291855 - protein, 8 aa, Influenza virus
YQSNNSTN

SEQ ID NO: 291856 - protein, 8 aa, Influenza virus
QSNNSTNT

SEQ ID NO: 291857 - protein, 8 aa, Influenza virus
SNNSTNTV

SEQ ID NO: 291858 - protein, 8 aa, Influenza virus
NNSTDTVD

SEQ ID NO: 291859 - protein, 8 aa, Influenza virus
NSTDTVDT

SEQ ID NO: 291860 - protein, 8 aa, Influenza virus
STDTVDTL

SEQ ID NO: 291861 - protein, 8 aa, Influenza virus
TNTVNTLI

SEQ ID NO: 291862 - protein, 8 aa, Influenza virus
DTVNTLME

SEQ ID NO: 291863 - protein, 8 aa, Influenza virus
TVNTLTEQ

SEQ ID NO: 291864 - protein, 8 aa, Influenza virus
VNTLMEQN

SEQ ID NO: 291865 - protein, 8 aa, Influenza virus
TLIEQNIP

SEQ ID NO: 291866 - protein, 8 aa, Influenza virus
LMEQNVPV

SEQ ID NO: 291867 - protein, 8 aa, Influenza virus
IEQNIPVT

SEQ ID NO: 291868 - protein, 8 aa, Influenza virus
EQNIPVTQ

SEQ ID NO: 291869 - protein, 8 aa, Influenza virus
QNVPVTQA

SEQ ID NO: 291870 - protein, 8 aa, Influenza virus
NVPVTQAM

SEQ ID NO: 291871 - protein, 8 aa, Influenza virus
VPVTQAME

SEQ ID NO: 291872 - protein, 8 aa, Influenza virus
PVTQAMEL

SEQ ID NO: 291873 - protein, 8 aa, Influenza virus
VTQAMELV

SEQ ID NO: 291874 - protein, 8 aa, Influenza virus
TQAMELVE

SEQ ID NO: 291875 - protein, 8 aa, Influenza virus
QTMELVEA

SEQ ID NO: 291876 - protein, 8 aa, Influenza virus
TMELVEAE

SEQ ID NO: 291877 - protein, 8 aa, Influenza virus
MELVEAEK

SEQ ID NO: 291878 - protein, 8 aa, Influenza virus
ELVEAEKH

SEQ ID NO: 291879 - protein, 8 aa, Influenza virus
EKHSAYCN

SEQ ID NO: 291880 - protein, 8 aa, Influenza virus
KHSAYCNT

SEQ ID NO: 291881 - protein, 8 aa, Influenza virus
HSAYCNTD

SEQ ID NO: 291882 - protein, 8 aa, Influenza virus
SAYCNTDL

SEQ ID NO: 291883 - protein, 8 aa, Influenza virus
YCNTDLGT

SEQ ID NO: 291884 - protein, 8 aa, Influenza virus
CNTDLGTP

SEQ ID NO: 291885 - protein, 8 aa, Influenza virus
NTDLGTPL

SEQ ID NO: 291886 - protein, 8 aa, Influenza virus
TDLGTPLE

SEQ ID NO: 291887 - protein, 8 aa, Influenza virus
DLGTPLEL

SEQ ID NO: 291888 - protein, 8 aa, Influenza virus
LGTPLELR

SEQ ID NO: 291889 - protein, 8 aa, Influenza virus
GTPLELRD

SEQ ID NO: 291890 - protein, 8 aa, Influenza virus
TPLELRDC

SEQ ID NO: 291891 - protein, 8 aa, Influenza virus
LELRDCKV

SEQ ID NO: 291892 - protein, 8 aa, Influenza virus
ELRDCKVE

SEQ ID NO: 291893 - protein, 8 aa, Influenza virus
LRDCKVEA

SEQ ID NO: 291894 - protein, 8 aa, Influenza virus
RDCKVEAV

SEQ ID NO: 291895 - protein, 8 aa, Influenza virus
DCKVEAVI

SEQ ID NO: 291896 - protein, 8 aa, Influenza virus
CKVEAVIY

SEQ ID NO: 291897 - protein, 8 aa, Influenza virus
KVEAVIYG

SEQ ID NO: 291898 - protein, 8 aa, Influenza virus
VEAVIYGN

SEQ ID NO: 291899 - protein, 8 aa, Influenza virus
YGNPKCDV

SEQ ID NO: 291900 - protein, 8 aa, Influenza virus
GNPKCDVH

SEQ ID NO: 291901 - protein, 8 aa, Influenza virus
NPKCDVHL

SEQ ID NO: 291902 - protein, 8 aa, Influenza virus
PKCDVHLK

SEQ ID NO: 291903 - protein, 8 aa, Influenza virus
KCDVHLKD

SEQ ID NO: 291904 - protein, 8 aa, Influenza virus
CDVHLKDQ

SEQ ID NO: 291905 - protein, 8 aa, Influenza virus
HLKDQDWS

SEQ ID NO: 291906 - protein, 8 aa, Influenza virus
LKDQSWSY

SEQ ID NO: 291907 - protein, 8 aa, Influenza virus
KDQSWSYI

SEQ ID NO: 291908 - protein, 8 aa, Influenza virus
DQSWSYIV

SEQ ID NO: 291909 - protein, 8 aa, Influenza virus
QSWSYIVE

SEQ ID NO: 291910 - protein, 8 aa, Influenza virus
SWSYIVER

SEQ ID NO: 291911 - protein, 8 aa, Influenza virus
EGMCYPGF

SEQ ID NO: 291912 - protein, 8 aa, Influenza virus
GMCYPGSI

SEQ ID NO: 291913 - protein, 8 aa, Influenza virus
MCYPGSIE

SEQ ID NO: 291914 - protein, 8 aa, Influenza virus
CYPGSIEN

SEQ ID NO: 291915 - protein, 8 aa, Influenza virus
YPGSIENL

SEQ ID NO: 291916 - protein, 8 aa, Influenza virus
PGSIENLE

SEQ ID NO: 291917 - protein, 8 aa, Influenza virus
GSIENLEE

SEQ ID NO: 291918 - protein, 8 aa, Influenza virus
SIENLEEL

SEQ ID NO: 291919 - protein, 8 aa, Influenza virus
IENLEELR

SEQ ID NO: 291920 - protein, 8 aa, Influenza virus
ELRFVFSS

SEQ ID NO: 291921 - protein, 8 aa, Influenza virus
LRFVFSSA

SEQ ID NO: 291922 - protein, 8 aa, Influenza virus
RFVFSSAA

SEQ ID NO: 291923 - protein, 8 aa, Influenza virus
FVFSSAAS

SEQ ID NO: 291924 - protein, 8 aa, Influenza virus
VFSSAASY

SEQ ID NO: 291925 - protein, 8 aa, Influenza virus
FSSAASYK

SEQ ID NO: 291926 - protein, 8 aa, Influenza virus
SSAASYKR

SEQ ID NO: 291927 - protein, 8 aa, Influenza virus
SAASYKRI

SEQ ID NO: 291928 - protein, 8 aa, Influenza virus
AASYKRVR

SEQ ID NO: 291929 - protein, 8 aa, Influenza virus
ASYKRVRL

SEQ ID NO: 291930 - protein, 8 aa, Influenza virus
SYKRVRLF

SEQ ID NO: 291931 - protein, 8 aa, Influenza virus
YKRVRLFD

SEQ ID NO: 291932 - protein, 8 aa, Influenza virus
KRVRLFDY

SEQ ID NO: 291933 - protein, 8 aa, Influenza virus
RVRLFDYS

SEQ ID NO: 291934 - protein, 8 aa, Influenza virus
IRLFDYSK

SEQ ID NO: 291935 - protein, 8 aa, Influenza virus
RLFDYSKW

SEQ ID NO: 291936 - protein, 8 aa, Influenza virus
LFDYSKWN

SEQ ID NO: 291937 - protein, 8 aa, Influenza virus
FDYSKWNV

SEQ ID NO: 291938 - protein, 8 aa, Influenza virus
DYSKWNVT

SEQ ID NO: 291939 - protein, 8 aa, Influenza virus
WNVTRSGT

SEQ ID NO: 291940 - protein, 8 aa, Influenza virus
NVTRSGTS

SEQ ID NO: 291941 - protein, 8 aa, Influenza virus
VTRSGTSK

SEQ ID NO: 291942 - protein, 8 aa, Influenza virus
TRSGTSKA

SEQ ID NO: 291943 - protein, 8 aa, Influenza virus
RSGTSKAC

SEQ ID NO: 291944 - protein, 8 aa, Influenza virus
SGTSKACS

SEQ ID NO: 291945 - protein, 8 aa, Influenza virus
GTSKACSA

SEQ ID NO: 291946 - protein, 8 aa, Influenza virus
TSKACSAS

SEQ ID NO: 291947 - protein, 8 aa, Influenza virus
SKACSAST

SEQ ID NO: 291948 - protein, 8 aa, Influenza virus
KACSASTG

SEQ ID NO: 291949 - protein, 8 aa, Influenza virus
ACSASTGG

SEQ ID NO: 291950 - protein, 8 aa, Influenza virus
CSASTGGQ

SEQ ID NO: 291951 - protein, 8 aa, Influenza virus
NASTGGQA

SEQ ID NO: 291952 - protein, 8 aa, Influenza virus
ASTGGQAF

SEQ ID NO: 291953 - protein, 8 aa, Influenza virus
STGGQAFY

SEQ ID NO: 291954 - protein, 8 aa, Influenza virus
TGGQAFYR

SEQ ID NO: 291955 - protein, 8 aa, Influenza virus
GGQAFYRS

SEQ ID NO: 291956 - protein, 8 aa, Influenza virus
GQAFYRSI

SEQ ID NO: 291957 - protein, 8 aa, Influenza virus
QAFYRSIN

SEQ ID NO: 291958 - protein, 8 aa, Influenza virus
AFYRSINW

SEQ ID NO: 291959 - protein, 8 aa, Influenza virus
INWLTKKE

SEQ ID NO: 291960 - protein, 8 aa, Influenza virus
NWLTKKKN

SEQ ID NO: 291961 - protein, 8 aa, Influenza virus
WLTKKKNP

SEQ ID NO: 291962 - protein, 8 aa, Influenza virus
LTKKKNPE

SEQ ID NO: 291963 - protein, 8 aa, Influenza virus
TKKKNPEA

SEQ ID NO: 291964 - protein, 8 aa, Influenza virus
KKKNPEAY

SEQ ID NO: 291965 - protein, 8 aa, Influenza virus
KKNPEAYN

SEQ ID NO: 291966 - protein, 8 aa, Influenza virus
KNPEAYNF

SEQ ID NO: 291967 - protein, 8 aa, Influenza virus
PEAYNFNE

SEQ ID NO: 291968 - protein, 8 aa, Influenza virus
EAYNFNEG

SEQ ID NO: 291969 - protein, 8 aa, Influenza virus
TYDFNEGT

SEQ ID NO: 291970 - protein, 8 aa, Influenza virus
YDFNEGTY

SEQ ID NO: 291971 - protein, 8 aa, Influenza virus
FNEGTYVN

SEQ ID NO: 291972 - protein, 8 aa, Influenza virus
NEGTYINN

SEQ ID NO: 291973 - protein, 8 aa, Influenza virus
NNEDGNII

SEQ ID NO: 291974 - protein, 8 aa, Influenza virus
NEDGNIIF

SEQ ID NO: 291975 - protein, 8 aa, Influenza virus
EDGNIIFL

SEQ ID NO: 291976 - protein, 8 aa, Influenza virus
DGNIIFLW

SEQ ID NO: 291977 - protein, 8 aa, Influenza virus
GNIIFLWG

SEQ ID NO: 291978 - protein, 8 aa, Influenza virus
NIIFLWGI

SEQ ID NO: 291979 - protein, 8 aa, Influenza virus
WGIHHPPN

SEQ ID NO: 291980 - protein, 8 aa, Influenza virus
GIHHPPDA

SEQ ID NO: 291981 - protein, 8 aa, Influenza virus
IHHPPDAK

SEQ ID NO: 291982 - protein, 8 aa, Influenza virus
HHPPDAKE

SEQ ID NO: 291983 - protein, 8 aa, Influenza virus
HPPDAKEQ

SEQ ID NO: 291984 - protein, 8 aa, Influenza virus
PPDAKEQT

SEQ ID NO: 291985 - protein, 8 aa, Influenza virus
AKEQTTLY

SEQ ID NO: 291986 - protein, 8 aa, Influenza virus
KEQTALYK

SEQ ID NO: 291987 - protein, 8 aa, Influenza virus
EQTALYKN

SEQ ID NO: 291988 - protein, 8 aa, Influenza virus
QTALYKNA

SEQ ID NO: 291989 - protein, 8 aa, Influenza virus
TALYKNAN

SEQ ID NO: 291990 - protein, 8 aa, Influenza virus
ALYKNANT

SEQ ID NO: 291991 - protein, 8 aa, Influenza virus
LYKNTNTL

SEQ ID NO: 291992 - protein, 8 aa, Influenza virus
YKNTNTLS

SEQ ID NO: 291993 - protein, 8 aa, Influenza virus
KNTNTLSS

SEQ ID NO: 291994 - protein, 8 aa, Influenza virus
NTNTLSSV

SEQ ID NO: 291995 - protein, 8 aa, Influenza virus
ANTLSSVN

SEQ ID NO: 291996 - protein, 8 aa, Influenza virus
NTLSSVNT

SEQ ID NO: 291997 - protein, 8 aa, Influenza virus
TLSSVNTN

SEQ ID NO: 291998 - protein, 8 aa, Influenza virus
LSSVNTNT

SEQ ID NO: 291999 - protein, 8 aa, Influenza virus
SSVNTNTI

SEQ ID NO: 292000 - protein, 8 aa, Influenza virus
SVNTNTIN

SEQ ID NO: 292001 - protein, 8 aa, Influenza virus
VNTNTINR

SEQ ID NO: 292002 - protein, 8 aa, Influenza virus
TTNTINRI

SEQ ID NO: 292003 - protein, 8 aa, Influenza virus
TNTINRIF

SEQ ID NO: 292004 - protein, 8 aa, Influenza virus
NTINRSFR

SEQ ID NO: 292005 - protein, 8 aa, Influenza virus
TINRSFRP

SEQ ID NO: 292006 - protein, 8 aa, Influenza virus
INRSFRPN

SEQ ID NO: 292007 - protein, 8 aa, Influenza virus
NRSFRPNI

SEQ ID NO: 292008 - protein, 8 aa, Influenza virus
RSFRPNIG

SEQ ID NO: 292009 - protein, 8 aa, Influenza virus
IFQPNIGP

SEQ ID NO: 292010 - protein, 8 aa, Influenza virus
FRPNIGPR

SEQ ID NO: 292011 - protein, 8 aa, Influenza virus
RPNIGPRP

SEQ ID NO: 292012 - protein, 8 aa, Influenza virus
PNIGPRAL

SEQ ID NO: 292013 - protein, 8 aa, Influenza virus
NIGPRALV

SEQ ID NO: 292014 - protein, 8 aa, Influenza virus
IGPRALVR

SEQ ID NO: 292015 - protein, 8 aa, Influenza virus
GPRALVRG

SEQ ID NO: 292016 - protein, 8 aa, Influenza virus
PRALVRGQ

SEQ ID NO: 292017 - protein, 8 aa, Influenza virus
RALVRGQQ

SEQ ID NO: 292018 - protein, 8 aa, Influenza virus
ALVRGQQG

SEQ ID NO: 292019 - protein, 8 aa, Influenza virus
LVRGQQGT

SEQ ID NO: 292020 - protein, 8 aa, Influenza virus
VREQQGRM

SEQ ID NO: 292021 - protein, 8 aa, Influenza virus
REQQGRMD

SEQ ID NO: 292022 - protein, 8 aa, Influenza virus
EQQGRMDY

SEQ ID NO: 292023 - protein, 8 aa, Influenza virus
QQGTMDYY

SEQ ID NO: 292024 - protein, 8 aa, Influenza virus
QGWMDYYW

SEQ ID NO: 292025 - protein, 8 aa, Influenza virus
GWMDYYWG

SEQ ID NO: 292026 - protein, 8 aa, Influenza virus
WMDYYWGI

SEQ ID NO: 292027 - protein, 8 aa, Influenza virus
PEFGYLLR

SEQ ID NO: 292028 - protein, 8 aa, Influenza virus
EFGYLLRG

SEQ ID NO: 292029 - protein, 8 aa, Influenza virus
FGYLLRGE

SEQ ID NO: 292030 - protein, 8 aa, Influenza virus
GYLLRGES

SEQ ID NO: 292031 - protein, 8 aa, Influenza virus
YLLKGESY

SEQ ID NO: 292032 - protein, 8 aa, Influenza virus
LLKGESYG

SEQ ID NO: 292033 - protein, 8 aa, Influenza virus
LKGESYGR

SEQ ID NO: 292034 - protein, 8 aa, Influenza virus
GESYGRII

SEQ ID NO: 292035 - protein, 8 aa, Influenza virus
ESYGRIIQ

SEQ ID NO: 292036 - protein, 8 aa, Influenza virus
SYGRIIQN

SEQ ID NO: 292037 - protein, 8 aa, Influenza virus
YGRIIQNE

SEQ ID NO: 292038 - protein, 8 aa, Influenza virus
CRIIQNED

SEQ ID NO: 292039 - protein, 8 aa, Influenza virus
KIIQNEDI

SEQ ID NO: 292040 - protein, 8 aa, Influenza virus
TIQNEDIP

SEQ ID NO: 292041 - protein, 8 aa, Influenza virus
QNEDIPIE

SEQ ID NO: 292042 - protein, 8 aa, Influenza virus
NEDIPIGS

SEQ ID NO: 292043 - protein, 8 aa, Influenza virus
EDIPIGSC

SEQ ID NO: 292044 - protein, 8 aa, Influenza virus
NCNTKCQT

SEQ ID NO: 292045 - protein, 8 aa, Influenza virus
CNTKCQTY

SEQ ID NO: 292046 - protein, 8 aa, Influenza virus
NTKCQTYA

SEQ ID NO: 292047 - protein, 8 aa, Influenza virus
TKCQTYTG

SEQ ID NO: 292048 - protein, 8 aa, Influenza virus
KCQTYTGA

SEQ ID NO: 292049 - protein, 8 aa, Influenza virus
CQTYTGAI

SEQ ID NO: 292050 - protein, 8 aa, Influenza virus
QTYTGAIN

SEQ ID NO: 292051 - protein, 8 aa, Influenza virus
TYTGAINS

SEQ ID NO: 292052 - protein, 8 aa, Influenza virus
YTGAINSS

SEQ ID NO: 292053 - protein, 8 aa, Influenza virus
AGAINSSR

SEQ ID NO: 292054 - protein, 8 aa, Influenza virus
GAINSSRP

SEQ ID NO: 292055 - protein, 8 aa, Influenza virus
AINSSRPF

SEQ ID NO: 292056 - protein, 8 aa, Influenza virus
INSSRPFQ

SEQ ID NO: 292057 - protein, 8 aa, Influenza virus
NSSRPFQN

SEQ ID NO: 292058 - protein, 8 aa, Influenza virus
SSRPFQNA

SEQ ID NO: 292059 - protein, 8 aa, Influenza virus
SRPFQNAS

SEQ ID NO: 292060 - protein, 8 aa, Influenza virus
RPFQNASR

SEQ ID NO: 292061 - protein, 8 aa, Influenza virus
PFQNASRY

SEQ ID NO: 292062 - protein, 8 aa, Influenza virus
FQNASRHH

SEQ ID NO: 292063 - protein, 8 aa, Influenza virus
QNASRYYM

SEQ ID NO: 292064 - protein, 8 aa, Influenza virus
NASRHHMG

SEQ ID NO: 292065 - protein, 8 aa, Influenza virus
TSRHYMGE

SEQ ID NO: 292066 - protein, 8 aa, Influenza virus
SRYYMGEC

SEQ ID NO: 292067 - protein, 8 aa, Influenza virus
RYYMGECP

SEQ ID NO: 292068 - protein, 8 aa, Influenza virus
HHMGECPK

SEQ ID NO: 292069 - protein, 8 aa, Influenza virus
YMGECPEY

SEQ ID NO: 292070 - protein, 8 aa, Influenza virus
MGECPKYA

SEQ ID NO: 292071 - protein, 8 aa, Influenza virus
GECPKYVR

SEQ ID NO: 292072 - protein, 8 aa, Influenza virus
ECPKYVRK

SEQ ID NO: 292073 - protein, 8 aa, Influenza virus
YVKKESLR

SEQ ID NO: 292074 - protein, 8 aa, Influenza virus
VKKESLRL

SEQ ID NO: 292075 - protein, 8 aa, Influenza virus
KKESLRLA

SEQ ID NO: 292076 - protein, 8 aa, Influenza virus
KESLRLAV

SEQ ID NO: 292077 - protein, 8 aa, Influenza virus
ESLRLAVG

SEQ ID NO: 292078 - protein, 8 aa, Influenza virus
SLRLALGL

SEQ ID NO: 292079 - protein, 8 aa, Influenza virus
LRLALGLR

SEQ ID NO: 292080 - protein, 8 aa, Influenza virus
RLALGLRN

SEQ ID NO: 292081 - protein, 8 aa, Influenza virus
LALGLRNT

SEQ ID NO: 292082 - protein, 8 aa, Influenza virus
ALGLRNTP

SEQ ID NO: 292083 - protein, 8 aa, Influenza virus
LGLRNTPS

SEQ ID NO: 292084 - protein, 8 aa, Influenza virus
GLRNTPSV

SEQ ID NO: 292085 - protein, 8 aa, Influenza virus
LRNTPSVE

SEQ ID NO: 292086 - protein, 8 aa, Influenza virus
RNTPSVEP

SEQ ID NO: 292087 - protein, 8 aa, Influenza virus
NTPSVEPK

SEQ ID NO: 292088 - protein, 8 aa, Influenza virus
TPSVEPRG

SEQ ID NO: 292089 - protein, 8 aa, Influenza virus
PSVEPRGL

SEQ ID NO: 292090 - protein, 8 aa, Influenza virus
SVEPKGLF

SEQ ID NO: 292091 - protein, 8 aa, Influenza virus
VEPKGLFG

SEQ ID NO: 292092 - protein, 8 aa, Influenza virus
EPRGLFGA

SEQ ID NO: 292093 - protein, 8 aa, Influenza virus
PRGLFGAI

SEQ ID NO: 292094 - protein, 8 aa, Influenza virus
RGLFGAIA

SEQ ID NO: 292095 - protein, 8 aa, Influenza virus
GFIEGGWC

SEQ ID NO: 292096 - protein, 8 aa, Influenza virus
FIEGGWCG

SEQ ID NO: 292097 - protein, 8 aa, Influenza virus
IEGGWCGM

SEQ ID NO: 292098 - protein, 8 aa, Influenza virus
EGGWCGMI

SEQ ID NO: 292099 - protein, 8 aa, Influenza virus
GGWCGMID

SEQ ID NO: 292100 - protein, 8 aa, Influenza virus
GWCGMIDG

SEQ ID NO: 292101 - protein, 8 aa, Influenza virus
WCGMIDGW

SEQ ID NO: 292102 - protein, 8 aa, Influenza virus
CGMIDGWY

SEQ ID NO: 292103 - protein, 8 aa, Influenza virus
YGFHHSNA

SEQ ID NO: 292104 - protein, 8 aa, Influenza virus
GFHHSNAE

SEQ ID NO: 292105 - protein, 8 aa, Influenza virus
FHHSNAEG

SEQ ID NO: 292106 - protein, 8 aa, Influenza virus
HHSNAEGT

SEQ ID NO: 292107 - protein, 8 aa, Influenza virus
HSNAEGTG

SEQ ID NO: 292108 - protein, 8 aa, Influenza virus
SNAEGTGM

SEQ ID NO: 292109 - protein, 8 aa, Influenza virus
NAEGTGMA

SEQ ID NO: 292110 - protein, 8 aa, Influenza virus
AEGTGMAA

SEQ ID NO: 292111 - protein, 8 aa, Influenza virus
KSTQEAIN

SEQ ID NO: 292112 - protein, 8 aa, Influenza virus
STQEAIEK

SEQ ID NO: 292113 - protein, 8 aa, Influenza virus
TQEAIEKI

SEQ ID NO: 292114 - protein, 8 aa, Influenza virus
QEAIGKIT

SEQ ID NO: 292115 - protein, 8 aa, Influenza virus
EAIGKITN

SEQ ID NO: 292116 - protein, 8 aa, Influenza virus
AIEKITNK

SEQ ID NO: 292117 - protein, 8 aa, Influenza virus
IDKITNKI

SEQ ID NO: 292118 - protein, 8 aa, Influenza virus
DKITNKIN

SEQ ID NO: 292119 - protein, 8 aa, Influenza virus
KITNKINN

SEQ ID NO: 292120 - protein, 8 aa, Influenza virus
ITNKINNI

SEQ ID NO: 292121 - protein, 8 aa, Influenza virus
TNKINNIV

SEQ ID NO: 292122 - protein, 8 aa, Influenza virus
NKINNIVD

SEQ ID NO: 292123 - protein, 8 aa, Influenza virus
KINNIVDK

SEQ ID NO: 292124 - protein, 8 aa, Influenza virus
INNIVDKM

SEQ ID NO: 292125 - protein, 8 aa, Influenza virus
DKMNREFG

SEQ ID NO: 292126 - protein, 8 aa, Influenza virus
KMNREFGV

SEQ ID NO: 292127 - protein, 8 aa, Influenza virus
MNREFGVV

SEQ ID NO: 292128 - protein, 8 aa, Influenza virus
NREFGVVN

SEQ ID NO: 292129 - protein, 8 aa, Influenza virus
REFGVVNH

SEQ ID NO: 292130 - protein, 8 aa, Influenza virus
EFGVVNHE

SEQ ID NO: 292131 - protein, 8 aa, Influenza virus
FGVVNHEF

SEQ ID NO: 292132 - protein, 8 aa, Influenza virus
GVVNHEFS

SEQ ID NO: 292133 - protein, 8 aa, Influenza virus
VMNHEFSE

SEQ ID NO: 292134 - protein, 8 aa, Influenza virus
HEFSKVEK

SEQ ID NO: 292135 - protein, 8 aa, Influenza virus
EKRINMIS

SEQ ID NO: 292136 - protein, 8 aa, Influenza virus
KRINVIND

SEQ ID NO: 292137 - protein, 8 aa, Influenza virus
KINMINDK

SEQ ID NO: 292138 - protein, 8 aa, Influenza virus
INVINDKI

SEQ ID NO: 292139 - protein, 8 aa, Influenza virus
NMINDKIN

SEQ ID NO: 292140 - protein, 8 aa, Influenza virus
MINDKIND

SEQ ID NO: 292141 - protein, 8 aa, Influenza virus
INDKINDQ

SEQ ID NO: 292142 - protein, 8 aa, Influenza virus
NDKINDQI

SEQ ID NO: 292143 - protein, 8 aa, Influenza virus
DKINDQIE

SEQ ID NO: 292144 - protein, 8 aa, Influenza virus
KINDQIED

SEQ ID NO: 292145 - protein, 8 aa, Influenza virus
INDQIEDL

SEQ ID NO: 292146 - protein, 8 aa, Influenza virus
NDQIEDLW

SEQ ID NO: 292147 - protein, 8 aa, Influenza virus
DQIEGLWA

SEQ ID NO: 292148 - protein, 8 aa, Influenza virus
QIENLWAY

SEQ ID NO: 292149 - protein, 8 aa, Influenza virus
IENLWAYN

SEQ ID NO: 292150 - protein, 8 aa, Influenza virus
EGLWAYNA

SEQ ID NO: 292151 - protein, 8 aa, Influenza virus
NLWAYNAE

SEQ ID NO: 292152 - protein, 8 aa, Influenza virus
VLLENQKI

SEQ ID NO: 292153 - protein, 8 aa, Influenza virus
LLENQKIL

SEQ ID NO: 292154 - protein, 8 aa, Influenza virus
LENQKILD

SEQ ID NO: 292155 - protein, 8 aa, Influenza virus
ENQKILDE

SEQ ID NO: 292156 - protein, 8 aa, Influenza virus
NQKILDEH

SEQ ID NO: 292157 - protein, 8 aa, Influenza virus
QKTLDKHD

SEQ ID NO: 292158 - protein, 8 aa, Influenza virus
KTLDKHDS

SEQ ID NO: 292159 - protein, 8 aa, Influenza virus
TLDKHDSN

SEQ ID NO: 292160 - protein, 8 aa, Influenza virus
LDKHDSNV

SEQ ID NO: 292161 - protein, 8 aa, Influenza virus
DKHDSNVK

SEQ ID NO: 292162 - protein, 8 aa, Influenza virus
EHDSNVEN

SEQ ID NO: 292163 - protein, 8 aa, Influenza virus
HDSNVENL

SEQ ID NO: 292164 - protein, 8 aa, Influenza virus
DSNVENLF

SEQ ID NO: 292165 - protein, 8 aa, Influenza virus
SNVENLFD

SEQ ID NO: 292166 - protein, 8 aa, Influenza virus
NVENLFDE

SEQ ID NO: 292167 - protein, 8 aa, Influenza virus
VENLFDEV

SEQ ID NO: 292168 - protein, 8 aa, Influenza virus
KNLFDEVR

SEQ ID NO: 292169 - protein, 8 aa, Influenza virus
NLFDEVRR

SEQ ID NO: 292170 - protein, 8 aa, Influenza virus
LFDEVRRR

SEQ ID NO: 292171 - protein, 8 aa, Influenza virus
FDEVRRRL

SEQ ID NO: 292172 - protein, 8 aa, Influenza virus
DEVRRRLS

SEQ ID NO: 292173 - protein, 8 aa, Influenza virus
EVKRRLST

SEQ ID NO: 292174 - protein, 8 aa, Influenza virus
VKRRLSTN

SEQ ID NO: 292175 - protein, 8 aa, Influenza virus
KRRLSTNA

SEQ ID NO: 292176 - protein, 8 aa, Influenza virus
RRLSTNAI

SEQ ID NO: 292177 - protein, 8 aa, Influenza virus
RLSTNAID

SEQ ID NO: 292178 - protein, 8 aa, Influenza virus
NAIDTGNG

SEQ ID NO: 292179 - protein, 8 aa, Influenza virus
AIDTGNGC

SEQ ID NO: 292180 - protein, 8 aa, Influenza virus
IDTGNGCF

SEQ ID NO: 292181 - protein, 8 aa, Influenza virus
DTGNGCFD

SEQ ID NO: 292182 - protein, 8 aa, Influenza virus
TGNGCFDI

SEQ ID NO: 292183 - protein, 8 aa, Influenza virus
GKGCFDIL

SEQ ID NO: 292184 - protein, 8 aa, Influenza virus
KGCFDILH

SEQ ID NO: 292185 - protein, 8 aa, Influenza virus
FDILHKCD

SEQ ID NO: 292186 - protein, 8 aa, Influenza virus
DILHKCDN

SEQ ID NO: 292187 - protein, 8 aa, Influenza virus
ILHKCDNE

SEQ ID NO: 292188 - protein, 8 aa, Influenza virus
LHKCDNEC

SEQ ID NO: 292189 - protein, 8 aa, Influenza virus
HKCDNECM

SEQ ID NO: 292190 - protein, 8 aa, Influenza virus
KCDNECME

SEQ ID NO: 292191 - protein, 8 aa, Influenza virus
CDNECMET

SEQ ID NO: 292192 - protein, 8 aa, Influenza virus
DNECMETI

SEQ ID NO: 292193 - protein, 8 aa, Influenza virus
NKCMETIK

SEQ ID NO: 292194 - protein, 8 aa, Influenza virus
KCMETIKN

SEQ ID NO: 292195 - protein, 8 aa, Influenza virus
TIKNGTYD

SEQ ID NO: 292196 - protein, 8 aa, Influenza virus
IKNGTYDH

SEQ ID NO: 292197 - protein, 8 aa, Influenza virus
KNGTYDHK

SEQ ID NO: 292198 - protein, 8 aa, Influenza virus
NGTYNHKE

SEQ ID NO: 292199 - protein, 8 aa, Influenza virus
GTYNHKEY

SEQ ID NO: 292200 - protein, 8 aa, Influenza virus
TYDHKEYE

SEQ ID NO: 292201 - protein, 8 aa, Influenza virus
YNHKEYEE

SEQ ID NO: 292202 - protein, 8 aa, Influenza virus
NHKEYEEE

SEQ ID NO: 292203 - protein, 8 aa, Influenza virus
HKDYEEEA

SEQ ID NO: 292204 - protein, 8 aa, Influenza virus
KDYEEEAK

SEQ ID NO: 292205 - protein, 8 aa, Influenza virus
DYEEEAKL

SEQ ID NO: 292206 - protein, 8 aa, Influenza virus
EEEAKLEK

SEQ ID NO: 292207 - protein, 8 aa, Influenza virus
EEAKLEKS

SEQ ID NO: 292208 - protein, 8 aa, Influenza virus
EAKLEKSR

SEQ ID NO: 292209 - protein, 8 aa, Influenza virus
AKLEKSRI

SEQ ID NO: 292210 - protein, 8 aa, Influenza virus
KLEKSRIN

SEQ ID NO: 292211 - protein, 8 aa, Influenza virus
LEKSRING

SEQ ID NO: 292212 - protein, 8 aa, Influenza virus
ERSKINEV

SEQ ID NO: 292213 - protein, 8 aa, Influenza virus
RSKINGVI

SEQ ID NO: 292214 - protein, 8 aa, Influenza virus
SKINEVKL

SEQ ID NO: 292215 - protein, 8 aa, Influenza virus
KINGVRLE

SEQ ID NO: 292216 - protein, 8 aa, Influenza virus
INGVRLEE

SEQ ID NO: 292217 - protein, 8 aa, Influenza virus
NGVILEEN

SEQ ID NO: 292218 - protein, 8 aa, Influenza virus
EVKLEENT

SEQ ID NO: 292219 - protein, 8 aa, Influenza virus
VRLEENTT

SEQ ID NO: 292220 - protein, 8 aa, Influenza virus
ILEENTTY

SEQ ID NO: 292221 - protein, 8 aa, Influenza virus
LEENTTYR

SEQ ID NO: 292222 - protein, 8 aa, Influenza virus
EENTTYRI

SEQ ID NO: 292223 - protein, 8 aa, Influenza virus
ENTTYRIL

SEQ ID NO: 292224 - protein, 8 aa, Influenza virus
NTTYRILS

SEQ ID NO: 292225 - protein, 8 aa, Influenza virus
TTYRILSI

SEQ ID NO: 292226 - protein, 8 aa, Influenza virus
SYKILSIY

SEQ ID NO: 292227 - protein, 8 aa, Influenza virus
YRILSIYS

SEQ ID NO: 292228 - protein, 8 aa, Influenza virus
RILSIYST

SEQ ID NO: 292229 - protein, 8 aa, Influenza virus
AASLCLAV

SEQ ID NO: 292230 - protein, 8 aa, Influenza virus
ASLCLAVL

SEQ ID NO: 292231 - protein, 8 aa, Influenza virus
SLCLAVLI

SEQ ID NO: 292232 - protein, 8 aa, Influenza virus
LCLAILVA

SEQ ID NO: 292233 - protein, 8 aa, Influenza virus
CLAILVAG

SEQ ID NO: 292234 - protein, 8 aa, Influenza virus
LAILVAGG

SEQ ID NO: 292235 - protein, 8 aa, Influenza virus
AILVAGGL

SEQ ID NO: 292236 - protein, 8 aa, Influenza virus
ILVAGGLI

SEQ ID NO: 292237 - protein, 8 aa, Influenza virus
LVAGGLIL

SEQ ID NO: 292238 - protein, 8 aa, Influenza virus
VAGGLILG

SEQ ID NO: 292239 - protein, 8 aa, Influenza virus
LGMQNGSY

SEQ ID NO: 292240 - protein, 8 aa, Influenza virus
GMQNGSYR

SEQ ID NO: 292241 - protein, 8 aa, Influenza virus
MQNGSYRC

SEQ ID NO: 292242 - protein, 8 aa, Influenza virus
QNGSYRCM

SEQ ID NO: 292243 - protein, 8 aa, Influenza virus
NGSYRCMF

SEQ ID NO: 292244 - protein, 8 aa, Influenza virus
GSYRCMFC

SEQ ID NO: 292245 - protein, 8 aa, Influenza virus
SYRCMFCI

SEQ ID NO: 292246 - protein, 8 aa, Influenza virus
GHQSTNST

SEQ ID NO: 292247 - protein, 8 aa, Influenza virus
HQSTNSTE

SEQ ID NO: 292248 - protein, 8 aa, Influenza virus
QSTNSTEA

SEQ ID NO: 292249 - protein, 8 aa, Influenza virus
STNSTEAV

SEQ ID NO: 292250 - protein, 8 aa, Influenza virus
TNSTETVN

SEQ ID NO: 292251 - protein, 8 aa, Influenza virus
NSTETVNT

SEQ ID NO: 292252 - protein, 8 aa, Influenza virus
EHNGILCA

SEQ ID NO: 292253 - protein, 8 aa, Influenza virus
HNGILCAT

SEQ ID NO: 292254 - protein, 8 aa, Influenza virus
IEGLVYGN

SEQ ID NO: 292255 - protein, 8 aa, Influenza virus
EGLVYGNP

SEQ ID NO: 292256 - protein, 8 aa, Influenza virus
GLVYGNPS

SEQ ID NO: 292257 - protein, 8 aa, Influenza virus
LVYGNPSC

SEQ ID NO: 292258 - protein, 8 aa, Influenza virus
VYGNPSCD

SEQ ID NO: 292259 - protein, 8 aa, Influenza virus
KWSYIVER

SEQ ID NO: 292260 - protein, 8 aa, Influenza virus
WSYIVERS

SEQ ID NO: 292261 - protein, 8 aa, Influenza virus
SYIVERSS

SEQ ID NO: 292262 - protein, 8 aa, Influenza virus
YIVERSSA

SEQ ID NO: 292263 - protein, 8 aa, Influenza virus
SFYRNMRW

SEQ ID NO: 292264 - protein, 8 aa, Influenza virus
FYRNMRWL

SEQ ID NO: 292265 - protein, 8 aa, Influenza virus
YRNMRWLT

SEQ ID NO: 292266 - protein, 8 aa, Influenza virus
GRINYYWS

SEQ ID NO: 292267 - protein, 8 aa, Influenza virus
AVLKPGQT

SEQ ID NO: 292268 - protein, 8 aa, Influenza virus
ILKPGQTL

SEQ ID NO: 292269 - protein, 8 aa, Influenza virus
LRPGQTLR

SEQ ID NO: 292270 - protein, 8 aa, Influenza virus
KPGQTLRV

SEQ ID NO: 292271 - protein, 8 aa, Influenza virus
PGQTLRVR

SEQ ID NO: 292272 - protein, 8 aa, Influenza virus
GQTLRVRS

SEQ ID NO: 292273 - protein, 8 aa, Influenza virus
QTLRVRSN

SEQ ID NO: 292274 - protein, 8 aa, Influenza virus
TLRVRSNG

SEQ ID NO: 292275 - protein, 8 aa, Influenza virus
LRVRSNGN

SEQ ID NO: 292276 - protein, 8 aa, Influenza virus
RVRSNGNL

SEQ ID NO: 292277 - protein, 8 aa, Influenza virus
VRSNGNLI

SEQ ID NO: 292278 - protein, 8 aa, Influenza virus
RSDGNLIA

SEQ ID NO: 292279 - protein, 8 aa, Influenza virus
SDGNLIAP

SEQ ID NO: 292280 - protein, 8 aa, Influenza virus
DGNLIAPW

SEQ ID NO: 292281 - protein, 8 aa, Influenza virus
GNLIAPWF

SEQ ID NO: 292282 - protein, 8 aa, Influenza virus
NLIAPWFG

SEQ ID NO: 292283 - protein, 8 aa, Influenza virus
LIAPWFGH

SEQ ID NO: 292284 - protein, 8 aa, Influenza virus
GGLNSTLP

SEQ ID NO: 292285 - protein, 8 aa, Influenza virus
GLNSTLPF

SEQ ID NO: 292286 - protein, 8 aa, Influenza virus
LNTTLPFH

SEQ ID NO: 292287 - protein, 8 aa, Influenza virus
NTTLPFHN

SEQ ID NO: 292288 - protein, 8 aa, Influenza virus
TLPFHNVS

SEQ ID NO: 292289 - protein, 8 aa, Influenza virus
LPFHNVSK

SEQ ID NO: 292290 - protein, 8 aa, Influenza virus
PFHNVSKY

SEQ ID NO: 292291 - protein, 8 aa, Influenza virus
FHNVSKYA

SEQ ID NO: 292292 - protein, 8 aa, Influenza virus
HNVSKYAF

SEQ ID NO: 292293 - protein, 8 aa, Influenza virus
NISKYAFG

SEQ ID NO: 292294 - protein, 8 aa, Influenza virus
ISKYAFGT

SEQ ID NO: 292295 - protein, 8 aa, Influenza virus
SKYAFGTC

SEQ ID NO: 292296 - protein, 8 aa, Influenza virus
KYAFGNCP

SEQ ID NO: 292297 - protein, 8 aa, Influenza virus
YAFGNCPK

SEQ ID NO: 292298 - protein, 8 aa, Influenza virus
AFGNCPKY

SEQ ID NO: 292299 - protein, 8 aa, Influenza virus
KSLKLAIG

SEQ ID NO: 292300 - protein, 8 aa, Influenza virus
SLKLAIGL

SEQ ID NO: 292301 - protein, 8 aa, Influenza virus
LKLAIGLR

SEQ ID NO: 292302 - protein, 8 aa, Influenza virus
KLAIGLRN

SEQ ID NO: 292303 - protein, 8 aa, Influenza virus
RGIFGAIA

SEQ ID NO: 292304 - protein, 8 aa, Influenza virus
GIFGAIAG

SEQ ID NO: 292305 - protein, 8 aa, Influenza virus
GFIEGGWP

SEQ ID NO: 292306 - protein, 8 aa, Influenza virus
FIEGGWPG

SEQ ID NO: 292307 - protein, 8 aa, Influenza virus
IEGGWPGL

SEQ ID NO: 292308 - protein, 8 aa, Influenza virus
EGGWPGLV

SEQ ID NO: 292309 - protein, 8 aa, Influenza virus
GGWPGLVA

SEQ ID NO: 292310 - protein, 8 aa, Influenza virus
GWPGLVAG

SEQ ID NO: 292311 - protein, 8 aa, Influenza virus
WPGLVAGW

SEQ ID NO: 292312 - protein, 8 aa, Influenza virus
PGLVAGWY

SEQ ID NO: 292313 - protein, 8 aa, Influenza virus
GLIAGWYG

SEQ ID NO: 292314 - protein, 8 aa, Influenza virus
LIAGWYGF

SEQ ID NO: 292315 - protein, 8 aa, Influenza virus
IAGWYGFQ

SEQ ID NO: 292316 - protein, 8 aa, Influenza virus
YGFQHSNA

SEQ ID NO: 292317 - protein, 8 aa, Influenza virus
GFQHSNAQ

SEQ ID NO: 292318 - protein, 8 aa, Influenza virus
FQHSNAQG

SEQ ID NO: 292319 - protein, 8 aa, Influenza virus
QGTGMAAD

SEQ ID NO: 292320 - protein, 8 aa, Influenza virus
DKIDDQIQ

SEQ ID NO: 292321 - protein, 8 aa, Influenza virus
KVDDQIQD

SEQ ID NO: 292322 - protein, 8 aa, Influenza virus
DDQIQDVW

SEQ ID NO: 292323 - protein, 8 aa, Influenza virus
DQIQDVWA

SEQ ID NO: 292324 - protein, 8 aa, Influenza virus
QIQDVWAY

SEQ ID NO: 292325 - protein, 8 aa, Influenza virus
IQDVWAYN

SEQ ID NO: 292326 - protein, 8 aa, Influenza virus
QDVWAYNA

SEQ ID NO: 292327 - protein, 8 aa, Influenza virus
DVWAYNAE

SEQ ID NO: 292328 - protein, 8 aa, Influenza virus
VWAYNAEL

SEQ ID NO: 292329 - protein, 8 aa, Influenza virus
AELLVLLG

SEQ ID NO: 292330 - protein, 8 aa, Influenza virus
ELLVLLGN

SEQ ID NO: 292331 - protein, 8 aa, Influenza virus
LLVLLGNQ

SEQ ID NO: 292332 - protein, 8 aa, Influenza virus
LVLLGNQK

SEQ ID NO: 292333 - protein, 8 aa, Influenza virus
VLLGNQKT

SEQ ID NO: 292334 - protein, 8 aa, Influenza virus
LLGNQKTL

SEQ ID NO: 292335 - protein, 8 aa, Influenza virus
LGNQKTLD

SEQ ID NO: 292336 - protein, 8 aa, Influenza virus
GNQKTLDE

SEQ ID NO: 292337 - protein, 8 aa, Influenza virus
NQKILDEH

SEQ ID NO: 292338 - protein, 8 aa, Influenza virus
QKTLDEHE

SEQ ID NO: 292339 - protein, 8 aa, Influenza virus
KTLDEHEA

SEQ ID NO: 292340 - protein, 8 aa, Influenza virus
TLDEHEAN

SEQ ID NO: 292341 - protein, 8 aa, Influenza virus
LDEHEANV

SEQ ID NO: 292342 - protein, 8 aa, Influenza virus
DEHDANVH

SEQ ID NO: 292343 - protein, 8 aa, Influenza virus
NNLYNKVR

SEQ ID NO: 292344 - protein, 8 aa, Influenza virus
EDGNGCFE

SEQ ID NO: 292345 - protein, 8 aa, Influenza virus
DGNGCFEL

SEQ ID NO: 292346 - protein, 8 aa, Influenza virus
GNGCFELY

SEQ ID NO: 292347 - protein, 8 aa, Influenza virus
NGCFELYH

SEQ ID NO: 292348 - protein, 8 aa, Influenza virus
GCFDLYHK

SEQ ID NO: 292349 - protein, 8 aa, Influenza virus
CFDLYHKC

SEQ ID NO: 292350 - protein, 8 aa, Influenza virus
FDLYHKCD

SEQ ID NO: 292351 - protein, 8 aa, Influenza virus
ELYHKCDN

SEQ ID NO: 292352 - protein, 8 aa, Influenza virus
CMATIRNG

SEQ ID NO: 292353 - protein, 8 aa, Influenza virus
MATIRNGT

SEQ ID NO: 292354 - protein, 8 aa, Influenza virus
ATIRNGTY

SEQ ID NO: 292355 - protein, 8 aa, Influenza virus
TIRNGTYD

SEQ ID NO: 292356 - protein, 8 aa, Influenza virus
EGIYKILT

SEQ ID NO: 292357 - protein, 8 aa, Influenza virus
GIYKILTI

SEQ ID NO: 292358 - protein, 8 aa, Influenza virus
IYKILTIY

SEQ ID NO: 292359 - protein, 8 aa, Influenza virus
ILTIYSTA

SEQ ID NO: 292360 - protein, 8 aa, Influenza virus
LTIYSTAA

SEQ ID NO: 292361 - protein, 8 aa, Influenza virus
TIYSTAAS

SEQ ID NO: 292362 - protein, 8 aa, Influenza virus
IYSTAASS

SEQ ID NO: 292363 - protein, 8 aa, Influenza virus
YSTAASSL

SEQ ID NO: 292364 - protein, 8 aa, Influenza virus
STAASSLV

SEQ ID NO: 292365 - protein, 8 aa, Influenza virus
AAFMFWAM

SEQ ID NO: 292366 - protein, 8 aa, Influenza virus
AFMFWAMS

SEQ ID NO: 292367 - protein, 8 aa, Influenza virus
GHQSTNST

SEQ ID NO: 292368 - protein, 8 aa, Influenza virus
HQSTNSTE

SEQ ID NO: 292369 - protein, 8 aa, Influenza virus
QSTNSTEA

SEQ ID NO: 292370 - protein, 8 aa, Influenza virus
STNSTEAV

SEQ ID NO: 292371 - protein, 8 aa, Influenza virus
TNSTETVN

SEQ ID NO: 292372 - protein, 8 aa, Influenza virus
NSTETVNT

SEQ ID NO: 292373 - protein, 8 aa, Influenza virus
ELLQTEHN

SEQ ID NO: 292374 - protein, 8 aa, Influenza virus
EHNGILCA

SEQ ID NO: 292375 - protein, 8 aa, Influenza virus
HNGILCAT

SEQ ID NO: 292376 - protein, 8 aa, Influenza virus
IEGLVYGN

SEQ ID NO: 292377 - protein, 8 aa, Influenza virus
EGLVYGNP

SEQ ID NO: 292378 - protein, 8 aa, Influenza virus
GLVYGNPS

SEQ ID NO: 292379 - protein, 8 aa, Influenza virus
LVYGNPSC

SEQ ID NO: 292380 - protein, 8 aa, Influenza virus
VYGNPSCD

SEQ ID NO: 292381 - protein, 8 aa, Influenza virus
KWSYIVER

SEQ ID NO: 292382 - protein, 8 aa, Influenza virus
WSYIVERS

SEQ ID NO: 292383 - protein, 8 aa, Influenza virus
SYIVERSS

SEQ ID NO: 292384 - protein, 8 aa, Influenza virus
YIVERSSA

SEQ ID NO: 292385 - protein, 8 aa, Influenza virus
SFYRNMRW

SEQ ID NO: 292386 - protein, 8 aa, Influenza virus
FYRNMRWL

SEQ ID NO: 292387 - protein, 8 aa, Influenza virus
YRNMRWLT

SEQ ID NO: 292388 - protein, 8 aa, Influenza virus
GRINYYWS

SEQ ID NO: 292389 - protein, 8 aa, Influenza virus
YYWSILKP

SEQ ID NO: 292390 - protein, 8 aa, Influenza virus
AVLKPGQT

SEQ ID NO: 292391 - protein, 8 aa, Influenza virus
ILKPGQTL

SEQ ID NO: 292392 - protein, 8 aa, Influenza virus
LRPGQTLR

SEQ ID NO: 292393 - protein, 8 aa, Influenza virus
KPGQTLRV

SEQ ID NO: 292394 - protein, 8 aa, Influenza virus
PGQTLRVR

SEQ ID NO: 292395 - protein, 8 aa, Influenza virus
GQTLRVRS

SEQ ID NO: 292396 - protein, 8 aa, Influenza virus
QTLRVRSN

SEQ ID NO: 292397 - protein, 8 aa, Influenza virus
TLRVRSNG

SEQ ID NO: 292398 - protein, 8 aa, Influenza virus
LRVRSNGN

SEQ ID NO: 292399 - protein, 8 aa, Influenza virus
RVRSNGNL

SEQ ID NO: 292400 - protein, 8 aa, Influenza virus
VRSNGNLI

SEQ ID NO: 292401 - protein, 8 aa, Influenza virus
RSDGNLIA

SEQ ID NO: 292402 - protein, 8 aa, Influenza virus
SDGNLIAP

SEQ ID NO: 292403 - protein, 8 aa, Influenza virus
DGNLIAPW

SEQ ID NO: 292404 - protein, 8 aa, Influenza virus
GNLIAPWF

SEQ ID NO: 292405 - protein, 8 aa, Influenza virus
NLIAPWFG

SEQ ID NO: 292406 - protein, 8 aa, Influenza virus
LIAPWFGH

SEQ ID NO: 292407 - protein, 8 aa, Influenza virus
GGLNSTLP

SEQ ID NO: 292408 - protein, 8 aa, Influenza virus
GLNSTLPF

SEQ ID NO: 292409 - protein, 8 aa, Influenza virus
LNTTLPFH

SEQ ID NO: 292410 - protein, 8 aa, Influenza virus
NTTLPFHN

SEQ ID NO: 292411 - protein, 8 aa, Influenza virus
TLPFHNVS

SEQ ID NO: 292412 - protein, 8 aa, Influenza virus
LPFHNVSK

SEQ ID NO: 292413 - protein, 8 aa, Influenza virus
PFHNVSKY

SEQ ID NO: 292414 - protein, 8 aa, Influenza virus
FHNVSKYA

SEQ ID NO: 292415 - protein, 8 aa, Influenza virus
HNVSKYAF

SEQ ID NO: 292416 - protein, 8 aa, Influenza virus
NISKYAFG

SEQ ID NO: 292417 - protein, 8 aa, Influenza virus
ISKYAFGT

SEQ ID NO: 292418 - protein, 8 aa, Influenza virus
SKYAFGTC

SEQ ID NO: 292419 - protein, 8 aa, Influenza virus
KYAFGNCP

SEQ ID NO: 292420 - protein, 8 aa, Influenza virus
YAFGNCPK

SEQ ID NO: 292421 - protein, 8 aa, Influenza virus
AFGNCPKY

SEQ ID NO: 292422 - protein, 8 aa, Influenza virus
KSLKLAIG

SEQ ID NO: 292423 - protein, 8 aa, Influenza virus
SLKLAIGL

SEQ ID NO: 292424 - protein, 8 aa, Influenza virus
LKLAIGLR

SEQ ID NO: 292425 - protein, 8 aa, Influenza virus
KLAIGLRN

SEQ ID NO: 292426 - protein, 8 aa, Influenza virus
LAIGLRNV

SEQ ID NO: 292427 - protein, 8 aa, Influenza virus
GFIEGGWP

SEQ ID NO: 292428 - protein, 8 aa, Influenza virus
FIEGGWPG

SEQ ID NO: 292429 - protein, 8 aa, Influenza virus
IEGGWPGL

SEQ ID NO: 292430 - protein, 8 aa, Influenza virus
EGGWPGLV

SEQ ID NO: 292431 - protein, 8 aa, Influenza virus
GGWPGLVA

SEQ ID NO: 292432 - protein, 8 aa, Influenza virus
GWPGLVAG

SEQ ID NO: 292433 - protein, 8 aa, Influenza virus
WPGLVAGW

SEQ ID NO: 292434 - protein, 8 aa, Influenza virus
PGLVAGWY

SEQ ID NO: 292435 - protein, 8 aa, Influenza virus
GLIAGWYG

SEQ ID NO: 292436 - protein, 8 aa, Influenza virus
LIAGWYGF

SEQ ID NO: 292437 - protein, 8 aa, Influenza virus
IAGWYGFQ

SEQ ID NO: 292438 - protein, 8 aa, Influenza virus
YGFQHSNA

SEQ ID NO: 292439 - protein, 8 aa, Influenza virus
GFQHSNAQ

SEQ ID NO: 292440 - protein, 8 aa, Influenza virus
FQHSNAQG

SEQ ID NO: 292441 - protein, 8 aa, Influenza virus
QGTGMAAD

SEQ ID NO: 292442 - protein, 8 aa, Influenza virus
KVNNIIDK

SEQ ID NO: 292443 - protein, 8 aa, Influenza virus
DKIDDQIQ

SEQ ID NO: 292444 - protein, 8 aa, Influenza virus
KVDDQIQD

SEQ ID NO: 292445 - protein, 8 aa, Influenza virus
DDQIQDVW

SEQ ID NO: 292446 - protein, 8 aa, Influenza virus
DQIQDVWA

SEQ ID NO: 292447 - protein, 8 aa, Influenza virus
QIQDVWAY

SEQ ID NO: 292448 - protein, 8 aa, Influenza virus
IQDVWAYN

SEQ ID NO: 292449 - protein, 8 aa, Influenza virus
QDVWAYNA

SEQ ID NO: 292450 - protein, 8 aa, Influenza virus
DVWAYNAE

SEQ ID NO: 292451 - protein, 8 aa, Influenza virus
VWAYNAEL

SEQ ID NO: 292452 - protein, 8 aa, Influenza virus
AELLVLLG

SEQ ID NO: 292453 - protein, 8 aa, Influenza virus
ELLVLLGN

SEQ ID NO: 292454 - protein, 8 aa, Influenza virus
LLVLLGNQ

SEQ ID NO: 292455 - protein, 8 aa, Influenza virus
LVLLGNQK

SEQ ID NO: 292456 - protein, 8 aa, Influenza virus
VLLGNQKT

SEQ ID NO: 292457 - protein, 8 aa, Influenza virus
LLGNQKTL

SEQ ID NO: 292458 - protein, 8 aa, Influenza virus
LGNQKTLD

SEQ ID NO: 292459 - protein, 8 aa, Influenza virus
GNQKTLDE

SEQ ID NO: 292460 - protein, 8 aa, Influenza virus
QKTLDEHE

SEQ ID NO: 292461 - protein, 8 aa, Influenza virus
KTLDEHVA

SEQ ID NO: 292462 - protein, 8 aa, Influenza virus
TLDEHDTN

SEQ ID NO: 292463 - protein, 8 aa, Influenza virus
LDEHDANA

SEQ ID NO: 292464 - protein, 8 aa, Influenza virus
DEHDANVH

SEQ ID NO: 292465 - protein, 8 aa, Influenza virus
DANVHNLY

SEQ ID NO: 292466 - protein, 8 aa, Influenza virus
ANVNNLYK

SEQ ID NO: 292467 - protein, 8 aa, Influenza virus
VNNLYNRV

SEQ ID NO: 292468 - protein, 8 aa, Influenza virus
NNLYNKVR

SEQ ID NO: 292469 - protein, 8 aa, Influenza virus
EDGNGCFE

SEQ ID NO: 292470 - protein, 8 aa, Influenza virus
DGNGCFEL

SEQ ID NO: 292471 - protein, 8 aa, Influenza virus
GNGCFELY

SEQ ID NO: 292472 - protein, 8 aa, Influenza virus
NGCFELYH

SEQ ID NO: 292473 - protein, 8 aa, Influenza virus
GCFDLYHK

SEQ ID NO: 292474 - protein, 8 aa, Influenza virus
CFDLYHKC

SEQ ID NO: 292475 - protein, 8 aa, Influenza virus
FDLYHKCD

SEQ ID NO: 292476 - protein, 8 aa, Influenza virus
ELYHKCDN

SEQ ID NO: 292477 - protein, 8 aa, Influenza virus
CMATIRNG

SEQ ID NO: 292478 - protein, 8 aa, Influenza virus
MATIRNGT

SEQ ID NO: 292479 - protein, 8 aa, Influenza virus
ATIRNGTY

SEQ ID NO: 292480 - protein, 8 aa, Influenza virus
TIRNGTYD

SEQ ID NO: 292481 - protein, 8 aa, Influenza virus
FEGTYKIL

SEQ ID NO: 292482 - protein, 8 aa, Influenza virus
EGIYKILT

SEQ ID NO: 292483 - protein, 8 aa, Influenza virus
GIYKILTI

SEQ ID NO: 292484 - protein, 8 aa, Influenza virus
IYKILTIY

SEQ ID NO: 292485 - protein, 8 aa, Influenza virus
ILTIYSTA

SEQ ID NO: 292486 - protein, 8 aa, Influenza virus
LTIYSTAA

SEQ ID NO: 292487 - protein, 8 aa, Influenza virus
TIYSTAAS

SEQ ID NO: 292488 - protein, 8 aa, Influenza virus
IYSTAASS

SEQ ID NO: 292489 - protein, 8 aa, Influenza virus
YSTAASSL

SEQ ID NO: 292490 - protein, 8 aa, Influenza virus
STAASSLV

SEQ ID NO: 292491 - protein, 8 aa, Influenza virus
AAFMFWAM

SEQ ID NO: 292492 - protein, 8 aa, Influenza virus
AFMFWAMS

SEQ ID NO: 292493 - protein, 8 aa, Influenza virus
WLKPQCQI

SEQ ID NO: 292494 - protein, 8 aa, Influenza virus
LKPQCQIT

SEQ ID NO: 292495 - protein, 8 aa, Influenza virus
KPQCLITG

SEQ ID NO: 292496 - protein, 8 aa, Influenza virus
PQCLITGF

SEQ ID NO: 292497 - protein, 8 aa, Influenza virus
QCQITGFV

SEQ ID NO: 292498 - protein, 8 aa, Influenza virus
CQITGFVP

SEQ ID NO: 292499 - protein, 8 aa, Influenza virus
GFVPFSKD

SEQ ID NO: 292500 - protein, 8 aa, Influenza virus
SIRLSASG

SEQ ID NO: 292501 - protein, 8 aa, Influenza virus
RLSASGDI

SEQ ID NO: 292502 - protein, 8 aa, Influenza virus
LSASGDIW

SEQ ID NO: 292503 - protein, 8 aa, Influenza virus
LTREPYVS

SEQ ID NO: 292504 - protein, 8 aa, Influenza virus
NREPYVSC

SEQ ID NO: 292505 - protein, 8 aa, Influenza virus
REPYVSCS

SEQ ID NO: 292506 - protein, 8 aa, Influenza virus
NCYQFALG

SEQ ID NO: 292507 - protein, 8 aa, Influenza virus
CYQFALGH

SEQ ID NO: 292508 - protein, 8 aa, Influenza virus
YQFALGHG

SEQ ID NO: 292509 - protein, 8 aa, Influenza virus
QFALGHGT

SEQ ID NO: 292510 - protein, 8 aa, Influenza virus
FALGHGTT

SEQ ID NO: 292511 - protein, 8 aa, Influenza virus
ALGHGTTL

SEQ ID NO: 292512 - protein, 8 aa, Influenza virus
PYRTLLMS

SEQ ID NO: 292513 - protein, 8 aa, Influenza virus
YRTLLMSE

SEQ ID NO: 292514 - protein, 8 aa, Influenza virus
RTLLMSEL

SEQ ID NO: 292515 - protein, 8 aa, Influenza virus
TLLMSELG

SEQ ID NO: 292516 - protein, 8 aa, Influenza virus
LLMSELGV

SEQ ID NO: 292517 - protein, 8 aa, Influenza virus
LMSELGVP

SEQ ID NO: 292518 - protein, 8 aa, Influenza virus
MSELGVPF

SEQ ID NO: 292519 - protein, 8 aa, Influenza virus
SELGVPFH

SEQ ID NO: 292520 - protein, 8 aa, Influenza virus
ELGVPLHL

SEQ ID NO: 292521 - protein, 8 aa, Influenza virus
TKQVCMAW

SEQ ID NO: 292522 - protein, 8 aa, Influenza virus
KQVCMAWS

SEQ ID NO: 292523 - protein, 8 aa, Influenza virus
QVCMAWSS

SEQ ID NO: 292524 - protein, 8 aa, Influenza virus
VCMAWSSS

SEQ ID NO: 292525 - protein, 8 aa, Influenza virus
CMAWSSSS

SEQ ID NO: 292526 - protein, 8 aa, Influenza virus
MAWSSSSC

SEQ ID NO: 292527 - protein, 8 aa, Influenza virus
AWSSSSCY

SEQ ID NO: 292528 - protein, 8 aa, Influenza virus
WSSSSCYD

SEQ ID NO: 292529 - protein, 8 aa, Influenza virus
SSSSCYDG

SEQ ID NO: 292530 - protein, 8 aa, Influenza virus
SSSCHDGR

SEQ ID NO: 292531 - protein, 8 aa, Influenza virus
SSCHDGRA

SEQ ID NO: 292532 - protein, 8 aa, Influenza virus
SCHDGRAW

SEQ ID NO: 292533 - protein, 8 aa, Influenza virus
CHDGRAWL

SEQ ID NO: 292534 - protein, 8 aa, Influenza virus
HDGRAWLH

SEQ ID NO: 292535 - protein, 8 aa, Influenza virus
WLHICVTG

SEQ ID NO: 292536 - protein, 8 aa, Influenza virus
LHICVTGD

SEQ ID NO: 292537 - protein, 8 aa, Influenza virus
HICVTGDD

SEQ ID NO: 292538 - protein, 8 aa, Influenza virus
SILRTQES

SEQ ID NO: 292539 - protein, 8 aa, Influenza virus
ILITQESE

SEQ ID NO: 292540 - protein, 8 aa, Influenza virus
LITQESEC

SEQ ID NO: 292541 - protein, 8 aa, Influenza virus
RTQESECI

SEQ ID NO: 292542 - protein, 8 aa, Influenza virus
TQESECIC

SEQ ID NO: 292543 - protein, 8 aa, Influenza virus
QESECICI

SEQ ID NO: 292544 - protein, 8 aa, Influenza virus
ESECVCIS

SEQ ID NO: 292545 - protein, 8 aa, Influenza virus
SECVCISG

SEQ ID NO: 292546 - protein, 8 aa, Influenza virus
ECVCISGT

SEQ ID NO: 292547 - protein, 8 aa, Influenza virus
CVCISGTC

SEQ ID NO: 292548 - protein, 8 aa, Influenza virus
INGTCAVV

SEQ ID NO: 292549 - protein, 8 aa, Influenza virus
NGTCAVVM

SEQ ID NO: 292550 - protein, 8 aa, Influenza virus
GTCAVVMT

SEQ ID NO: 292551 - protein, 8 aa, Influenza virus
TCAVVMTD

SEQ ID NO: 292552 - protein, 8 aa, Influenza virus
CAVVMTDG

SEQ ID NO: 292553 - protein, 8 aa, Influenza virus
AVVMTDGS

SEQ ID NO: 292554 - protein, 8 aa, Influenza virus
VVMTDGGA

SEQ ID NO: 292555 - protein, 8 aa, Influenza virus
VMTDGGAS

SEQ ID NO: 292556 - protein, 8 aa, Influenza virus
GSAQHIEE

SEQ ID NO: 292557 - protein, 8 aa, Influenza virus
SAQHIEEC

SEQ ID NO: 292558 - protein, 8 aa, Influenza virus
AQHIEECS

SEQ ID NO: 292559 - protein, 8 aa, Influenza virus
QHIEECSC

SEQ ID NO: 292560 - protein, 8 aa, Influenza virus
HIEECSCY

SEQ ID NO: 292561 - protein, 8 aa, Influenza virus
IEECSCYP

SEQ ID NO: 292562 - protein, 8 aa, Influenza virus
EECSCYPQ

SEQ ID NO: 292563 - protein, 8 aa, Influenza virus
ECSCYPQY

SEQ ID NO: 292564 - protein, 8 aa, Influenza virus
CVCRDNWR

SEQ ID NO: 292565 - protein, 8 aa, Influenza virus
VCRDNWRG

SEQ ID NO: 292566 - protein, 8 aa, Influenza virus
CRDNWRGS

SEQ ID NO: 292567 - protein, 8 aa, Influenza virus
RDNWRGSN

SEQ ID NO: 292568 - protein, 8 aa, Influenza virus
DNWRGSNR

SEQ ID NO: 292569 - protein, 8 aa, Influenza virus
NWRGSNRP

SEQ ID NO: 292570 - protein, 8 aa, Influenza virus
WRGSNRPV

SEQ ID NO: 292571 - protein, 8 aa, Influenza virus
YLCSGLVG

SEQ ID NO: 292572 - protein, 8 aa, Influenza virus
LCSGLVGD

SEQ ID NO: 292573 - protein, 8 aa, Influenza virus
LVGDTPRS

SEQ ID NO: 292574 - protein, 8 aa, Influenza virus
SGVKGWAF

SEQ ID NO: 292575 - protein, 8 aa, Influenza virus
GVKGWGFD

SEQ ID NO: 292576 - protein, 8 aa, Influenza virus
DVWMGRTI

SEQ ID NO: 292577 - protein, 8 aa, Influenza virus
CVNRCFYV

SEQ ID NO: 292578 - protein, 8 aa, Influenza virus
VNRCFYVE

SEQ ID NO: 292579 - protein, 8 aa, Influenza virus
RCFYVELV

SEQ ID NO: 292580 - protein, 8 aa, Influenza virus
CFYVELVR

SEQ ID NO: 292581 - protein, 8 aa, Influenza virus
FYVELVRG

SEQ ID NO: 292582 - protein, 8 aa, Influenza virus
YVELVRGR

SEQ ID NO: 292583 - protein, 8 aa, Influenza virus
VELVRGRP

SEQ ID NO: 292584 - protein, 8 aa, Influenza virus
KVWWTSNS

SEQ ID NO: 292585 - protein, 8 aa, Influenza virus
VWWTANSI

SEQ ID NO: 292586 - protein, 8 aa, Influenza virus
FCGTSGSY

SEQ ID NO: 292587 - protein, 8 aa, Influenza virus
CGTSGSYG

SEQ ID NO: 292588 - protein, 8 aa, Influenza virus
TSGSYGTG

SEQ ID NO: 292589 - protein, 8 aa, Influenza virus
GSYGTGSW

SEQ ID NO: 292590 - protein, 8 aa, Influenza virus
SYGTGSWP

SEQ ID NO: 292591 - protein, 8 aa, Influenza virus
YGAGSWPD

SEQ ID NO: 292592 - protein, 8 aa, Influenza virus
GAGSWPDG

SEQ ID NO: 292593 - protein, 8 aa, Influenza virus
AGSWPDGA

SEQ ID NO: 292594 - protein, 8 aa, Influenza virus
GSWPDGAD

SEQ ID NO: 292595 - protein, 8 aa, Influenza virus
SWPDGADI

SEQ ID NO: 292596 - protein, 8 aa, Influenza virus
ETYVLSII

SEQ ID NO: 292597 - protein, 8 aa, Influenza virus
TYVLSIIP

SEQ ID NO: 292598 - protein, 8 aa, Influenza virus
YVLSIIPS

SEQ ID NO: 292599 - protein, 8 aa, Influenza virus
VLSIIPSG

SEQ ID NO: 292600 - protein, 8 aa, Influenza virus
LSIIPSGP

SEQ ID NO: 292601 - protein, 8 aa, Influenza virus
SIIPSGPL

SEQ ID NO: 292602 - protein, 8 aa, Influenza virus
IIPSGPLK

SEQ ID NO: 292603 - protein, 8 aa, Influenza virus
IPSGPLKA

SEQ ID NO: 292604 - protein, 8 aa, Influenza virus
LKAEIAQK

SEQ ID NO: 292605 - protein, 8 aa, Influenza virus
KAEIAQKL

SEQ ID NO: 292606 - protein, 8 aa, Influenza virus
AEIAQKLE

SEQ ID NO: 292607 - protein, 8 aa, Influenza virus
EIAQRLES

SEQ ID NO: 292608 - protein, 8 aa, Influenza virus
IAQRLESV

SEQ ID NO: 292609 - protein, 8 aa, Influenza virus
AQRLESVF

SEQ ID NO: 292610 - protein, 8 aa, Influenza virus
QRLESVFA

SEQ ID NO: 292611 - protein, 8 aa, Influenza virus
RLESVFAG

SEQ ID NO: 292612 - protein, 8 aa, Influenza virus
LESVFAGK

SEQ ID NO: 292613 - protein, 8 aa, Influenza virus
ESVFAGKN

SEQ ID NO: 292614 - protein, 8 aa, Influenza virus
VFAGKNAD

SEQ ID NO: 292615 - protein, 8 aa, Influenza virus
FAGKNADL

SEQ ID NO: 292616 - protein, 8 aa, Influenza virus
AGKNADLE

SEQ ID NO: 292617 - protein, 8 aa, Influenza virus
GKNADLEA

SEQ ID NO: 292618 - protein, 8 aa, Influenza virus
KNADLEAL

SEQ ID NO: 292619 - protein, 8 aa, Influenza virus
NADLEALM

SEQ ID NO: 292620 - protein, 8 aa, Influenza virus
ADLEALME

SEQ ID NO: 292621 - protein, 8 aa, Influenza virus
LEALMEWI

SEQ ID NO: 292622 - protein, 8 aa, Influenza virus
EALMEWIK

SEQ ID NO: 292623 - protein, 8 aa, Influenza virus
ALMEWIKT

SEQ ID NO: 292624 - protein, 8 aa, Influenza virus
LMEWIKTR

SEQ ID NO: 292625 - protein, 8 aa, Influenza virus
MEWIKTRP

SEQ ID NO: 292626 - protein, 8 aa, Influenza virus
EWIKTRPI

SEQ ID NO: 292627 - protein, 8 aa, Influenza virus
WIKTRPIL

SEQ ID NO: 292628 - protein, 8 aa, Influenza virus
IKTRPILS

SEQ ID NO: 292629 - protein, 8 aa, Influenza virus
LSPLTKGM

SEQ ID NO: 292630 - protein, 8 aa, Influenza virus
SPLTKGML

SEQ ID NO: 292631 - protein, 8 aa, Influenza virus
PLTKGMLG

SEQ ID NO: 292632 - protein, 8 aa, Influenza virus
LTKGMLGF

SEQ ID NO: 292633 - protein, 8 aa, Influenza virus
TKGMLGFV

SEQ ID NO: 292634 - protein, 8 aa, Influenza virus
KGMLGFVF

SEQ ID NO: 292635 - protein, 8 aa, Influenza virus
GMLGFVFT

SEQ ID NO: 292636 - protein, 8 aa, Influenza virus
MLGFVFTL

SEQ ID NO: 292637 - protein, 8 aa, Influenza virus
GLQRRRFI

SEQ ID NO: 292638 - protein, 8 aa, Influenza virus
LQRRRFIQ

SEQ ID NO: 292639 - protein, 8 aa, Influenza virus
QRRRFIQN

SEQ ID NO: 292640 - protein, 8 aa, Influenza virus
RRRFIQNA

SEQ ID NO: 292641 - protein, 8 aa, Influenza virus
RRFIQNAL

SEQ ID NO: 292642 - protein, 8 aa, Influenza virus
RFVQNALS

SEQ ID NO: 292643 - protein, 8 aa, Influenza virus
FVQNALSG

SEQ ID NO: 292644 - protein, 8 aa, Influenza virus
VQNALSGN

SEQ ID NO: 292645 - protein, 8 aa, Influenza virus
QNALSGNG

SEQ ID NO: 292646 - protein, 8 aa, Influenza virus
NALSGNGD

SEQ ID NO: 292647 - protein, 8 aa, Influenza virus
ALSGNGDP

SEQ ID NO: 292648 - protein, 8 aa, Influenza virus
LSGNGDPN

SEQ ID NO: 292649 - protein, 8 aa, Influenza virus
SGNGDPNN

SEQ ID NO: 292650 - protein, 8 aa, Influenza virus
GDPNNMDK

SEQ ID NO: 292651 - protein, 8 aa, Influenza virus
DPNNMDKA

SEQ ID NO: 292652 - protein, 8 aa, Influenza virus
PNNMDKAV

SEQ ID NO: 292653 - protein, 8 aa, Influenza virus
NNMDKAVK

SEQ ID NO: 292654 - protein, 8 aa, Influenza virus
NMDKAVKL

SEQ ID NO: 292655 - protein, 8 aa, Influenza virus
MDKAVKLY

SEQ ID NO: 292656 - protein, 8 aa, Influenza virus
DRAVKLYK

SEQ ID NO: 292657 - protein, 8 aa, Influenza virus
RAVKLYKK

SEQ ID NO: 292658 - protein, 8 aa, Influenza virus
AVKLYKKL

SEQ ID NO: 292659 - protein, 8 aa, Influenza virus
VKLYKKLK

SEQ ID NO: 292660 - protein, 8 aa, Influenza virus
KLYKKLKR

SEQ ID NO: 292661 - protein, 8 aa, Influenza virus
LYKKLKRE

SEQ ID NO: 292662 - protein, 8 aa, Influenza virus
YKKLKREI

SEQ ID NO: 292663 - protein, 8 aa, Influenza virus
KKLKREIT

SEQ ID NO: 292664 - protein, 8 aa, Influenza virus
KLKREMTF

SEQ ID NO: 292665 - protein, 8 aa, Influenza virus
LKREMTFH

SEQ ID NO: 292666 - protein, 8 aa, Influenza virus
KREMTFHG

SEQ ID NO: 292667 - protein, 8 aa, Influenza virus
REMTFHGA

SEQ ID NO: 292668 - protein, 8 aa, Influenza virus
EMTFHGAK

SEQ ID NO: 292669 - protein, 8 aa, Influenza virus
MTFHGAKE

SEQ ID NO: 292670 - protein, 8 aa, Influenza virus
TFHGAKEI

SEQ ID NO: 292671 - protein, 8 aa, Influenza virus
FHGAKEIA

SEQ ID NO: 292672 - protein, 8 aa, Influenza virus
HGAKEIAL

SEQ ID NO: 292673 - protein, 8 aa, Influenza virus
GAKEIALS

SEQ ID NO: 292674 - protein, 8 aa, Influenza virus
AKEIALSY

SEQ ID NO: 292675 - protein, 8 aa, Influenza virus
KEIALSYS

SEQ ID NO: 292676 - protein, 8 aa, Influenza virus
EIALSYSA

SEQ ID NO: 292677 - protein, 8 aa, Influenza virus
IALSYSAG

SEQ ID NO: 292678 - protein, 8 aa, Influenza virus
ALSYSAGA

SEQ ID NO: 292679 - protein, 8 aa, Influenza virus
LSYSAGAL

SEQ ID NO: 292680 - protein, 8 aa, Influenza virus
SYSAGALA

SEQ ID NO: 292681 - protein, 8 aa, Influenza virus
YSAGALAS

SEQ ID NO: 292682 - protein, 8 aa, Influenza virus
SAGALASC

SEQ ID NO: 292683 - protein, 8 aa, Influenza virus
AGALASCM

SEQ ID NO: 292684 - protein, 8 aa, Influenza virus
LIYNRMGA

SEQ ID NO: 292685 - protein, 8 aa, Influenza virus
IYNRMGAV

SEQ ID NO: 292686 - protein, 8 aa, Influenza virus
YNRMGAVT

SEQ ID NO: 292687 - protein, 8 aa, Influenza virus
AFGLICAT

SEQ ID NO: 292688 - protein, 8 aa, Influenza virus
FGLICATC

SEQ ID NO: 292689 - protein, 8 aa, Influenza virus
GLICATCE

SEQ ID NO: 292690 - protein, 8 aa, Influenza virus
LICATCEQ

SEQ ID NO: 292691 - protein, 8 aa, Influenza virus
ICATCEQI

SEQ ID NO: 292692 - protein, 8 aa, Influenza virus
TCEQIADA

SEQ ID NO: 292693 - protein, 8 aa, Influenza virus
CEQIADAQ

SEQ ID NO: 292694 - protein, 8 aa, Influenza virus
EQIADAQH

SEQ ID NO: 292695 - protein, 8 aa, Influenza virus
QIADSQHK

SEQ ID NO: 292696 - protein, 8 aa, Influenza virus
IADSQHKS

SEQ ID NO: 292697 - protein, 8 aa, Influenza virus
ADSQHKSH

SEQ ID NO: 292698 - protein, 8 aa, Influenza virus
DSQHKSHR

SEQ ID NO: 292699 - protein, 8 aa, Influenza virus
SQHKSHRQ

SEQ ID NO: 292700 - protein, 8 aa, Influenza virus
QHKSHRQM

SEQ ID NO: 292701 - protein, 8 aa, Influenza virus
HRSHRQMA

SEQ ID NO: 292702 - protein, 8 aa, Influenza virus
ATTNPLIK

SEQ ID NO: 292703 - protein, 8 aa, Influenza virus
TTNPLIKH

SEQ ID NO: 292704 - protein, 8 aa, Influenza virus
TNPLIKHE

SEQ ID NO: 292705 - protein, 8 aa, Influenza virus
NPLIKHEN

SEQ ID NO: 292706 - protein, 8 aa, Influenza virus
PLIKHENR

SEQ ID NO: 292707 - protein, 8 aa, Influenza virus
LIKHENRM

SEQ ID NO: 292708 - protein, 8 aa, Influenza virus
IKHENRMV

SEQ ID NO: 292709 - protein, 8 aa, Influenza virus
KHENRMVL

SEQ ID NO: 292710 - protein, 8 aa, Influenza virus
HENRMVIA

SEQ ID NO: 292711 - protein, 8 aa, Influenza virus
ENRMVIAS

SEQ ID NO: 292712 - protein, 8 aa, Influenza virus
NRMVIAST

SEQ ID NO: 292713 - protein, 8 aa, Influenza virus
RMVIASTT

SEQ ID NO: 292714 - protein, 8 aa, Influenza virus
MVIASTTA

SEQ ID NO: 292715 - protein, 8 aa, Influenza virus
VIASTTAK

SEQ ID NO: 292716 - protein, 8 aa, Influenza virus
IASTTAKA

SEQ ID NO: 292717 - protein, 8 aa, Influenza virus
TAKAMEQV

SEQ ID NO: 292718 - protein, 8 aa, Influenza virus
AKAMEQVA

SEQ ID NO: 292719 - protein, 8 aa, Influenza virus
KAMEQVAG

SEQ ID NO: 292720 - protein, 8 aa, Influenza virus
AMEQVAGS

SEQ ID NO: 292721 - protein, 8 aa, Influenza virus
MEQVAGSS

SEQ ID NO: 292722 - protein, 8 aa, Influenza virus
EQVAGSSE

SEQ ID NO: 292723 - protein, 8 aa, Influenza virus
QVAGSSEQ

SEQ ID NO: 292724 - protein, 8 aa, Influenza virus
VAGSSEQA

SEQ ID NO: 292725 - protein, 8 aa, Influenza virus
SEQAAEAI

SEQ ID NO: 292726 - protein, 8 aa, Influenza virus
EQAAEAMD

SEQ ID NO: 292727 - protein, 8 aa, Influenza virus
QAAEAMEI

SEQ ID NO: 292728 - protein, 8 aa, Influenza virus
AAEAMEIA

SEQ ID NO: 292729 - protein, 8 aa, Influenza virus
TRQMVHAM

SEQ ID NO: 292730 - protein, 8 aa, Influenza virus
RQMVHAMR

SEQ ID NO: 292731 - protein, 8 aa, Influenza virus
QMVHAMRT

SEQ ID NO: 292732 - protein, 8 aa, Influenza virus
MVHAMRTI

SEQ ID NO: 292733 - protein, 8 aa, Influenza virus
VHAMRTIG

SEQ ID NO: 292734 - protein, 8 aa, Influenza virus
HAMRTIGT

SEQ ID NO: 292735 - protein, 8 aa, Influenza virus
AMRAIGTH

SEQ ID NO: 292736 - protein, 8 aa, Influenza virus
MRAIGTHP

SEQ ID NO: 292737 - protein, 8 aa, Influenza virus
DNLLENLQ

SEQ ID NO: 292738 - protein, 8 aa, Influenza virus
DLLENLQT

SEQ ID NO: 292739 - protein, 8 aa, Influenza virus
LLENLQTY

SEQ ID NO: 292740 - protein, 8 aa, Influenza virus
LENLQTYQ

SEQ ID NO: 292741 - protein, 8 aa, Influenza virus
ENLQTYQK

SEQ ID NO: 292742 - protein, 8 aa, Influenza virus
NLQTYQKR

SEQ ID NO: 292743 - protein, 8 aa, Influenza virus
LQTYQKRM

SEQ ID NO: 292744 - protein, 8 aa, Influenza virus
QTYQKRMG

SEQ ID NO: 292745 - protein, 8 aa, Influenza virus
TYQKRMGV

SEQ ID NO: 292746 - protein, 8 aa, Influenza virus
YQKRMGLQ

SEQ ID NO: 292747 - protein, 8 aa, Influenza virus
QKRMGVQL

SEQ ID NO: 292748 - protein, 8 aa, Influenza virus
KRMGVQLQ

SEQ ID NO: 292749 - protein, 8 aa, Influenza virus
RMGVQLQR

SEQ ID NO: 292750 - protein, 8 aa, Influenza virus
MGVQLQRF

SEQ ID NO: 292751 - protein, 8 aa, Influenza virus
GVQLQRFK

SEQ ID NO: 292752 - protein, 8 aa, Influenza virus
PDSSWLFG

SEQ ID NO: 292753 - protein, 8 aa, Influenza virus
SRHCSKYH

SEQ ID NO: 292754 - protein, 8 aa, Influenza virus
LLTEVETL

SEQ ID NO: 292755 - protein, 8 aa, Influenza virus
LTEVETPI

SEQ ID NO: 292756 - protein, 8 aa, Influenza virus
GIVHLILW

SEQ ID NO: 292757 - protein, 8 aa, Influenza virus
IVHLILWI

SEQ ID NO: 292758 - protein, 8 aa, Influenza virus
GVPKSMRE

SEQ ID NO: 292759 - protein, 8 aa, Influenza virus
VPKSMREE

SEQ ID NO: 292760 - protein, 8 aa, Influenza virus
PKSMREEY

SEQ ID NO: 292761 - protein, 8 aa, Influenza virus
ESMREEYQ

SEQ ID NO: 292762 - protein, 8 aa, Influenza virus
SMREEYQQ

SEQ ID NO: 292763 - protein, 8 aa, Influenza virus
MREEYQQE

SEQ ID NO: 292764 - protein, 8 aa, Influenza virus
REEYQQEQ

SEQ ID NO: 292765 - protein, 8 aa, Influenza virus
FVNIELED

SEQ ID NO: 292766 - protein, 8 aa, Influenza virus
MSDINIMA

SEQ ID NO: 292767 - protein, 8 aa, Influenza virus
SDINIMAS

SEQ ID NO: 292768 - protein, 8 aa, Influenza virus
DINIMASQ

SEQ ID NO: 292769 - protein, 8 aa, Influenza virus
INIMASQG

SEQ ID NO: 292770 - protein, 8 aa, Influenza virus
NIMASQGT

SEQ ID NO: 292771 - protein, 8 aa, Influenza virus
IMASQGTK

SEQ ID NO: 292772 - protein, 8 aa, Influenza virus
MALQGTKR

SEQ ID NO: 292773 - protein, 8 aa, Influenza virus
ALQGTKRS

SEQ ID NO: 292774 - protein, 8 aa, Influenza virus
SQGTKRSH

SEQ ID NO: 292775 - protein, 8 aa, Influenza virus
QGTKRSHE

SEQ ID NO: 292776 - protein, 8 aa, Influenza virus
GTKRSHEQ

SEQ ID NO: 292777 - protein, 8 aa, Influenza virus
TKRSHEQM

SEQ ID NO: 292778 - protein, 8 aa, Influenza virus
KRSHEQME

SEQ ID NO: 292779 - protein, 8 aa, Influenza virus
RSHEQMET

SEQ ID NO: 292780 - protein, 8 aa, Influenza virus
SYEQMETD

SEQ ID NO: 292781 - protein, 8 aa, Influenza virus
YEQMETDG

SEQ ID NO: 292782 - protein, 8 aa, Influenza virus
EQMETDGD

SEQ ID NO: 292783 - protein, 8 aa, Influenza virus
QMETDGDR

SEQ ID NO: 292784 - protein, 8 aa, Influenza virus
METDGDRQ

SEQ ID NO: 292785 - protein, 8 aa, Influenza virus
RQDATEIR

SEQ ID NO: 292786 - protein, 8 aa, Influenza virus
ATEIRSSV

SEQ ID NO: 292787 - protein, 8 aa, Influenza virus
TEIRSSVG

SEQ ID NO: 292788 - protein, 8 aa, Influenza virus
EIRASVGK

SEQ ID NO: 292789 - protein, 8 aa, Influenza virus
IRASVGKM

SEQ ID NO: 292790 - protein, 8 aa, Influenza virus
RASVGRMI

SEQ ID NO: 292791 - protein, 8 aa, Influenza virus
DGIGRFYI

SEQ ID NO: 292792 - protein, 8 aa, Influenza virus
GIGRFYVQ

SEQ ID NO: 292793 - protein, 8 aa, Influenza virus
IGRFYVQM

SEQ ID NO: 292794 - protein, 8 aa, Influenza virus
GRFYVQMC

SEQ ID NO: 292795 - protein, 8 aa, Influenza virus
RFYVQMCT

SEQ ID NO: 292796 - protein, 8 aa, Influenza virus
FYVQMCTE

SEQ ID NO: 292797 - protein, 8 aa, Influenza virus
YVQMCTEL

SEQ ID NO: 292798 - protein, 8 aa, Influenza virus
VQMCTELK

SEQ ID NO: 292799 - protein, 8 aa, Influenza virus
QMCTELQL

SEQ ID NO: 292800 - protein, 8 aa, Influenza virus
MCTELKLN

SEQ ID NO: 292801 - protein, 8 aa, Influenza virus
CTELKLND

SEQ ID NO: 292802 - protein, 8 aa, Influenza virus
YDGRLIQN

SEQ ID NO: 292803 - protein, 8 aa, Influenza virus
DGRLIQNS

SEQ ID NO: 292804 - protein, 8 aa, Influenza virus
GRLIQNSL

SEQ ID NO: 292805 - protein, 8 aa, Influenza virus
RLIQNSLT

SEQ ID NO: 292806 - protein, 8 aa, Influenza virus
LIQNSLTI

SEQ ID NO: 292807 - protein, 8 aa, Influenza virus
IQNSLTIE

SEQ ID NO: 292808 - protein, 8 aa, Influenza virus
QNSLTIEK

SEQ ID NO: 292809 - protein, 8 aa, Influenza virus
NSLTIEKM

SEQ ID NO: 292810 - protein, 8 aa, Influenza virus
TIEKMVLS

SEQ ID NO: 292811 - protein, 8 aa, Influenza virus
IEKMVLSA

SEQ ID NO: 292812 - protein, 8 aa, Influenza virus
EKMVLSAF

SEQ ID NO: 292813 - protein, 8 aa, Influenza virus
KMVLSAFD

SEQ ID NO: 292814 - protein, 8 aa, Influenza virus
AFDERRNR

SEQ ID NO: 292815 - protein, 8 aa, Influenza virus
FDERRNRY

SEQ ID NO: 292816 - protein, 8 aa, Influenza virus
DERRNRYL

SEQ ID NO: 292817 - protein, 8 aa, Influenza virus
ERRNRYLE

SEQ ID NO: 292818 - protein, 8 aa, Influenza virus
RRNRYLEE

SEQ ID NO: 292819 - protein, 8 aa, Influenza virus
RNRYLEEH

SEQ ID NO: 292820 - protein, 8 aa, Influenza virus
NRYLEEHP

SEQ ID NO: 292821 - protein, 8 aa, Influenza virus
RYLEEHPS

SEQ ID NO: 292822 - protein, 8 aa, Influenza virus
YLEEHPST

SEQ ID NO: 292823 - protein, 8 aa, Influenza virus
LEEHPSTG

SEQ ID NO: 292824 - protein, 8 aa, Influenza virus
EEHPNAGK

SEQ ID NO: 292825 - protein, 8 aa, Influenza virus
EHPNAGKD

SEQ ID NO: 292826 - protein, 8 aa, Influenza virus
HPNAGKDP

SEQ ID NO: 292827 - protein, 8 aa, Influenza virus
PNAGKDPK

SEQ ID NO: 292828 - protein, 8 aa, Influenza virus
NAGKDPKK

SEQ ID NO: 292829 - protein, 8 aa, Influenza virus
TGKDPKKT

SEQ ID NO: 292830 - protein, 8 aa, Influenza virus
KTGGPIYK

SEQ ID NO: 292831 - protein, 8 aa, Influenza virus
TGGPIYKR

SEQ ID NO: 292832 - protein, 8 aa, Influenza virus
RELVLYDK

SEQ ID NO: 292833 - protein, 8 aa, Influenza virus
ELVLYDKE

SEQ ID NO: 292834 - protein, 8 aa, Influenza virus
LVLYDKEE

SEQ ID NO: 292835 - protein, 8 aa, Influenza virus
KEEIRRVW

SEQ ID NO: 292836 - protein, 8 aa, Influenza virus
EIRRVWRQ

SEQ ID NO: 292837 - protein, 8 aa, Influenza virus
IRRVWRQA

SEQ ID NO: 292838 - protein, 8 aa, Influenza virus
RRVWRQAN

SEQ ID NO: 292839 - protein, 8 aa, Influenza virus
RVWRQANN

SEQ ID NO: 292840 - protein, 8 aa, Influenza virus
VWRQANNG

SEQ ID NO: 292841 - protein, 8 aa, Influenza virus
WRQANNGD

SEQ ID NO: 292842 - protein, 8 aa, Influenza virus
RQANNGDD

SEQ ID NO: 292843 - protein, 8 aa, Influenza virus
QANNGDDA

SEQ ID NO: 292844 - protein, 8 aa, Influenza virus
AGLTHLMI

SEQ ID NO: 292845 - protein, 8 aa, Influenza virus
GLTHLMIW

SEQ ID NO: 292846 - protein, 8 aa, Influenza virus
LTHLMIWH

SEQ ID NO: 292847 - protein, 8 aa, Influenza virus
THLMIWHS

SEQ ID NO: 292848 - protein, 8 aa, Influenza virus
HLMIWHSN

SEQ ID NO: 292849 - protein, 8 aa, Influenza virus
LMIWHSNL

SEQ ID NO: 292850 - protein, 8 aa, Influenza virus
WHSNLNDT

SEQ ID NO: 292851 - protein, 8 aa, Influenza virus
HSNLNDTT

SEQ ID NO: 292852 - protein, 8 aa, Influenza virus
SNLNDTTY

SEQ ID NO: 292853 - protein, 8 aa, Influenza virus
NLNDTTYQ

SEQ ID NO: 292854 - protein, 8 aa, Influenza virus
LNDTTYQR

SEQ ID NO: 292855 - protein, 8 aa, Influenza virus
NDTTYQRT

SEQ ID NO: 292856 - protein, 8 aa, Influenza virus
DTTYQRTR

SEQ ID NO: 292857 - protein, 8 aa, Influenza virus
TTYQRTRA

SEQ ID NO: 292858 - protein, 8 aa, Influenza virus
RTRALVRS

SEQ ID NO: 292859 - protein, 8 aa, Influenza virus
TRALVRSG

SEQ ID NO: 292860 - protein, 8 aa, Influenza virus
RALVRSGM

SEQ ID NO: 292861 - protein, 8 aa, Influenza virus
ALVRSGMD

SEQ ID NO: 292862 - protein, 8 aa, Influenza virus
LVRSGMDP

SEQ ID NO: 292863 - protein, 8 aa, Influenza virus
VRSGMDPR

SEQ ID NO: 292864 - protein, 8 aa, Influenza virus
RSGMDPRM

SEQ ID NO: 292865 - protein, 8 aa, Influenza virus
SGMDPRMC

SEQ ID NO: 292866 - protein, 8 aa, Influenza virus
SGAAGAAI

SEQ ID NO: 292867 - protein, 8 aa, Influenza virus
GAAGAAIK

SEQ ID NO: 292868 - protein, 8 aa, Influenza virus
AAGAAIKG

SEQ ID NO: 292869 - protein, 8 aa, Influenza virus
AGAAVKGI

SEQ ID NO: 292870 - protein, 8 aa, Influenza virus
GAAVKGIG

SEQ ID NO: 292871 - protein, 8 aa, Influenza virus
AAVKGIGT

SEQ ID NO: 292872 - protein, 8 aa, Influenza virus
AVKGVGTI

SEQ ID NO: 292873 - protein, 8 aa, Influenza virus
AMELIRMI

SEQ ID NO: 292874 - protein, 8 aa, Influenza virus
MELIRMVK

SEQ ID NO: 292875 - protein, 8 aa, Influenza virus
ELIRMVKR

SEQ ID NO: 292876 - protein, 8 aa, Influenza virus
LIRMVKRG

SEQ ID NO: 292877 - protein, 8 aa, Influenza virus
IRMVKRGI

SEQ ID NO: 292878 - protein, 8 aa, Influenza virus
RMVKRGIN

SEQ ID NO: 292879 - protein, 8 aa, Influenza virus
MVKRGIND

SEQ ID NO: 292880 - protein, 8 aa, Influenza virus
VKRGINDR

SEQ ID NO: 292881 - protein, 8 aa, Influenza virus
KRGVNDRN

SEQ ID NO: 292882 - protein, 8 aa, Influenza virus
RGVNDRNF

SEQ ID NO: 292883 - protein, 8 aa, Influenza virus
GVNDRNFW

SEQ ID NO: 292884 - protein, 8 aa, Influenza virus
VNDRNFWR

SEQ ID NO: 292885 - protein, 8 aa, Influenza virus
DRNFWRGD

SEQ ID NO: 292886 - protein, 8 aa, Influenza virus
RNFWRGDN

SEQ ID NO: 292887 - protein, 8 aa, Influenza virus
NFWRGDNG

SEQ ID NO: 292888 - protein, 8 aa, Influenza virus
FWRGDNGR

SEQ ID NO: 292889 - protein, 8 aa, Influenza virus
WRGENGRK

SEQ ID NO: 292890 - protein, 8 aa, Influenza virus
RGENGRKT

SEQ ID NO: 292891 - protein, 8 aa, Influenza virus
GENGRKTR

SEQ ID NO: 292892 - protein, 8 aa, Influenza virus
TRVAYERM

SEQ ID NO: 292893 - protein, 8 aa, Influenza virus
RVAYERMC

SEQ ID NO: 292894 - protein, 8 aa, Influenza virus
VAYERMCN

SEQ ID NO: 292895 - protein, 8 aa, Influenza virus
KFQTAAQK

SEQ ID NO: 292896 - protein, 8 aa, Influenza virus
FQTAAQKA

SEQ ID NO: 292897 - protein, 8 aa, Influenza virus
QTAAQKAM

SEQ ID NO: 292898 - protein, 8 aa, Influenza virus
TAAQRAMV

SEQ ID NO: 292899 - protein, 8 aa, Influenza virus
AAQRAMVD

SEQ ID NO: 292900 - protein, 8 aa, Influenza virus
AQRAMVDQ

SEQ ID NO: 292901 - protein, 8 aa, Influenza virus
QRAMVDQV

SEQ ID NO: 292902 - protein, 8 aa, Influenza virus
RAMVDQVR

SEQ ID NO: 292903 - protein, 8 aa, Influenza virus
AMVDQVRE

SEQ ID NO: 292904 - protein, 8 aa, Influenza virus
MVDQVRES

SEQ ID NO: 292905 - protein, 8 aa, Influenza virus
VDQVRESR

SEQ ID NO: 292906 - protein, 8 aa, Influenza virus
DQVREGRN

SEQ ID NO: 292907 - protein, 8 aa, Influenza virus
QVREGRNP

SEQ ID NO: 292908 - protein, 8 aa, Influenza virus
VREGRNPG

SEQ ID NO: 292909 - protein, 8 aa, Influenza virus
REGRNPGN

SEQ ID NO: 292910 - protein, 8 aa, Influenza virus
EGRNPGNA

SEQ ID NO: 292911 - protein, 8 aa, Influenza virus
GRNPGNAE

SEQ ID NO: 292912 - protein, 8 aa, Influenza virus
RSPGNAEI

SEQ ID NO: 292913 - protein, 8 aa, Influenza virus
SPGNAEIE

SEQ ID NO: 292914 - protein, 8 aa, Influenza virus
NAEIEDLT

SEQ ID NO: 292915 - protein, 8 aa, Influenza virus
AEIEDLTF

SEQ ID NO: 292916 - protein, 8 aa, Influenza virus
EIEDLTFL

SEQ ID NO: 292917 - protein, 8 aa, Influenza virus
IEDLTFLA

SEQ ID NO: 292918 - protein, 8 aa, Influenza virus
EDLTFLAR

SEQ ID NO: 292919 - protein, 8 aa, Influenza virus
DLTFLARS

SEQ ID NO: 292920 - protein, 8 aa, Influenza virus
LTFLARSA

SEQ ID NO: 292921 - protein, 8 aa, Influenza virus
TFLARSAL

SEQ ID NO: 292922 - protein, 8 aa, Influenza virus
FSARSALI

SEQ ID NO: 292923 - protein, 8 aa, Influenza virus
SARSALIL

SEQ ID NO: 292924 - protein, 8 aa, Influenza virus
ALILRGSI

SEQ ID NO: 292925 - protein, 8 aa, Influenza virus
LILRGSIA

SEQ ID NO: 292926 - protein, 8 aa, Influenza virus
ILRGSIAH

SEQ ID NO: 292927 - protein, 8 aa, Influenza virus
LRGSIAHK

SEQ ID NO: 292928 - protein, 8 aa, Influenza virus
RGSIAHKS

SEQ ID NO: 292929 - protein, 8 aa, Influenza virus
GSIAHKSC

SEQ ID NO: 292930 - protein, 8 aa, Influenza virus
SIAHKSCL

SEQ ID NO: 292931 - protein, 8 aa, Influenza virus
IAHKSCLP

SEQ ID NO: 292932 - protein, 8 aa, Influenza virus
KSCLPACA

SEQ ID NO: 292933 - protein, 8 aa, Influenza virus
SCLPACAY

SEQ ID NO: 292934 - protein, 8 aa, Influenza virus
CLPACAYG

SEQ ID NO: 292935 - protein, 8 aa, Influenza virus
LPACVYGP

SEQ ID NO: 292936 - protein, 8 aa, Influenza virus
PACVYGPA

SEQ ID NO: 292937 - protein, 8 aa, Influenza virus
ACVYGPAV

SEQ ID NO: 292938 - protein, 8 aa, Influenza virus
SGHDFERE

SEQ ID NO: 292939 - protein, 8 aa, Influenza virus
GHDFEREG

SEQ ID NO: 292940 - protein, 8 aa, Influenza virus
HDFEREGY

SEQ ID NO: 292941 - protein, 8 aa, Influenza virus
DFEKEGYS

SEQ ID NO: 292942 - protein, 8 aa, Influenza virus
FEKEGYSL

SEQ ID NO: 292943 - protein, 8 aa, Influenza virus
EKEGYSLV

SEQ ID NO: 292944 - protein, 8 aa, Influenza virus
KEGYSLVG

SEQ ID NO: 292945 - protein, 8 aa, Influenza virus
EGYSLVGV

SEQ ID NO: 292946 - protein, 8 aa, Influenza virus
GYSLVGVD

SEQ ID NO: 292947 - protein, 8 aa, Influenza virus
YSLVGVDP

SEQ ID NO: 292948 - protein, 8 aa, Influenza virus
SLVGVDPF

SEQ ID NO: 292949 - protein, 8 aa, Influenza virus
LVGIDPFR

SEQ ID NO: 292950 - protein, 8 aa, Influenza virus
VGIDPFRL

SEQ ID NO: 292951 - protein, 8 aa, Influenza virus
GIDPFRLL

SEQ ID NO: 292952 - protein, 8 aa, Influenza virus
IDPFRLLQ

SEQ ID NO: 292953 - protein, 8 aa, Influenza virus
DPFRLLQN

SEQ ID NO: 292954 - protein, 8 aa, Influenza virus
PFRLLQNS

SEQ ID NO: 292955 - protein, 8 aa, Influenza virus
FRLLQNSQ

SEQ ID NO: 292956 - protein, 8 aa, Influenza virus
KLLQNSQV

SEQ ID NO: 292957 - protein, 8 aa, Influenza virus
SLMRPNEN

SEQ ID NO: 292958 - protein, 8 aa, Influenza virus
LMRPNENP

SEQ ID NO: 292959 - protein, 8 aa, Influenza virus
RSNENPAH

SEQ ID NO: 292960 - protein, 8 aa, Influenza virus
SNENPAHK

SEQ ID NO: 292961 - protein, 8 aa, Influenza virus
NENPVHKS

SEQ ID NO: 292962 - protein, 8 aa, Influenza virus
ENPVHKSQ

SEQ ID NO: 292963 - protein, 8 aa, Influenza virus
NPVHKSQL

SEQ ID NO: 292964 - protein, 8 aa, Influenza virus
PVHKSQLI

SEQ ID NO: 292965 - protein, 8 aa, Influenza virus
VHKSQLIW

SEQ ID NO: 292966 - protein, 8 aa, Influenza virus
HKSQLIWM

SEQ ID NO: 292967 - protein, 8 aa, Influenza virus
KSQLIWMA

SEQ ID NO: 292968 - protein, 8 aa, Influenza virus
SQLIWMAC

SEQ ID NO: 292969 - protein, 8 aa, Influenza virus
QLVWMACN

SEQ ID NO: 292970 - protein, 8 aa, Influenza virus
LVWMACNS

SEQ ID NO: 292971 - protein, 8 aa, Influenza virus
VWMACNSA

SEQ ID NO: 292972 - protein, 8 aa, Influenza virus
WMACNSAA

SEQ ID NO: 292973 - protein, 8 aa, Influenza virus
MACNSAAF

SEQ ID NO: 292974 - protein, 8 aa, Influenza virus
ACNSAAFE

SEQ ID NO: 292975 - protein, 8 aa, Influenza virus
CNSAAFED

SEQ ID NO: 292976 - protein, 8 aa, Influenza virus
NSAAFEDL

SEQ ID NO: 292977 - protein, 8 aa, Influenza virus
AAFEDLRL

SEQ ID NO: 292978 - protein, 8 aa, Influenza virus
AFEDLRLL

SEQ ID NO: 292979 - protein, 8 aa, Influenza virus
PRGQLSTR

SEQ ID NO: 292980 - protein, 8 aa, Influenza virus
RGQLSTRG

SEQ ID NO: 292981 - protein, 8 aa, Influenza virus
LSTRGVQV

SEQ ID NO: 292982 - protein, 8 aa, Influenza virus
STRGVQVA

SEQ ID NO: 292983 - protein, 8 aa, Influenza virus
TRGVQVAS

SEQ ID NO: 292984 - protein, 8 aa, Influenza virus
RGVQVASN

SEQ ID NO: 292985 - protein, 8 aa, Influenza virus
GVQVASNE

SEQ ID NO: 292986 - protein, 8 aa, Influenza virus
VQVASNEN

SEQ ID NO: 292987 - protein, 8 aa, Influenza virus
QIASNENV

SEQ ID NO: 292988 - protein, 8 aa, Influenza virus
SNTLELRS

SEQ ID NO: 292989 - protein, 8 aa, Influenza virus
TLELRSGY

SEQ ID NO: 292990 - protein, 8 aa, Influenza virus
LELRSGYW

SEQ ID NO: 292991 - protein, 8 aa, Influenza virus
ELRSGYWA

SEQ ID NO: 292992 - protein, 8 aa, Influenza virus
LRSGYWAI

SEQ ID NO: 292993 - protein, 8 aa, Influenza virus
RSGYWAIR

SEQ ID NO: 292994 - protein, 8 aa, Influenza virus
SGYWAIRT

SEQ ID NO: 292995 - protein, 8 aa, Influenza virus
GYWAIRTR

SEQ ID NO: 292996 - protein, 8 aa, Influenza virus
RTKSGGNT

SEQ ID NO: 292997 - protein, 8 aa, Influenza virus
TRSGGNTS

SEQ ID NO: 292998 - protein, 8 aa, Influenza virus
RSGGNTSQ

SEQ ID NO: 292999 - protein, 8 aa, Influenza virus
SGGNTSQQ

SEQ ID NO: 293000 - protein, 8 aa, Influenza virus
QQKASAGQ

SEQ ID NO: 293001 - protein, 8 aa, Influenza virus
KASAGQIS

SEQ ID NO: 293002 - protein, 8 aa, Influenza virus
ASAGQTSV

SEQ ID NO: 293003 - protein, 8 aa, Influenza virus
SAGQTSVQ

SEQ ID NO: 293004 - protein, 8 aa, Influenza virus
AGQTSVQP

SEQ ID NO: 293005 - protein, 8 aa, Influenza virus
STQPTFSV

SEQ ID NO: 293006 - protein, 8 aa, Influenza virus
TQPTFSVQ

SEQ ID NO: 293007 - protein, 8 aa, Influenza virus
QPAFSVQR

SEQ ID NO: 293008 - protein, 8 aa, Influenza virus
PAFSVQRN

SEQ ID NO: 293009 - protein, 8 aa, Influenza virus
AFSVQRNL

SEQ ID NO: 293010 - protein, 8 aa, Influenza virus
FSVQRSLP

SEQ ID NO: 293011 - protein, 8 aa, Influenza virus
SVQRSLPF

SEQ ID NO: 293012 - protein, 8 aa, Influenza virus
VQRNLPFD

SEQ ID NO: 293013 - protein, 8 aa, Influenza virus
QRNLPFEK

SEQ ID NO: 293014 - protein, 8 aa, Influenza virus
GNNEGRTS

SEQ ID NO: 293015 - protein, 8 aa, Influenza virus
NNEGRTSD

SEQ ID NO: 293016 - protein, 8 aa, Influenza virus
NEGRTSDM

SEQ ID NO: 293017 - protein, 8 aa, Influenza virus
GRTSDMRA

SEQ ID NO: 293018 - protein, 8 aa, Influenza virus
RTSDMRAE

SEQ ID NO: 293019 - protein, 8 aa, Influenza virus
TSDMRAEI

SEQ ID NO: 293020 - protein, 8 aa, Influenza virus
SDMRAEII

SEQ ID NO: 293021 - protein, 8 aa, Influenza virus
DMRTEVIR

SEQ ID NO: 293022 - protein, 8 aa, Influenza virus
DLSFQGRG

SEQ ID NO: 293023 - protein, 8 aa, Influenza virus
LSFQGRGV

SEQ ID NO: 293024 - protein, 8 aa, Influenza virus
SFRGRGVF

SEQ ID NO: 293025 - protein, 8 aa, Influenza virus
FRGRGVFE

SEQ ID NO: 293026 - protein, 8 aa, Influenza virus
RGRGVFEL

SEQ ID NO: 293027 - protein, 8 aa, Influenza virus
GRGVFEFS

SEQ ID NO: 293028 - protein, 8 aa, Influenza virus
RGVFEFSD

SEQ ID NO: 293029 - protein, 8 aa, Influenza virus
GVFEFSDE

SEQ ID NO: 293030 - protein, 8 aa, Influenza virus
VFELSDER

SEQ ID NO: 293031 - protein, 8 aa, Influenza virus
FELSDERA

SEQ ID NO: 293032 - protein, 8 aa, Influenza virus
ELSDERAT

SEQ ID NO: 293033 - protein, 8 aa, Influenza virus
SDERATNP

SEQ ID NO: 293034 - protein, 8 aa, Influenza virus
AANPIVPS

SEQ ID NO: 293035 - protein, 8 aa, Influenza virus
ANPIVPSF

SEQ ID NO: 293036 - protein, 8 aa, Influenza virus
NPIVPSFE

SEQ ID NO: 293037 - protein, 8 aa, Influenza virus
PIVPSFEM

SEQ ID NO: 293038 - protein, 8 aa, Influenza virus
IVPSFDMN

SEQ ID NO: 293039 - protein, 8 aa, Influenza virus
VPSFDMNN

SEQ ID NO: 293040 - protein, 8 aa, Influenza virus
PSFDMNNE

SEQ ID NO: 293041 - protein, 8 aa, Influenza virus
SFDMNNEG

SEQ ID NO: 293042 - protein, 8 aa, Influenza virus
FDMNNEGS

SEQ ID NO: 293043 - protein, 8 aa, Influenza virus
DMNNEGSY

SEQ ID NO: 293044 - protein, 8 aa, Influenza virus
MNNEGSYF

SEQ ID NO: 293045 - protein, 8 aa, Influenza virus
NNEGSYFF

SEQ ID NO: 293046 - protein, 8 aa, Influenza virus
KEGSYFFG

SEQ ID NO: 293047 - protein, 8 aa, Influenza virus
YFFGDNAK

SEQ ID NO: 293048 - protein, 8 aa, Influenza virus
FFGDNAKE

SEQ ID NO: 293049 - protein, 8 aa, Influenza virus
FGDNAEEF

SEQ ID NO: 293050 - protein, 8 aa, Influenza virus
TSFQVDCY

SEQ ID NO: 293051 - protein, 8 aa, Influenza virus
SFQVDCYL

SEQ ID NO: 293052 - protein, 8 aa, Influenza virus
FQVDCYLW

SEQ ID NO: 293053 - protein, 8 aa, Influenza virus
QVDCYLWH

SEQ ID NO: 293054 - protein, 8 aa, Influenza virus
VDCFLWHI

SEQ ID NO: 293055 - protein, 8 aa, Influenza virus
DCFLWHIR

SEQ ID NO: 293056 - protein, 8 aa, Influenza virus
SDAPFLDR

SEQ ID NO: 293057 - protein, 8 aa, Influenza virus
DAPFDDRL

SEQ ID NO: 293058 - protein, 8 aa, Influenza virus
APFDDRLR

SEQ ID NO: 293059 - protein, 8 aa, Influenza virus
PFDDRLRR

SEQ ID NO: 293060 - protein, 8 aa, Influenza virus
FDDRLRRD

SEQ ID NO: 293061 - protein, 8 aa, Influenza virus
SSLLLQAN

SEQ ID NO: 293062 - protein, 8 aa, Influenza virus
SLLLQANL

SEQ ID NO: 293063 - protein, 8 aa, Influenza virus
DDRLRRDQ

SEQ ID NO: 293064 - protein, 8 aa, Influenza virus
DRLRRDQR

SEQ ID NO: 293065 - protein, 8 aa, Influenza virus
RLRRDQRS

SEQ ID NO: 293066 - protein, 8 aa, Influenza virus
LRRDQRSL

SEQ ID NO: 293067 - protein, 8 aa, Influenza virus
RRDQKSLK

SEQ ID NO: 293068 - protein, 8 aa, Influenza virus
RDQKSLKG

SEQ ID NO: 293069 - protein, 8 aa, Influenza virus
DQKSLKGR

SEQ ID NO: 293070 - protein, 8 aa, Influenza virus
LKMPASRY

SEQ ID NO: 293071 - protein, 8 aa, Influenza virus
SVPASRYL

SEQ ID NO: 293072 - protein, 8 aa, Influenza virus
VPASRYLI

SEQ ID NO: 293073 - protein, 8 aa, Influenza virus
PASRYLID

SEQ ID NO: 293074 - protein, 8 aa, Influenza virus
RHRLKITE

SEQ ID NO: 293075 - protein, 8 aa, Influenza virus
RDQMAHCR

SEQ ID NO: 293076 - protein, 8 aa, Influenza virus
DQMAHCRM

SEQ ID NO: 293077 - protein, 8 aa, Influenza virus
FQVDCFLW

SEQ ID NO: 293078 - protein, 8 aa, Influenza virus
QVDCFLWH

SEQ ID NO: 293079 - protein, 8 aa, Influenza virus
VDCFLWHV

SEQ ID NO: 293080 - protein, 8 aa, Influenza virus
DCFLWHVR

SEQ ID NO: 293081 - protein, 8 aa, Influenza virus
CFLWHVRK

SEQ ID NO: 293082 - protein, 8 aa, Influenza virus
TIASDILT

SEQ ID NO: 293083 - protein, 8 aa, Influenza virus
IASDILKR

SEQ ID NO: 293084 - protein, 8 aa, Influenza virus
ASDILKRM

SEQ ID NO: 293085 - protein, 8 aa, Influenza virus
QLSQKFEE

SEQ ID NO: 293086 - protein, 8 aa, Influenza virus
LSQKFEEI

SEQ ID NO: 293087 - protein, 8 aa, Influenza virus
QKFEEVRW

SEQ ID NO: 293088 - protein, 8 aa, Influenza virus
KFEEVRWL

SEQ ID NO: 293089 - protein, 8 aa, Influenza virus
FEEVRWLI

SEQ ID NO: 293090 - protein, 8 aa, Influenza virus
TESSFEQI

SEQ ID NO: 293091 - protein, 8 aa, Influenza virus
ESSFEQIT

SEQ ID NO: 293092 - protein, 8 aa, Influenza virus
SSFEQITF

SEQ ID NO: 293093 - protein, 8 aa, Influenza virus
SFEQITFL

SEQ ID NO: 293094 - protein, 8 aa, Influenza virus
FEQITFLQ

SEQ ID NO: 293095 - protein, 8 aa, Influenza virus
EQITFLQA

SEQ ID NO: 293096 - protein, 8 aa, Influenza virus
QITFLQAL

SEQ ID NO: 293097 - protein, 8 aa, Influenza virus
ITFLQALQ

SEQ ID NO: 293098 - protein, 8 aa, Influenza virus
TFLQALQL

SEQ ID NO: 293099 - protein, 8 aa, Influenza virus
FLQALQLL

SEQ ID NO: 293100 - protein, 8 aa, Influenza virus
MQALQLLF

SEQ ID NO: 293101 - protein, 8 aa, Influenza virus
QALQLLFE

SEQ ID NO: 293102 - protein, 8 aa, Influenza virus
ALQLLFEV

SEQ ID NO: 293103 - protein, 8 aa, Influenza virus
LQLLFEVE

SEQ ID NO: 293104 - protein, 8 aa, Influenza virus
QLLFEVEQ

SEQ ID NO: 293105 - protein, 8 aa, Influenza virus
LLFEVEQE

SEQ ID NO: 293106 - protein, 8 aa, Influenza virus
EVEQEIRA

SEQ ID NO: 293107 - protein, 8 aa, Influenza virus
VEQEIRAF

SEQ ID NO: 293108 - protein, 8 aa, Influenza virus
EQEIRAFS

SEQ ID NO: 293109 - protein, 8 aa, Influenza virus
QEIRAFSF

SEQ ID NO: 293110 - protein, 8 aa, Influenza virus
EIRAFSFQ

SEQ ID NO: 293111 - protein, 8 aa, Influenza virus
IRAFSFQL

SEQ ID NO: 293112 - protein, 8 aa, Influenza virus
RAFSFQLI

SEQ ID NO: 293113 - protein, 8 aa, Influenza virus
TFSFQLIL

SEQ ID NO: 293114 - protein, 8 aa, Influenza virus
FSFQLILL

SEQ ID NO: 293115 - protein, 8 aa, Influenza virus
MENFVRQC

SEQ ID NO: 293116 - protein, 8 aa, Influenza virus
ENFVRQCF

SEQ ID NO: 293117 - protein, 8 aa, Influenza virus
NFVRQCFN

SEQ ID NO: 293118 - protein, 8 aa, Influenza virus
RQCFNPMV

SEQ ID NO: 293119 - protein, 8 aa, Influenza virus
QCFNPMII

SEQ ID NO: 293120 - protein, 8 aa, Influenza virus
CFNPMIIE

SEQ ID NO: 293121 - protein, 8 aa, Influenza virus
FNPMIIEL

SEQ ID NO: 293122 - protein, 8 aa, Influenza virus
NPMIIELA

SEQ ID NO: 293123 - protein, 8 aa, Influenza virus
PMIIELAE

SEQ ID NO: 293124 - protein, 8 aa, Influenza virus
MIIELAEK

SEQ ID NO: 293125 - protein, 8 aa, Influenza virus
VELAEKTM

SEQ ID NO: 293126 - protein, 8 aa, Influenza virus
ELAEKTMK

SEQ ID NO: 293127 - protein, 8 aa, Influenza virus
LAEKTMKE

SEQ ID NO: 293128 - protein, 8 aa, Influenza virus
AEKTMKEY

SEQ ID NO: 293129 - protein, 8 aa, Influenza virus
EKTMKEYG

SEQ ID NO: 293130 - protein, 8 aa, Influenza virus
KTMKEYGE

SEQ ID NO: 293131 - protein, 8 aa, Influenza virus
VETNKFAA

SEQ ID NO: 293132 - protein, 8 aa, Influenza virus
ETNKLAAI

SEQ ID NO: 293133 - protein, 8 aa, Influenza virus
TNKLAAIC

SEQ ID NO: 293134 - protein, 8 aa, Influenza virus
NKLAAICT

SEQ ID NO: 293135 - protein, 8 aa, Influenza virus
KLAAICTH

SEQ ID NO: 293136 - protein, 8 aa, Influenza virus
FAAICTHM

SEQ ID NO: 293137 - protein, 8 aa, Influenza virus
AAICTHME

SEQ ID NO: 293138 - protein, 8 aa, Influenza virus
AICTHMEV

SEQ ID NO: 293139 - protein, 8 aa, Influenza virus
ICTHMEVC

SEQ ID NO: 293140 - protein, 8 aa, Influenza virus
CTHMEVCF

SEQ ID NO: 293141 - protein, 8 aa, Influenza virus
THMEVCFM

SEQ ID NO: 293142 - protein, 8 aa, Influenza virus
HMEVCFMY

SEQ ID NO: 293143 - protein, 8 aa, Influenza virus
MEVCFMYS

SEQ ID NO: 293144 - protein, 8 aa, Influenza virus
EICFMYSD

SEQ ID NO: 293145 - protein, 8 aa, Influenza virus
ICFMYSDF

SEQ ID NO: 293146 - protein, 8 aa, Influenza virus
YSDFHFIN

SEQ ID NO: 293147 - protein, 8 aa, Influenza virus
SDFHFINE

SEQ ID NO: 293148 - protein, 8 aa, Influenza virus
DFHFINEQ

SEQ ID NO: 293149 - protein, 8 aa, Influenza virus
DSNALLKH

SEQ ID NO: 293150 - protein, 8 aa, Influenza virus
SNALLKHR

SEQ ID NO: 293151 - protein, 8 aa, Influenza virus
NVLLKHRF

SEQ ID NO: 293152 - protein, 8 aa, Influenza virus
VLLKHRFE

SEQ ID NO: 293153 - protein, 8 aa, Influenza virus
IIEGRDRI

SEQ ID NO: 293154 - protein, 8 aa, Influenza virus
EGRDRIMA

SEQ ID NO: 293155 - protein, 8 aa, Influenza virus
GRDRIMAW

SEQ ID NO: 293156 - protein, 8 aa, Influenza virus
AWTVVNSL

SEQ ID NO: 293157 - protein, 8 aa, Influenza virus
WTVVNSLC

SEQ ID NO: 293158 - protein, 8 aa, Influenza virus
KPRFLPDL

SEQ ID NO: 293159 - protein, 8 aa, Influenza virus
PRFLPDLY

SEQ ID NO: 293160 - protein, 8 aa, Influenza virus
RFLPDLYD

SEQ ID NO: 293161 - protein, 8 aa, Influenza virus
YLPDLYDY

SEQ ID NO: 293162 - protein, 8 aa, Influenza virus
DLYDYKED

SEQ ID NO: 293163 - protein, 8 aa, Influenza virus
LYDYKEDR

SEQ ID NO: 293164 - protein, 8 aa, Influenza virus
YDYKEDRF

SEQ ID NO: 293165 - protein, 8 aa, Influenza virus
RFVEIGVT

SEQ ID NO: 293166 - protein, 8 aa, Influenza virus
FVEIGVTR

SEQ ID NO: 293167 - protein, 8 aa, Influenza virus
VEIGVTRR

SEQ ID NO: 293168 - protein, 8 aa, Influenza virus
IGVTRREI

SEQ ID NO: 293169 - protein, 8 aa, Influenza virus
GVTRREIH

SEQ ID NO: 293170 - protein, 8 aa, Influenza virus
VTRREVHT

SEQ ID NO: 293171 - protein, 8 aa, Influenza virus
TRREVHTY

SEQ ID NO: 293172 - protein, 8 aa, Influenza virus
RREVHTYY

SEQ ID NO: 293173 - protein, 8 aa, Influenza virus
REVHTYYL

SEQ ID NO: 293174 - protein, 8 aa, Influenza virus
EVHTYYLE

SEQ ID NO: 293175 - protein, 8 aa, Influenza virus
VHTYYLEK

SEQ ID NO: 293176 - protein, 8 aa, Influenza virus
HTYYLEKA

SEQ ID NO: 293177 - protein, 8 aa, Influenza virus
TYYLEKAN

SEQ ID NO: 293178 - protein, 8 aa, Influenza virus
YYLEKASK

SEQ ID NO: 293179 - protein, 8 aa, Influenza virus
YLEKASKI

SEQ ID NO: 293180 - protein, 8 aa, Influenza virus
LEKASKIK

SEQ ID NO: 293181 - protein, 8 aa, Influenza virus
EKANKIKT

SEQ ID NO: 293182 - protein, 8 aa, Influenza virus
KANKIKTE

SEQ ID NO: 293183 - protein, 8 aa, Influenza virus
ENTHIHIF

SEQ ID NO: 293184 - protein, 8 aa, Influenza virus
NTHIHIFS

SEQ ID NO: 293185 - protein, 8 aa, Influenza virus
HIHIFSFN

SEQ ID NO: 293186 - protein, 8 aa, Influenza virus
IHIFSFNG

SEQ ID NO: 293187 - protein, 8 aa, Influenza virus
HIFSFNGE

SEQ ID NO: 293188 - protein, 8 aa, Influenza virus
IFSFNGEE

SEQ ID NO: 293189 - protein, 8 aa, Influenza virus
FSFNGEEM

SEQ ID NO: 293190 - protein, 8 aa, Influenza virus
SFNGEEMA

SEQ ID NO: 293191 - protein, 8 aa, Influenza virus
FNGEEMAT

SEQ ID NO: 293192 - protein, 8 aa, Influenza virus
TGEEMATR

SEQ ID NO: 293193 - protein, 8 aa, Influenza virus
GEEMATRA

SEQ ID NO: 293194 - protein, 8 aa, Influenza virus
DYTIDEES

SEQ ID NO: 293195 - protein, 8 aa, Influenza virus
YTIDEESR

SEQ ID NO: 293196 - protein, 8 aa, Influenza virus
TIDEESRA

SEQ ID NO: 293197 - protein, 8 aa, Influenza virus
IDEESRAR

SEQ ID NO: 293198 - protein, 8 aa, Influenza virus
LFTIRQEL

SEQ ID NO: 293199 - protein, 8 aa, Influenza virus
FTIRQELA

SEQ ID NO: 293200 - protein, 8 aa, Influenza virus
TIRQEMAN

SEQ ID NO: 293201 - protein, 8 aa, Influenza virus
IRQEMANR

SEQ ID NO: 293202 - protein, 8 aa, Influenza virus
RSLWDSFR

SEQ ID NO: 293203 - protein, 8 aa, Influenza virus
SLWDSFRQ

SEQ ID NO: 293204 - protein, 8 aa, Influenza virus
RQSERGED

SEQ ID NO: 293205 - protein, 8 aa, Influenza virus
QSERGEDT

SEQ ID NO: 293206 - protein, 8 aa, Influenza virus
SERGEDTI

SEQ ID NO: 293207 - protein, 8 aa, Influenza virus
ERGEDTIE

SEQ ID NO: 293208 - protein, 8 aa, Influenza virus
RGEDTIEE

SEQ ID NO: 293209 - protein, 8 aa, Influenza virus
GEETIEEK

SEQ ID NO: 293210 - protein, 8 aa, Influenza virus
EETIEEKF

SEQ ID NO: 293211 - protein, 8 aa, Influenza virus
ETIEEKFE

SEQ ID NO: 293212 - protein, 8 aa, Influenza virus
TIEEKFEI

SEQ ID NO: 293213 - protein, 8 aa, Influenza virus
KLADQSLP

SEQ ID NO: 293214 - protein, 8 aa, Influenza virus
LANQSLPP

SEQ ID NO: 293215 - protein, 8 aa, Influenza virus
ANQSLPPN

SEQ ID NO: 293216 - protein, 8 aa, Influenza virus
NQSLPPNF

SEQ ID NO: 293217 - protein, 8 aa, Influenza virus
YSLPPNFS

SEQ ID NO: 293218 - protein, 8 aa, Influenza virus
SLPPNFSC

SEQ ID NO: 293219 - protein, 8 aa, Influenza virus
NFRVYVDG

SEQ ID NO: 293220 - protein, 8 aa, Influenza virus
FRVYVDGF

SEQ ID NO: 293221 - protein, 8 aa, Influenza virus
RAYVDGFK

SEQ ID NO: 293222 - protein, 8 aa, Influenza virus
AYVDGFKP

SEQ ID NO: 293223 - protein, 8 aa, Influenza virus
YVDGFKPN

SEQ ID NO: 293224 - protein, 8 aa, Influenza virus
VDGFKPNG

SEQ ID NO: 293225 - protein, 8 aa, Influenza virus
DGFEPNGY

SEQ ID NO: 293226 - protein, 8 aa, Influenza virus
GFEPNGYI

SEQ ID NO: 293227 - protein, 8 aa, Influenza virus
FEPNGYIE

SEQ ID NO: 293228 - protein, 8 aa, Influenza virus
EPNGYIEG

SEQ ID NO: 293229 - protein, 8 aa, Influenza virus
PNGYIEGK

SEQ ID NO: 293230 - protein, 8 aa, Influenza virus
NGYIEGKL

SEQ ID NO: 293231 - protein, 8 aa, Influenza virus
GYIEGKLS

SEQ ID NO: 293232 - protein, 8 aa, Influenza virus
YIEGKLSQ

SEQ ID NO: 293233 - protein, 8 aa, Influenza virus
IESKLSQM

SEQ ID NO: 293234 - protein, 8 aa, Influenza virus
ESKLSQMS

SEQ ID NO: 293235 - protein, 8 aa, Influenza virus
GKLSQMSR

SEQ ID NO: 293236 - protein, 8 aa, Influenza virus
KLSQMSRE

SEQ ID NO: 293237 - protein, 8 aa, Influenza virus
LSQMSREV

SEQ ID NO: 293238 - protein, 8 aa, Influenza virus
CHQRSKFL

SEQ ID NO: 293239 - protein, 8 aa, Influenza virus
HQRSKFLL

SEQ ID NO: 293240 - protein, 8 aa, Influenza virus
SKFLLMDS

SEQ ID NO: 293241 - protein, 8 aa, Influenza virus
KFLLMDSL

SEQ ID NO: 293242 - protein, 8 aa, Influenza virus
FLLMDSLK

SEQ ID NO: 293243 - protein, 8 aa, Influenza virus
LLMDSLKL

SEQ ID NO: 293244 - protein, 8 aa, Influenza virus
LMDSLKLS

SEQ ID NO: 293245 - protein, 8 aa, Influenza virus
MDSLKLSI

SEQ ID NO: 293246 - protein, 8 aa, Influenza virus
DSLKLSIE

SEQ ID NO: 293247 - protein, 8 aa, Influenza virus
SLKLSIED

SEQ ID NO: 293248 - protein, 8 aa, Influenza virus
KLSIEDPN

SEQ ID NO: 293249 - protein, 8 aa, Influenza virus
LSIEDPNH

SEQ ID NO: 293250 - protein, 8 aa, Influenza virus
SIEDPNHE

SEQ ID NO: 293251 - protein, 8 aa, Influenza virus
IEDPNHEG

SEQ ID NO: 293252 - protein, 8 aa, Influenza virus
EDPNHEGE

SEQ ID NO: 293253 - protein, 8 aa, Influenza virus
DPNHEGEG

SEQ ID NO: 293254 - protein, 8 aa, Influenza virus
PNHEGEGI

SEQ ID NO: 293255 - protein, 8 aa, Influenza virus
NHEGEGIP

SEQ ID NO: 293256 - protein, 8 aa, Influenza virus
EGEGIPLH

SEQ ID NO: 293257 - protein, 8 aa, Influenza virus
GIPLYDAV

SEQ ID NO: 293258 - protein, 8 aa, Influenza virus
IPLYDAVR

SEQ ID NO: 293259 - protein, 8 aa, Influenza virus
PLYDAVRC

SEQ ID NO: 293260 - protein, 8 aa, Influenza virus
KCIKTFFG

SEQ ID NO: 293261 - protein, 8 aa, Influenza virus
CIKTFFGW

SEQ ID NO: 293262 - protein, 8 aa, Influenza virus
IKTFFGWK

SEQ ID NO: 293263 - protein, 8 aa, Influenza virus
RTFFGWKE

SEQ ID NO: 293264 - protein, 8 aa, Influenza virus
TFFGWREP

SEQ ID NO: 293265 - protein, 8 aa, Influenza virus
LRWALGEN

SEQ ID NO: 293266 - protein, 8 aa, Influenza virus
RWALGENM

SEQ ID NO: 293267 - protein, 8 aa, Influenza virus
WVLGENMA

SEQ ID NO: 293268 - protein, 8 aa, Influenza virus
VLGENMAP

SEQ ID NO: 293269 - protein, 8 aa, Influenza virus
ENMAPEKM

SEQ ID NO: 293270 - protein, 8 aa, Influenza virus
NMAPEKMD

SEQ ID NO: 293271 - protein, 8 aa, Influenza virus
MAPEKMDF

SEQ ID NO: 293272 - protein, 8 aa, Influenza virus
APEKVDFE

SEQ ID NO: 293273 - protein, 8 aa, Influenza virus
WIQNEFNK

SEQ ID NO: 293274 - protein, 8 aa, Influenza virus
IQNEFNKA

SEQ ID NO: 293275 - protein, 8 aa, Influenza virus
QSEFNKAC

SEQ ID NO: 293276 - protein, 8 aa, Influenza virus
SEFNKACE

SEQ ID NO: 293277 - protein, 8 aa, Influenza virus
ACELTDSI

SEQ ID NO: 293278 - protein, 8 aa, Influenza virus
CELTDSIW

SEQ ID NO: 293279 - protein, 8 aa, Influenza virus
WLELDEIG

SEQ ID NO: 293280 - protein, 8 aa, Influenza virus
LELDEIGE

SEQ ID NO: 293281 - protein, 8 aa, Influenza virus
EFDEIGED

SEQ ID NO: 293282 - protein, 8 aa, Influenza virus
LDEIGEDI

SEQ ID NO: 293283 - protein, 8 aa, Influenza virus
DEIGEDIA

SEQ ID NO: 293284 - protein, 8 aa, Influenza virus
EIGEDIAP

SEQ ID NO: 293285 - protein, 8 aa, Influenza virus
IGEDIAPI

SEQ ID NO: 293286 - protein, 8 aa, Influenza virus
GEDIAPIE

SEQ ID NO: 293287 - protein, 8 aa, Influenza virus
EDVAPIEY

SEQ ID NO: 293288 - protein, 8 aa, Influenza virus
APIEYIAS

SEQ ID NO: 293289 - protein, 8 aa, Influenza virus
PIEYIASM

SEQ ID NO: 293290 - protein, 8 aa, Influenza virus
IEYIASMR

SEQ ID NO: 293291 - protein, 8 aa, Influenza virus
EYIASMRR

SEQ ID NO: 293292 - protein, 8 aa, Influenza virus
VASMRRNY

SEQ ID NO: 293293 - protein, 8 aa, Influenza virus
ASMRRDYF

SEQ ID NO: 293294 - protein, 8 aa, Influenza virus
SMRRDYFT

SEQ ID NO: 293295 - protein, 8 aa, Influenza virus
RRDYFTAE

SEQ ID NO: 293296 - protein, 8 aa, Influenza virus
RNYFTAEI

SEQ ID NO: 293297 - protein, 8 aa, Influenza virus
NYFTAEIS

SEQ ID NO: 293298 - protein, 8 aa, Influenza virus
YFTAEISH

SEQ ID NO: 293299 - protein, 8 aa, Influenza virus
FTAEISHC

SEQ ID NO: 293300 - protein, 8 aa, Influenza virus
TAEISHCR

SEQ ID NO: 293301 - protein, 8 aa, Influenza virus
AEISHCRA

SEQ ID NO: 293302 - protein, 8 aa, Influenza virus
EISHCRAT

SEQ ID NO: 293303 - protein, 8 aa, Influenza virus
ISHCRATE

SEQ ID NO: 293304 - protein, 8 aa, Influenza virus
YCRATEYI

SEQ ID NO: 293305 - protein, 8 aa, Influenza virus
RATEYMMK

SEQ ID NO: 293306 - protein, 8 aa, Influenza virus
ATEYMMKG

SEQ ID NO: 293307 - protein, 8 aa, Influenza virus
TEYMMKGV

SEQ ID NO: 293308 - protein, 8 aa, Influenza virus
EYMMKGVY

SEQ ID NO: 293309 - protein, 8 aa, Influenza virus
MKGVYVNT

SEQ ID NO: 293310 - protein, 8 aa, Influenza virus
KGVYVNTA

SEQ ID NO: 293311 - protein, 8 aa, Influenza virus
GVYVNTAL

SEQ ID NO: 293312 - protein, 8 aa, Influenza virus
VYVNTALL

SEQ ID NO: 293313 - protein, 8 aa, Influenza virus
YVNTALLN

SEQ ID NO: 293314 - protein, 8 aa, Influenza virus
VNTALLNA

SEQ ID NO: 293315 - protein, 8 aa, Influenza virus
MLNASCAA

SEQ ID NO: 293316 - protein, 8 aa, Influenza virus
NASCAAME

SEQ ID NO: 293317 - protein, 8 aa, Influenza virus
ASCAAMDE

SEQ ID NO: 293318 - protein, 8 aa, Influenza virus
SCAAMDEF

SEQ ID NO: 293319 - protein, 8 aa, Influenza virus
CAAMDEFQ

SEQ ID NO: 293320 - protein, 8 aa, Influenza virus
AAMDEFQL

SEQ ID NO: 293321 - protein, 8 aa, Influenza virus
AMDEFQLI

SEQ ID NO: 293322 - protein, 8 aa, Influenza virus
MDEFQLIP

SEQ ID NO: 293323 - protein, 8 aa, Influenza virus
DEFQLIPM

SEQ ID NO: 293324 - protein, 8 aa, Influenza virus
EFQLIPMI

SEQ ID NO: 293325 - protein, 8 aa, Influenza virus
IPMISKCK

SEQ ID NO: 293326 - protein, 8 aa, Influenza virus
PMISKCKT

SEQ ID NO: 293327 - protein, 8 aa, Influenza virus
MISKCRTR

SEQ ID NO: 293328 - protein, 8 aa, Influenza virus
ISKCRTRE

SEQ ID NO: 293329 - protein, 8 aa, Influenza virus
SKCRTREG

SEQ ID NO: 293330 - protein, 8 aa, Influenza virus
KCRTREGR

SEQ ID NO: 293331 - protein, 8 aa, Influenza virus
CRTREGRR

SEQ ID NO: 293332 - protein, 8 aa, Influenza virus
RTREGRRK

SEQ ID NO: 293333 - protein, 8 aa, Influenza virus
TREGRRKT

SEQ ID NO: 293334 - protein, 8 aa, Influenza virus
REGRRKTN

SEQ ID NO: 293335 - protein, 8 aa, Influenza virus
RTNLYGFI

SEQ ID NO: 293336 - protein, 8 aa, Influenza virus
TNLYGFIV

SEQ ID NO: 293337 - protein, 8 aa, Influenza virus
NLYGFIVK

SEQ ID NO: 293338 - protein, 8 aa, Influenza virus
LYGFIVKG

SEQ ID NO: 293339 - protein, 8 aa, Influenza virus
YGFIVKGR

SEQ ID NO: 293340 - protein, 8 aa, Influenza virus
GFIVKGRS

SEQ ID NO: 293341 - protein, 8 aa, Influenza virus
FIVKGRSH

SEQ ID NO: 293342 - protein, 8 aa, Influenza virus
IVKGRSHL

SEQ ID NO: 293343 - protein, 8 aa, Influenza virus
VKGRSHLR

SEQ ID NO: 293344 - protein, 8 aa, Influenza virus
NDTDVVNY

SEQ ID NO: 293345 - protein, 8 aa, Influenza virus
DTDVVNYV

SEQ ID NO: 293346 - protein, 8 aa, Influenza virus
TDVVNYVS

SEQ ID NO: 293347 - protein, 8 aa, Influenza virus
DVVNYVSM

SEQ ID NO: 293348 - protein, 8 aa, Influenza virus
VVNYVSME

SEQ ID NO: 293349 - protein, 8 aa, Influenza virus
VNYVSMEF

SEQ ID NO: 293350 - protein, 8 aa, Influenza virus
NYVSMEFS

SEQ ID NO: 293351 - protein, 8 aa, Influenza virus
YVSMEFSL

SEQ ID NO: 293352 - protein, 8 aa, Influenza virus
LSMEFSLT

SEQ ID NO: 293353 - protein, 8 aa, Influenza virus
EFSLTDPK

SEQ ID NO: 293354 - protein, 8 aa, Influenza virus
FSLTDPRF

SEQ ID NO: 293355 - protein, 8 aa, Influenza virus
SLTDPRFE

SEQ ID NO: 293356 - protein, 8 aa, Influenza virus
LHKWEKYC

SEQ ID NO: 293357 - protein, 8 aa, Influenza virus
HKWEKYCI

SEQ ID NO: 293358 - protein, 8 aa, Influenza virus
KWEKYCIL

SEQ ID NO: 293359 - protein, 8 aa, Influenza virus
WEKYCILE

SEQ ID NO: 293360 - protein, 8 aa, Influenza virus
PMFLYIRT

SEQ ID NO: 293361 - protein, 8 aa, Influenza virus
MFLYIRTN

SEQ ID NO: 293362 - protein, 8 aa, Influenza virus
FLYIRTNG

SEQ ID NO: 293363 - protein, 8 aa, Influenza virus
LYIRTNGT

SEQ ID NO: 293364 - protein, 8 aa, Influenza virus
YIRTNGTS

SEQ ID NO: 293365 - protein, 8 aa, Influenza virus
IRTNGTSK

SEQ ID NO: 293366 - protein, 8 aa, Influenza virus
RTNGTSKV

SEQ ID NO: 293367 - protein, 8 aa, Influenza virus
TNGTSKVK

SEQ ID NO: 293368 - protein, 8 aa, Influenza virus
NGTSKVKM

SEQ ID NO: 293369 - protein, 8 aa, Influenza virus
GTSKVKMK

SEQ ID NO: 293370 - protein, 8 aa, Influenza virus
TSKVKMKW

SEQ ID NO: 293371 - protein, 8 aa, Influenza virus
SKVKMKWG

SEQ ID NO: 293372 - protein, 8 aa, Influenza virus
KVKMKWGM

SEQ ID NO: 293373 - protein, 8 aa, Influenza virus
VKMKWGME

SEQ ID NO: 293374 - protein, 8 aa, Influenza virus
KMKWGMEL

SEQ ID NO: 293375 - protein, 8 aa, Influenza virus
MKWGMELR

SEQ ID NO: 293376 - protein, 8 aa, Influenza virus
KWGMELRR

SEQ ID NO: 293377 - protein, 8 aa, Influenza virus
WGMELRRC

SEQ ID NO: 293378 - protein, 8 aa, Influenza virus
GMELRRCL

SEQ ID NO: 293379 - protein, 8 aa, Influenza virus
MELRRCLL

SEQ ID NO: 293380 - protein, 8 aa, Influenza virus
ELRRCLLQ

SEQ ID NO: 293381 - protein, 8 aa, Influenza virus
LRRCLLQS

SEQ ID NO: 293382 - protein, 8 aa, Influenza virus
SLQQIESI

SEQ ID NO: 293383 - protein, 8 aa, Influenza virus
LQQIESMV

SEQ ID NO: 293384 - protein, 8 aa, Influenza virus
QQIESMVE

SEQ ID NO: 293385 - protein, 8 aa, Influenza virus
QIESMVEA

SEQ ID NO: 293386 - protein, 8 aa, Influenza virus
IESMVEAE

SEQ ID NO: 293387 - protein, 8 aa, Influenza virus
ESMVEAES

SEQ ID NO: 293388 - protein, 8 aa, Influenza virus
SMVEAESS

SEQ ID NO: 293389 - protein, 8 aa, Influenza virus
MIEAESSI

SEQ ID NO: 293390 - protein, 8 aa, Influenza virus
IEAESSIK

SEQ ID NO: 293391 - protein, 8 aa, Influenza virus
EAESSIKE

SEQ ID NO: 293392 - protein, 8 aa, Influenza virus
AESSIKEK

SEQ ID NO: 293393 - protein, 8 aa, Influenza virus
ESSIKEKD

SEQ ID NO: 293394 - protein, 8 aa, Influenza virus
SSIKEKDM

SEQ ID NO: 293395 - protein, 8 aa, Influenza virus
SIKEKDMT

SEQ ID NO: 293396 - protein, 8 aa, Influenza virus
IKEKDMTK

SEQ ID NO: 293397 - protein, 8 aa, Influenza virus
KEKDMTRE

SEQ ID NO: 293398 - protein, 8 aa, Influenza virus
EKDMTREF

SEQ ID NO: 293399 - protein, 8 aa, Influenza virus
KDMTREFF

SEQ ID NO: 293400 - protein, 8 aa, Influenza virus
DMTREFFE

SEQ ID NO: 293401 - protein, 8 aa, Influenza virus
EAWPIGES

SEQ ID NO: 293402 - protein, 8 aa, Influenza virus
AWPIGESP

SEQ ID NO: 293403 - protein, 8 aa, Influenza virus
WPIGESPR

SEQ ID NO: 293404 - protein, 8 aa, Influenza virus
PIGESPRG

SEQ ID NO: 293405 - protein, 8 aa, Influenza virus
GESPRGVE

SEQ ID NO: 293406 - protein, 8 aa, Influenza virus
GVEESSIG

SEQ ID NO: 293407 - protein, 8 aa, Influenza virus
VEESSIGK

SEQ ID NO: 293408 - protein, 8 aa, Influenza virus
EESSIGKV

SEQ ID NO: 293409 - protein, 8 aa, Influenza virus
ESSIGKVC

SEQ ID NO: 293410 - protein, 8 aa, Influenza virus
SSIGKVCR

SEQ ID NO: 293411 - protein, 8 aa, Influenza virus
VCRALLAK

SEQ ID NO: 293412 - protein, 8 aa, Influenza virus
LAKSVFNC

SEQ ID NO: 293413 - protein, 8 aa, Influenza virus
AKSVFNCL

SEQ ID NO: 293414 - protein, 8 aa, Influenza virus
KSVFNCLY

SEQ ID NO: 293415 - protein, 8 aa, Influenza virus
SVFNCLYA

SEQ ID NO: 293416 - protein, 8 aa, Influenza virus
VFNCLYAS

SEQ ID NO: 293417 - protein, 8 aa, Influenza virus
FNSLYASS

SEQ ID NO: 293418 - protein, 8 aa, Influenza virus
NSLYASSQ

SEQ ID NO: 293419 - protein, 8 aa, Influenza virus
SLYASSQL

SEQ ID NO: 293420 - protein, 8 aa, Influenza virus
LYASSQLE

SEQ ID NO: 293421 - protein, 8 aa, Influenza virus
YASSQLEG

SEQ ID NO: 293422 - protein, 8 aa, Influenza virus
ASSQLEGF

SEQ ID NO: 293423 - protein, 8 aa, Influenza virus
SSQLEGFS

SEQ ID NO: 293424 - protein, 8 aa, Influenza virus
SQLEGFSA

SEQ ID NO: 293425 - protein, 8 aa, Influenza virus
FSAESRKM

SEQ ID NO: 293426 - protein, 8 aa, Influenza virus
SAESRKML

SEQ ID NO: 293427 - protein, 8 aa, Influenza virus
AESRKMLL

SEQ ID NO: 293428 - protein, 8 aa, Influenza virus
ESRKLLLV

SEQ ID NO: 293429 - protein, 8 aa, Influenza virus
SRKLLLVV

SEQ ID NO: 293430 - protein, 8 aa, Influenza virus
RKLLLVVQ

SEQ ID NO: 293431 - protein, 8 aa, Influenza virus
KLLLVVQA

SEQ ID NO: 293432 - protein, 8 aa, Influenza virus
LLLVVQAL

SEQ ID NO: 293433 - protein, 8 aa, Influenza virus
LLVVQALR

SEQ ID NO: 293434 - protein, 8 aa, Influenza virus
LVVQALRD

SEQ ID NO: 293435 - protein, 8 aa, Influenza virus
QALRDSLE

SEQ ID NO: 293436 - protein, 8 aa, Influenza virus
ALRDSLEP

SEQ ID NO: 293437 - protein, 8 aa, Influenza virus
LRDSLEPG

SEQ ID NO: 293438 - protein, 8 aa, Influenza virus
RDSLEPGT

SEQ ID NO: 293439 - protein, 8 aa, Influenza virus
DSLEPGTF

SEQ ID NO: 293440 - protein, 8 aa, Influenza virus
SLEPGTFD

SEQ ID NO: 293441 - protein, 8 aa, Influenza virus
LEPGTFDI

SEQ ID NO: 293442 - protein, 8 aa, Influenza virus
EPGTFDLE

SEQ ID NO: 293443 - protein, 8 aa, Influenza virus
PGTFDLEG

SEQ ID NO: 293444 - protein, 8 aa, Influenza virus
GTFDLEGL

SEQ ID NO: 293445 - protein, 8 aa, Influenza virus
TFDLEGLY

SEQ ID NO: 293446 - protein, 8 aa, Influenza virus
GLYESIEE

SEQ ID NO: 293447 - protein, 8 aa, Influenza virus
LYESIEEC

SEQ ID NO: 293448 - protein, 8 aa, Influenza virus
YESIEECL

SEQ ID NO: 293449 - protein, 8 aa, Influenza virus
ESIEECLI

SEQ ID NO: 293450 - protein, 8 aa, Influenza virus
SIEECLIN

SEQ ID NO: 293451 - protein, 8 aa, Influenza virus
SWFNSFLA

SEQ ID NO: 293452 - protein, 8 aa, Influenza virus
WFNSFLAH

SEQ ID NO: 293453 - protein, 8 aa, Influenza virus
FLTHALRF

SEQ ID NO: 293454 - protein, 8 aa, Influenza virus
LAHALKLV

SEQ ID NO: 293455 - protein, 8 aa, Influenza virus
AHALKLVV

SEQ ID NO: 293456 - protein, 8 aa, Influenza virus
HALKLVVA

SEQ ID NO: 293457 - protein, 8 aa, Influenza virus
ALKLVVAM

SEQ ID NO: 293458 - protein, 8 aa, Influenza virus
LKLVVAML

SEQ ID NO: 293459 - protein, 8 aa, Influenza virus
HPTLLFLK

SEQ ID NO: 293460 - protein, 8 aa, Influenza virus
PTLLFLKI

SEQ ID NO: 293461 - protein, 8 aa, Influenza virus
TLLFLKIP

SEQ ID NO: 293462 - protein, 8 aa, Influenza virus
LLFLKIPA

SEQ ID NO: 293463 - protein, 8 aa, Influenza virus
LFLKIPAQ

SEQ ID NO: 293464 - protein, 8 aa, Influenza virus
FLKIPAQN

SEQ ID NO: 293465 - protein, 8 aa, Influenza virus
LKIPAQNA

SEQ ID NO: 293466 - protein, 8 aa, Influenza virus
KIPAQNAI

SEQ ID NO: 293467 - protein, 8 aa, Influenza virus
IPAQNAIS

SEQ ID NO: 293468 - protein, 8 aa, Influenza virus
PVQNAIST

SEQ ID NO: 293469 - protein, 8 aa, Influenza virus
VQNAISTT

SEQ ID NO: 293470 - protein, 8 aa, Influenza virus
GYTMDTVS

SEQ ID NO: 293471 - protein, 8 aa, Influenza virus
YTMDTVSR

SEQ ID NO: 293472 - protein, 8 aa, Influenza virus
RTHQYSER

SEQ ID NO: 293473 - protein, 8 aa, Influenza virus
THQYSERG

SEQ ID NO: 293474 - protein, 8 aa, Influenza virus
HQYSERGR

SEQ ID NO: 293475 - protein, 8 aa, Influenza virus
QYSERGRW

SEQ ID NO: 293476 - protein, 8 aa, Influenza virus
NSETGAPQ

SEQ ID NO: 293477 - protein, 8 aa, Influenza virus
SETGAPQL

SEQ ID NO: 293478 - protein, 8 aa, Influenza virus
EIGAPQLN

SEQ ID NO: 293479 - protein, 8 aa, Influenza virus
IGAPQLNP

SEQ ID NO: 293480 - protein, 8 aa, Influenza virus
KAPQLNPI

SEQ ID NO: 293481 - protein, 8 aa, Influenza virus
ALQLNPID

SEQ ID NO: 293482 - protein, 8 aa, Influenza virus
LQLNPIDG

SEQ ID NO: 293483 - protein, 8 aa, Influenza virus
PIDGPLPK

SEQ ID NO: 293484 - protein, 8 aa, Influenza virus
DNEPTGYA

SEQ ID NO: 293485 - protein, 8 aa, Influenza virus
NEPTGYAQ

SEQ ID NO: 293486 - protein, 8 aa, Influenza virus
EPTGYAQT

SEQ ID NO: 293487 - protein, 8 aa, Influenza virus
PTGYAQTD

SEQ ID NO: 293488 - protein, 8 aa, Influenza virus
TGYAQTDC

SEQ ID NO: 293489 - protein, 8 aa, Influenza virus
LEAMALLE

SEQ ID NO: 293490 - protein, 8 aa, Influenza virus
EAMAFLEK

SEQ ID NO: 293491 - protein, 8 aa, Influenza virus
AMAFLEKS

SEQ ID NO: 293492 - protein, 8 aa, Influenza virus
MAFLEKSH

SEQ ID NO: 293493 - protein, 8 aa, Influenza virus
AFLEKSHP

SEQ ID NO: 293494 - protein, 8 aa, Influenza virus
FLEKSHPG

SEQ ID NO: 293495 - protein, 8 aa, Influenza virus
LEKSHPGI

SEQ ID NO: 293496 - protein, 8 aa, Influenza virus
EKSHPGIF

SEQ ID NO: 293497 - protein, 8 aa, Influenza virus
KSHPGIFE

SEQ ID NO: 293498 - protein, 8 aa, Influenza virus
SHPGLFEN

SEQ ID NO: 293499 - protein, 8 aa, Influenza virus
HPGLFENS

SEQ ID NO: 293500 - protein, 8 aa, Influenza virus
PGLFENSC

SEQ ID NO: 293501 - protein, 8 aa, Influenza virus
GIFENSCI

SEQ ID NO: 293502 - protein, 8 aa, Influenza virus
IFENSCIE

SEQ ID NO: 293503 - protein, 8 aa, Influenza virus
FENSCIET

SEQ ID NO: 293504 - protein, 8 aa, Influenza virus
NSCIETME

SEQ ID NO: 293505 - protein, 8 aa, Influenza virus
IQQTRVDK

SEQ ID NO: 293506 - protein, 8 aa, Influenza virus
QQTRVDRL

SEQ ID NO: 293507 - protein, 8 aa, Influenza virus
QTRVDRLT

SEQ ID NO: 293508 - protein, 8 aa, Influenza virus
TRVDRLTQ

SEQ ID NO: 293509 - protein, 8 aa, Influenza virus
RVDRLTQG

SEQ ID NO: 293510 - protein, 8 aa, Influenza virus
VDRLTQGR

SEQ ID NO: 293511 - protein, 8 aa, Influenza virus
DRLTQGRQ

SEQ ID NO: 293512 - protein, 8 aa, Influenza virus
RLTQGRQT

SEQ ID NO: 293513 - protein, 8 aa, Influenza virus
LTQGRQTF

SEQ ID NO: 293514 - protein, 8 aa, Influenza virus
TQGRQTFD

SEQ ID NO: 293515 - protein, 8 aa, Influenza virus
QGRQTFDW

SEQ ID NO: 293516 - protein, 8 aa, Influenza virus
GRQTFDWT

SEQ ID NO: 293517 - protein, 8 aa, Influenza virus
RQTFDWTL

SEQ ID NO: 293518 - protein, 8 aa, Influenza virus
QTFDWTLN

SEQ ID NO: 293519 - protein, 8 aa, Influenza virus
TFDWTLNR

SEQ ID NO: 293520 - protein, 8 aa, Influenza virus
FDWTLNRN

SEQ ID NO: 293521 - protein, 8 aa, Influenza virus
ALANTIEI

SEQ ID NO: 293522 - protein, 8 aa, Influenza virus
LANTIEIF

SEQ ID NO: 293523 - protein, 8 aa, Influenza virus
ANTIEIFR

SEQ ID NO: 293524 - protein, 8 aa, Influenza virus
NTIEIFRS

SEQ ID NO: 293525 - protein, 8 aa, Influenza virus
TIEIFRSN

SEQ ID NO: 293526 - protein, 8 aa, Influenza virus
SESGRLID

SEQ ID NO: 293527 - protein, 8 aa, Influenza virus
ESGRLMDF

SEQ ID NO: 293528 - protein, 8 aa, Influenza virus
SGRLMDFL

SEQ ID NO: 293529 - protein, 8 aa, Influenza virus
GRLMDFLK

SEQ ID NO: 293530 - protein, 8 aa, Influenza virus
RLMDFLKD

SEQ ID NO: 293531 - protein, 8 aa, Influenza virus
LMDFLKDV

SEQ ID NO: 293532 - protein, 8 aa, Influenza virus
IDFLKDVI

SEQ ID NO: 293533 - protein, 8 aa, Influenza virus
EVTTHFQR

SEQ ID NO: 293534 - protein, 8 aa, Influenza virus
VTTHFQRK

SEQ ID NO: 293535 - protein, 8 aa, Influenza virus
VTHFQRKR

SEQ ID NO: 293536 - protein, 8 aa, Influenza virus
HFQRKRRI

SEQ ID NO: 293537 - protein, 8 aa, Influenza virus
FQRKRRIR

SEQ ID NO: 293538 - protein, 8 aa, Influenza virus
QRKRRIRD

SEQ ID NO: 293539 - protein, 8 aa, Influenza virus
RKRRIRDN

SEQ ID NO: 293540 - protein, 8 aa, Influenza virus
KRRVRDNV

SEQ ID NO: 293541 - protein, 8 aa, Influenza virus
RRVRDNVT

SEQ ID NO: 293542 - protein, 8 aa, Influenza virus
RVRDNVTK

SEQ ID NO: 293543 - protein, 8 aa, Influenza virus
RDNVTKKM

SEQ ID NO: 293544 - protein, 8 aa, Influenza virus
TKKMITQR

SEQ ID NO: 293545 - protein, 8 aa, Influenza virus
KKMITQRT

SEQ ID NO: 293546 - protein, 8 aa, Influenza virus
KMITQRTI

SEQ ID NO: 293547 - protein, 8 aa, Influenza virus
MITQRTIG

SEQ ID NO: 293548 - protein, 8 aa, Influenza virus
ITQRTIGK

SEQ ID NO: 293549 - protein, 8 aa, Influenza virus
TQRTVGKK

SEQ ID NO: 293550 - protein, 8 aa, Influenza virus
QRTVGKKK

SEQ ID NO: 293551 - protein, 8 aa, Influenza virus
RTIGKKKH

SEQ ID NO: 293552 - protein, 8 aa, Influenza virus
GYLIRALT

SEQ ID NO: 293553 - protein, 8 aa, Influenza virus
YLIRTLTL

SEQ ID NO: 293554 - protein, 8 aa, Influenza virus
LIRTLTLN

SEQ ID NO: 293555 - protein, 8 aa, Influenza virus
IRTLTLNT

SEQ ID NO: 293556 - protein, 8 aa, Influenza virus
RTLTLNTM

SEQ ID NO: 293557 - protein, 8 aa, Influenza virus
MQIRGFVH

SEQ ID NO: 293558 - protein, 8 aa, Influenza virus
QIRGFVHF

SEQ ID NO: 293559 - protein, 8 aa, Influenza virus
IRGFVHFV

SEQ ID NO: 293560 - protein, 8 aa, Influenza virus
RGFVHFVE

SEQ ID NO: 293561 - protein, 8 aa, Influenza virus
GFVYFVEA

SEQ ID NO: 293562 - protein, 8 aa, Influenza virus
FVYFVEAL

SEQ ID NO: 293563 - protein, 8 aa, Influenza virus
VYFVEALA

SEQ ID NO: 293564 - protein, 8 aa, Influenza virus
YFVEALAR

SEQ ID NO: 293565 - protein, 8 aa, Influenza virus
VEALARSI

SEQ ID NO: 293566 - protein, 8 aa, Influenza virus
EALARSIC

SEQ ID NO: 293567 - protein, 8 aa, Influenza virus
LARRICEK

SEQ ID NO: 293568 - protein, 8 aa, Influenza virus
ARRICEKL

SEQ ID NO: 293569 - protein, 8 aa, Influenza virus
RRICEKLE

SEQ ID NO: 293570 - protein, 8 aa, Influenza virus
RICEKLEQ

SEQ ID NO: 293571 - protein, 8 aa, Influenza virus
VVRKMMTS

SEQ ID NO: 293572 - protein, 8 aa, Influenza virus
VRKMMTSS

SEQ ID NO: 293573 - protein, 8 aa, Influenza virus
RKMMTSSQ

SEQ ID NO: 293574 - protein, 8 aa, Influenza virus
KMMTSSQD

SEQ ID NO: 293575 - protein, 8 aa, Influenza virus
MMTSSQDT

SEQ ID NO: 293576 - protein, 8 aa, Influenza virus
MTSSQDTE

SEQ ID NO: 293577 - protein, 8 aa, Influenza virus
TNSQDTEI

SEQ ID NO: 293578 - protein, 8 aa, Influenza virus
NSQDTEIS

SEQ ID NO: 293579 - protein, 8 aa, Influenza virus
SQDTEISF

SEQ ID NO: 293580 - protein, 8 aa, Influenza virus
QDTEISFT

SEQ ID NO: 293581 - protein, 8 aa, Influenza virus
DTEISFTI

SEQ ID NO: 293582 - protein, 8 aa, Influenza virus
TEISFTIT

SEQ ID NO: 293583 - protein, 8 aa, Influenza virus
EISFTITG

SEQ ID NO: 293584 - protein, 8 aa, Influenza virus
ISFTITGD

SEQ ID NO: 293585 - protein, 8 aa, Influenza virus
NENQNPRV

SEQ ID NO: 293586 - protein, 8 aa, Influenza virus
ENQNPRVF

SEQ ID NO: 293587 - protein, 8 aa, Influenza virus
NQNPRVFL

SEQ ID NO: 293588 - protein, 8 aa, Influenza virus
QNPRIFLA

SEQ ID NO: 293589 - protein, 8 aa, Influenza virus
NPRIFLAM

SEQ ID NO: 293590 - protein, 8 aa, Influenza virus
PRIFLAMI

SEQ ID NO: 293591 - protein, 8 aa, Influenza virus
RIFLAMIT

SEQ ID NO: 293592 - protein, 8 aa, Influenza virus
IFLAMITY

SEQ ID NO: 293593 - protein, 8 aa, Influenza virus
FLTMITYI

SEQ ID NO: 293594 - protein, 8 aa, Influenza virus
LTMITYIT

SEQ ID NO: 293595 - protein, 8 aa, Influenza virus
AMITYITK

SEQ ID NO: 293596 - protein, 8 aa, Influenza virus
TYITKNQP

SEQ ID NO: 293597 - protein, 8 aa, Influenza virus
QPEWFRNV

SEQ ID NO: 293598 - protein, 8 aa, Influenza virus
PEWFRNVL

SEQ ID NO: 293599 - protein, 8 aa, Influenza virus
EWFRNVLS

SEQ ID NO: 293600 - protein, 8 aa, Influenza virus
WFRNILSM

SEQ ID NO: 293601 - protein, 8 aa, Influenza virus
FRNILSMA

SEQ ID NO: 293602 - protein, 8 aa, Influenza virus
RNILSMAP

SEQ ID NO: 293603 - protein, 8 aa, Influenza virus
NILSMAPI

SEQ ID NO: 293604 - protein, 8 aa, Influenza virus
ILSMAPIM

SEQ ID NO: 293605 - protein, 8 aa, Influenza virus
LSMAPIMF

SEQ ID NO: 293606 - protein, 8 aa, Influenza virus
SMAPIMFS

SEQ ID NO: 293607 - protein, 8 aa, Influenza virus
MAPIMFSN

SEQ ID NO: 293608 - protein, 8 aa, Influenza virus
MFSNKVAR

SEQ ID NO: 293609 - protein, 8 aa, Influenza virus
FSNKVARL

SEQ ID NO: 293610 - protein, 8 aa, Influenza virus
SNKVARLG

SEQ ID NO: 293611 - protein, 8 aa, Influenza virus
NKMARLGR

SEQ ID NO: 293612 - protein, 8 aa, Influenza virus
KMARLGRG

SEQ ID NO: 293613 - protein, 8 aa, Influenza virus
MARLGRGY

SEQ ID NO: 293614 - protein, 8 aa, Influenza virus
ARLGRGYM

SEQ ID NO: 293615 - protein, 8 aa, Influenza virus
RLGRGYMF

SEQ ID NO: 293616 - protein, 8 aa, Influenza virus
LGRGYMFE

SEQ ID NO: 293617 - protein, 8 aa, Influenza virus
GRGYMFES

SEQ ID NO: 293618 - protein, 8 aa, Influenza virus
RGYMFESK

SEQ ID NO: 293619 - protein, 8 aa, Influenza virus
GYMFESKR

SEQ ID NO: 293620 - protein, 8 aa, Influenza virus
YMFESKRM

SEQ ID NO: 293621 - protein, 8 aa, Influenza virus
MKIRTQIP

SEQ ID NO: 293622 - protein, 8 aa, Influenza virus
KIRTQIPA

SEQ ID NO: 293623 - protein, 8 aa, Influenza virus
IRTQIPAE

SEQ ID NO: 293624 - protein, 8 aa, Influenza virus
IDLKYFND

SEQ ID NO: 293625 - protein, 8 aa, Influenza virus
KIERIRPL

SEQ ID NO: 293626 - protein, 8 aa, Influenza virus
IERIRPLL

SEQ ID NO: 293627 - protein, 8 aa, Influenza virus
GAASLSPG

SEQ ID NO: 293628 - protein, 8 aa, Influenza virus
AASLSPGM

SEQ ID NO: 293629 - protein, 8 aa, Influenza virus
VSLSPGMM

SEQ ID NO: 293630 - protein, 8 aa, Influenza virus
LGVSVLNL

SEQ ID NO: 293631 - protein, 8 aa, Influenza virus
GVSVLNLG

SEQ ID NO: 293632 - protein, 8 aa, Influenza virus
VSVLNLGQ

SEQ ID NO: 293633 - protein, 8 aa, Influenza virus
SILNLGQR

SEQ ID NO: 293634 - protein, 8 aa, Influenza virus
ILNLGQKK

SEQ ID NO: 293635 - protein, 8 aa, Influenza virus
LNLGQKKY

SEQ ID NO: 293636 - protein, 8 aa, Influenza virus
NLGQKKYT

SEQ ID NO: 293637 - protein, 8 aa, Influenza virus
TIYWWDGL

SEQ ID NO: 293638 - protein, 8 aa, Influenza virus
IYWWDGLQ

SEQ ID NO: 293639 - protein, 8 aa, Influenza virus
DDFALILN

SEQ ID NO: 293640 - protein, 8 aa, Influenza virus
DFALILNA

SEQ ID NO: 293641 - protein, 8 aa, Influenza virus
FALIVNAS

SEQ ID NO: 293642 - protein, 8 aa, Influenza virus
AGIQAGVD

SEQ ID NO: 293643 - protein, 8 aa, Influenza virus
GIQAGVNR

SEQ ID NO: 293644 - protein, 8 aa, Influenza virus
IQAGVNRF

SEQ ID NO: 293645 - protein, 8 aa, Influenza virus
QAGVNRFY

SEQ ID NO: 293646 - protein, 8 aa, Influenza virus
AGVNRFYR

SEQ ID NO: 293647 - protein, 8 aa, Influenza virus
GVDRFYRI

SEQ ID NO: 293648 - protein, 8 aa, Influenza virus
VDRFYRIC

SEQ ID NO: 293649 - protein, 8 aa, Influenza virus
DRFYRICK

SEQ ID NO: 293650 - protein, 8 aa, Influenza virus
RFYRICKL

SEQ ID NO: 293651 - protein, 8 aa, Influenza virus
FYRTCKLL

SEQ ID NO: 293652 - protein, 8 aa, Influenza virus
YRTCKLLG

SEQ ID NO: 293653 - protein, 8 aa, Influenza virus
RTCKLLGI

SEQ ID NO: 293654 - protein, 8 aa, Influenza virus
TCKLLGIN

SEQ ID NO: 293655 - protein, 8 aa, Influenza virus
CKLLGINM

SEQ ID NO: 293656 - protein, 8 aa, Influenza virus
KLLGINMS

SEQ ID NO: 293657 - protein, 8 aa, Influenza virus
LLGINMSK

SEQ ID NO: 293658 - protein, 8 aa, Influenza virus
LGINMSKK

SEQ ID NO: 293659 - protein, 8 aa, Influenza virus
KKKSYINK

SEQ ID NO: 293660 - protein, 8 aa, Influenza virus
KKSYINKT

SEQ ID NO: 293661 - protein, 8 aa, Influenza virus
KSYINKTG

SEQ ID NO: 293662 - protein, 8 aa, Influenza virus
SYINKTGT

SEQ ID NO: 293663 - protein, 8 aa, Influenza virus
YINKTGTF

SEQ ID NO: 293664 - protein, 8 aa, Influenza virus
INKTGTFE

SEQ ID NO: 293665 - protein, 8 aa, Influenza virus
NKTGTFEF

SEQ ID NO: 293666 - protein, 8 aa, Influenza virus
KTGTFEFT

SEQ ID NO: 293667 - protein, 8 aa, Influenza virus
PSFGVSGV

SEQ ID NO: 293668 - protein, 8 aa, Influenza virus
SFGVSGVN

SEQ ID NO: 293669 - protein, 8 aa, Influenza virus
FGVSGVNE

SEQ ID NO: 293670 - protein, 8 aa, Influenza virus
GVSGVNES

SEQ ID NO: 293671 - protein, 8 aa, Influenza virus
VSGVNESA

SEQ ID NO: 293672 - protein, 8 aa, Influenza virus
SGVNESAD

SEQ ID NO: 293673 - protein, 8 aa, Influenza virus
GVNESADM

SEQ ID NO: 293674 - protein, 8 aa, Influenza virus
VNESADMS

SEQ ID NO: 293675 - protein, 8 aa, Influenza virus
SADMSIGI

SEQ ID NO: 293676 - protein, 8 aa, Influenza virus
ADMSIGIT

SEQ ID NO: 293677 - protein, 8 aa, Influenza virus
DMSIGITV

SEQ ID NO: 293678 - protein, 8 aa, Influenza virus
MSIGITVI

SEQ ID NO: 293679 - protein, 8 aa, Influenza virus
SIGITVIK

SEQ ID NO: 293680 - protein, 8 aa, Influenza virus
IGITVIKN

SEQ ID NO: 293681 - protein, 8 aa, Influenza virus
GITVIKNN

SEQ ID NO: 293682 - protein, 8 aa, Influenza virus
ITVIKNNM

SEQ ID NO: 293683 - protein, 8 aa, Influenza virus
TVIRNNMI

SEQ ID NO: 293684 - protein, 8 aa, Influenza virus
VIRNNMIN

SEQ ID NO: 293685 - protein, 8 aa, Influenza virus
IRNNMINN

SEQ ID NO: 293686 - protein, 8 aa, Influenza virus
RNNMINND

SEQ ID NO: 293687 - protein, 8 aa, Influenza virus
RYTYRCHK

SEQ ID NO: 293688 - protein, 8 aa, Influenza virus
YTYRCHKG

SEQ ID NO: 293689 - protein, 8 aa, Influenza virus
TYRCHKGD

SEQ ID NO: 293690 - protein, 8 aa, Influenza virus
YRCHKGDT

SEQ ID NO: 293691 - protein, 8 aa, Influenza virus
RCHKGDTQ

SEQ ID NO: 293692 - protein, 8 aa, Influenza virus
CHKGDTQI

SEQ ID NO: 293693 - protein, 8 aa, Influenza virus
QIQTKRSF

SEQ ID NO: 293694 - protein, 8 aa, Influenza virus
IQTKRSFE

SEQ ID NO: 293695 - protein, 8 aa, Influenza virus
QTRRSFEI

SEQ ID NO: 293696 - protein, 8 aa, Influenza virus
TRRSFEIK

SEQ ID NO: 293697 - protein, 8 aa, Influenza virus
GLLISDGG

SEQ ID NO: 293698 - protein, 8 aa, Influenza virus
LLISDGGP

SEQ ID NO: 293699 - protein, 8 aa, Influenza virus
LISDGGPN

SEQ ID NO: 293700 - protein, 8 aa, Influenza virus
ISDGGPNL

SEQ ID NO: 293701 - protein, 8 aa, Influenza virus
ADGGPNLY

SEQ ID NO: 293702 - protein, 8 aa, Influenza virus
LHIPEAGL

SEQ ID NO: 293703 - protein, 8 aa, Influenza virus
PEVCLKWD

SEQ ID NO: 293704 - protein, 8 aa, Influenza virus
EVCLKWDL

SEQ ID NO: 293705 - protein, 8 aa, Influenza virus
VCLKWDLM

SEQ ID NO: 293706 - protein, 8 aa, Influenza virus
CLKWDLMD

SEQ ID NO: 293707 - protein, 8 aa, Influenza virus
YRGRLCNP

SEQ ID NO: 293708 - protein, 8 aa, Influenza virus
RGRLCNPL

SEQ ID NO: 293709 - protein, 8 aa, Influenza virus
GRLCNPMN

SEQ ID NO: 293710 - protein, 8 aa, Influenza virus
CNPMNPFV

SEQ ID NO: 293711 - protein, 8 aa, Influenza virus
NPLNPFVN

SEQ ID NO: 293712 - protein, 8 aa, Influenza virus
PLNPFVNH

SEQ ID NO: 293713 - protein, 8 aa, Influenza virus
NPFVNHKG

SEQ ID NO: 293714 - protein, 8 aa, Influenza virus
IEYDAVAT

SEQ ID NO: 293715 - protein, 8 aa, Influenza virus
VATTHSWV

SEQ ID NO: 293716 - protein, 8 aa, Influenza virus
ATTHSWVP

SEQ ID NO: 293717 - protein, 8 aa, Influenza virus
TTHSWVPK

SEQ ID NO: 293718 - protein, 8 aa, Influenza virus
THSWVPKR

SEQ ID NO: 293719 - protein, 8 aa, Influenza virus
HSWVPKRN

SEQ ID NO: 293720 - protein, 8 aa, Influenza virus
SWVPKRNR

SEQ ID NO: 293721 - protein, 8 aa, Influenza virus
WVPKRNRS

SEQ ID NO: 293722 - protein, 8 aa, Influenza virus
VPKRNRSI

SEQ ID NO: 293723 - protein, 8 aa, Influenza virus
LNTSQRGV

SEQ ID NO: 293724 - protein, 8 aa, Influenza virus
NTSQRGVL

SEQ ID NO: 293725 - protein, 8 aa, Influenza virus
TSQRGVLE

SEQ ID NO: 293726 - protein, 8 aa, Influenza virus
SQRGVLED

SEQ ID NO: 293727 - protein, 8 aa, Influenza virus
RGVLEDEQ

SEQ ID NO: 293728 - protein, 8 aa, Influenza virus
GVLEDEQM

SEQ ID NO: 293729 - protein, 8 aa, Influenza virus
VLEDEQMY

SEQ ID NO: 293730 - protein, 8 aa, Influenza virus
EDEQMYQR

SEQ ID NO: 293731 - protein, 8 aa, Influenza virus
DEQMYQRC

SEQ ID NO: 293732 - protein, 8 aa, Influenza virus
EQMYQRCC

SEQ ID NO: 293733 - protein, 8 aa, Influenza virus
QMYQRCCN

SEQ ID NO: 293734 - protein, 8 aa, Influenza virus
MYQRCCNL

SEQ ID NO: 293735 - protein, 8 aa, Influenza virus
YQRCCNLF

SEQ ID NO: 293736 - protein, 8 aa, Influenza virus
QRCCNLFE

SEQ ID NO: 293737 - protein, 8 aa, Influenza virus
RCCNLFEK

SEQ ID NO: 293738 - protein, 8 aa, Influenza virus
CCSLFEKF

SEQ ID NO: 293739 - protein, 8 aa, Influenza virus
CSLFEKFF

SEQ ID NO: 293740 - protein, 8 aa, Influenza virus
SLFEKFFP

SEQ ID NO: 293741 - protein, 8 aa, Influenza virus
SSSYRRPI

SEQ ID NO: 293742 - protein, 8 aa, Influenza virus
SSYRRPIG

SEQ ID NO: 293743 - protein, 8 aa, Influenza virus
SYRRPIGI

SEQ ID NO: 293744 - protein, 8 aa, Influenza virus
YRRPIGIS

SEQ ID NO: 293745 - protein, 8 aa, Influenza virus
RRPIGISS

SEQ ID NO: 293746 - protein, 8 aa, Influenza virus
RPIGISSM

SEQ ID NO: 293747 - protein, 8 aa, Influenza virus
PIGISSMV

SEQ ID NO: 293748 - protein, 8 aa, Influenza virus
IGISSMVE

SEQ ID NO: 293749 - protein, 8 aa, Influenza virus
GISSMMEA

SEQ ID NO: 293750 - protein, 8 aa, Influenza virus
ISSMMEAM

SEQ ID NO: 293751 - protein, 8 aa, Influenza virus
SSMMEAMV

SEQ ID NO: 293752 - protein, 8 aa, Influenza virus
SMMEAMVS

SEQ ID NO: 293753 - protein, 8 aa, Influenza virus
MMEAMVSR

SEQ ID NO: 293754 - protein, 8 aa, Influenza virus
MEAMVSRA

SEQ ID NO: 293755 - protein, 8 aa, Influenza virus
EAMISRAR

SEQ ID NO: 293756 - protein, 8 aa, Influenza virus
AMISRARI

SEQ ID NO: 293757 - protein, 8 aa, Influenza virus
MISRARID

SEQ ID NO: 293758 - protein, 8 aa, Influenza virus
ISRARIDA

SEQ ID NO: 293759 - protein, 8 aa, Influenza virus
RARIDARV

SEQ ID NO: 293760 - protein, 8 aa, Influenza virus
ARIDARVD

SEQ ID NO: 293761 - protein, 8 aa, Influenza virus
RIDARVDF

SEQ ID NO: 293762 - protein, 8 aa, Influenza virus
IDARVDFE

SEQ ID NO: 293763 - protein, 8 aa, Influenza virus
DARVDFES

SEQ ID NO: 293764 - protein, 8 aa, Influenza virus
ARVDFESG

SEQ ID NO: 293765 - protein, 8 aa, Influenza virus
RVDFESGR

SEQ ID NO: 293766 - protein, 8 aa, Influenza virus
VDFESGRI

SEQ ID NO: 293767 - protein, 8 aa, Influenza virus
GKKEFSEI

SEQ ID NO: 293768 - protein, 8 aa, Influenza virus
ELRRQKWW

SEQ ID NO: 293769 - protein, 8 aa, Influenza virus
LRRQKWWV

SEQ ID NO: 293770 - protein, 8 aa, Influenza virus
RRQKSLIW

SEQ ID NO: 293771 - protein, 8 aa, Influenza virus
RQKSLIWL

SEQ ID NO: 293772 - protein, 8 aa, Influenza virus
QKWWVWLW

SEQ ID NO: 293773 - protein, 8 aa, Influenza virus
KSLIWLWL

SEQ ID NO: 293774 - protein, 8 aa, Influenza virus
WWVWLWLV

SEQ ID NO: 293775 - protein, 8 aa, Influenza virus
LIWLWLVL

SEQ ID NO: 293776 - protein, 8 aa, Influenza virus
IWLWLVLR

SEQ ID NO: 293777 - protein, 8 aa, Influenza virus
SESRSNIF

SEQ ID NO: 293778 - protein, 8 aa, Influenza virus
ESRSNIFN

SEQ ID NO: 293779 - protein, 8 aa, Influenza virus
SRSIIFNM

SEQ ID NO: 293780 - protein, 8 aa, Influenza virus
RSIIFNME

SEQ ID NO: 293781 - protein, 8 aa, Influenza virus
SIIFNMER

SEQ ID NO: 293782 - protein, 8 aa, Influenza virus
IIFNMERI

SEQ ID NO: 293783 - protein, 8 aa, Influenza virus
MERIRELR

SEQ ID NO: 293784 - protein, 8 aa, Influenza virus
NLMSQSRT

SEQ ID NO: 293785 - protein, 8 aa, Influenza virus
LMLQSRTR

SEQ ID NO: 293786 - protein, 8 aa, Influenza virus
MLQSRTRE

SEQ ID NO: 293787 - protein, 8 aa, Influenza virus
LQSRTREI

SEQ ID NO: 293788 - protein, 8 aa, Influenza virus
QSRTRGIL

SEQ ID NO: 293789 - protein, 8 aa, Influenza virus
RTREILTR

SEQ ID NO: 293790 - protein, 8 aa, Influenza virus
TREILTRT

SEQ ID NO: 293791 - protein, 8 aa, Influenza virus
REILTRTT

SEQ ID NO: 293792 - protein, 8 aa, Influenza virus
EILTRTTV

SEQ ID NO: 293793 - protein, 8 aa, Influenza virus
ILTRTTVD

SEQ ID NO: 293794 - protein, 8 aa, Influenza virus
LTRTTVDH

SEQ ID NO: 293795 - protein, 8 aa, Influenza virus
TRTTVDHM

SEQ ID NO: 293796 - protein, 8 aa, Influenza virus
RTTVDHMA

SEQ ID NO: 293797 - protein, 8 aa, Influenza virus
IIKKYTSA

SEQ ID NO: 293798 - protein, 8 aa, Influenza virus
IKKYTSAR

SEQ ID NO: 293799 - protein, 8 aa, Influenza virus
KKYTSARQ

SEQ ID NO: 293800 - protein, 8 aa, Influenza virus
KYTSARQE

SEQ ID NO: 293801 - protein, 8 aa, Influenza virus
YTSARQEK

SEQ ID NO: 293802 - protein, 8 aa, Influenza virus
TSARQEKN

SEQ ID NO: 293803 - protein, 8 aa, Influenza virus
SARQEKNP

SEQ ID NO: 293804 - protein, 8 aa, Influenza virus
GRQEKNPS

SEQ ID NO: 293805 - protein, 8 aa, Influenza virus
RQEKNPSL

SEQ ID NO: 293806 - protein, 8 aa, Influenza virus
QEKNPSLR

SEQ ID NO: 293807 - protein, 8 aa, Influenza virus
EKNPSLRM

SEQ ID NO: 293808 - protein, 8 aa, Influenza virus
KNPSLRMK

SEQ ID NO: 293809 - protein, 8 aa, Influenza virus
NPSLRMKW

SEQ ID NO: 293810 - protein, 8 aa, Influenza virus
PSLRMKWM

SEQ ID NO: 293811 - protein, 8 aa, Influenza virus
SLRMKWMM

SEQ ID NO: 293812 - protein, 8 aa, Influenza virus
MKWMMAMR

SEQ ID NO: 293813 - protein, 8 aa, Influenza virus
KWMMAMRY

SEQ ID NO: 293814 - protein, 8 aa, Influenza virus
WMMAMRYP

SEQ ID NO: 293815 - protein, 8 aa, Influenza virus
MMAMRYPI

SEQ ID NO: 293816 - protein, 8 aa, Influenza virus
MAMRYPIT

SEQ ID NO: 293817 - protein, 8 aa, Influenza virus
AMRYPITA

SEQ ID NO: 293818 - protein, 8 aa, Influenza virus
MRYPITAD

SEQ ID NO: 293819 - protein, 8 aa, Influenza virus
RYPITADK

SEQ ID NO: 293820 - protein, 8 aa, Influenza virus
VPERNEQG

SEQ ID NO: 293821 - protein, 8 aa, Influenza virus
PERNEHGQ

SEQ ID NO: 293822 - protein, 8 aa, Influenza virus
RNEHGQTL

SEQ ID NO: 293823 - protein, 8 aa, Influenza virus
NEHGQTLW

SEQ ID NO: 293824 - protein, 8 aa, Influenza virus
DAGSDRLM

SEQ ID NO: 293825 - protein, 8 aa, Influenza virus
GSDRVMIS

SEQ ID NO: 293826 - protein, 8 aa, Influenza virus
MISPLAVT

SEQ ID NO: 293827 - protein, 8 aa, Influenza virus
ISPLAVTW

SEQ ID NO: 293828 - protein, 8 aa, Influenza virus
AVTWWNRK

SEQ ID NO: 293829 - protein, 8 aa, Influenza virus
VTWWNRKG

SEQ ID NO: 293830 - protein, 8 aa, Influenza virus
TWWNRKGP

SEQ ID NO: 293831 - protein, 8 aa, Influenza virus
HYPKIYKT

SEQ ID NO: 293832 - protein, 8 aa, Influenza virus
YPKIYKTY

SEQ ID NO: 293833 - protein, 8 aa, Influenza virus
PKIYKTYF

SEQ ID NO: 293834 - protein, 8 aa, Influenza virus
KVYKTYFD

SEQ ID NO: 293835 - protein, 8 aa, Influenza virus
VYKTYFDK

SEQ ID NO: 293836 - protein, 8 aa, Influenza virus
GIFGPVHF

SEQ ID NO: 293837 - protein, 8 aa, Influenza virus
TFGPVHFQ

SEQ ID NO: 293838 - protein, 8 aa, Influenza virus
FGPVHFQN

SEQ ID NO: 293839 - protein, 8 aa, Influenza virus
GPVHFQNQ

SEQ ID NO: 293840 - protein, 8 aa, Influenza virus
PVHFRNQI

SEQ ID NO: 293841 - protein, 8 aa, Influenza virus
VHFRNQIK

SEQ ID NO: 293842 - protein, 8 aa, Influenza virus
HFRNQIKI

SEQ ID NO: 293843 - protein, 8 aa, Influenza virus
FRNQIKIR

SEQ ID NO: 293844 - protein, 8 aa, Influenza virus
RNQIKIRR

SEQ ID NO: 293845 - protein, 8 aa, Influenza virus
NQIKIRRR

SEQ ID NO: 293846 - protein, 8 aa, Influenza virus
QIKIRRRV

SEQ ID NO: 293847 - protein, 8 aa, Influenza virus
IKIRRRVD

SEQ ID NO: 293848 - protein, 8 aa, Influenza virus
KIRRRVDT

SEQ ID NO: 293849 - protein, 8 aa, Influenza virus
IRRRVDTN

SEQ ID NO: 293850 - protein, 8 aa, Influenza virus
RRRVDTNP

SEQ ID NO: 293851 - protein, 8 aa, Influenza virus
RRVDTNPG

SEQ ID NO: 293852 - protein, 8 aa, Influenza virus
RVDTNPGH

SEQ ID NO: 293853 - protein, 8 aa, Influenza virus
VDTNPGHA

SEQ ID NO: 293854 - protein, 8 aa, Influenza virus
DTNPGHAD

SEQ ID NO: 293855 - protein, 8 aa, Influenza virus
TNPGHADL

SEQ ID NO: 293856 - protein, 8 aa, Influenza virus
NPGHADLN

SEQ ID NO: 293857 - protein, 8 aa, Influenza virus
DLSSKEAQ

SEQ ID NO: 293858 - protein, 8 aa, Influenza virus
LSSKEAQD

SEQ ID NO: 293859 - protein, 8 aa, Influenza virus
SSKEAQDV

SEQ ID NO: 293860 - protein, 8 aa, Influenza virus
SKEAQDVI

SEQ ID NO: 293861 - protein, 8 aa, Influenza virus
FPNEVGAK

SEQ ID NO: 293862 - protein, 8 aa, Influenza virus
PNEVGAKI

SEQ ID NO: 293863 - protein, 8 aa, Influenza virus
NEVGAKIL

SEQ ID NO: 293864 - protein, 8 aa, Influenza virus
EVGAKILT

SEQ ID NO: 293865 - protein, 8 aa, Influenza virus
VGAKILTS

SEQ ID NO: 293866 - protein, 8 aa, Influenza virus
GAKILTSE

SEQ ID NO: 293867 - protein, 8 aa, Influenza virus
AKILTSES

SEQ ID NO: 293868 - protein, 8 aa, Influenza virus
KILTSESQ

SEQ ID NO: 293869 - protein, 8 aa, Influenza virus
ILTSESQM

SEQ ID NO: 293870 - protein, 8 aa, Influenza virus
TREKKEEL

SEQ ID NO: 293871 - protein, 8 aa, Influenza virus
ISPLMVAY

SEQ ID NO: 293872 - protein, 8 aa, Influenza virus
SPLMVAYM

SEQ ID NO: 293873 - protein, 8 aa, Influenza virus
KTRFLPVS

SEQ ID NO: 293874 - protein, 8 aa, Influenza virus
TRFLPVSG

SEQ ID NO: 293875 - protein, 8 aa, Influenza virus
RFLPVSGG

SEQ ID NO: 293876 - protein, 8 aa, Influenza virus
FLPVSGGT

SEQ ID NO: 293877 - protein, 8 aa, Influenza virus
LPVAGGTG

SEQ ID NO: 293878 - protein, 8 aa, Influenza virus
PVAGGTGS

SEQ ID NO: 293879 - protein, 8 aa, Influenza virus
GGTGSVYI

SEQ ID NO: 293880 - protein, 8 aa, Influenza virus
GTGSVYIE

SEQ ID NO: 293881 - protein, 8 aa, Influenza virus
TGSVYIEV

SEQ ID NO: 293882 - protein, 8 aa, Influenza virus
GSVYIEVL

SEQ ID NO: 293883 - protein, 8 aa, Influenza virus
SIYIEVLH

SEQ ID NO: 293884 - protein, 8 aa, Influenza virus
IYIEVLHL

SEQ ID NO: 293885 - protein, 8 aa, Influenza virus
YVEVLHLT

SEQ ID NO: 293886 - protein, 8 aa, Influenza virus
VEVLHLTQ

SEQ ID NO: 293887 - protein, 8 aa, Influenza virus
VLHLTQGA

SEQ ID NO: 293888 - protein, 8 aa, Influenza virus
LHLTQGAC

SEQ ID NO: 293889 - protein, 8 aa, Influenza virus
HLTQGACW

SEQ ID NO: 293890 - protein, 8 aa, Influenza virus
LTQGACWE

SEQ ID NO: 293891 - protein, 8 aa, Influenza virus
TQGACWEQ

SEQ ID NO: 293892 - protein, 8 aa, Influenza virus
QGACWEQL

SEQ ID NO: 293893 - protein, 8 aa, Influenza virus
GACWEQLY

SEQ ID NO: 293894 - protein, 8 aa, Influenza virus
ACWEQLYT

SEQ ID NO: 293895 - protein, 8 aa, Influenza virus
CWEQLYTP

SEQ ID NO: 293896 - protein, 8 aa, Influenza virus
WEQLYTPG

SEQ ID NO: 293897 - protein, 8 aa, Influenza virus
EQLYTPGG

SEQ ID NO: 293898 - protein, 8 aa, Influenza virus
QMYTPGGG

SEQ ID NO: 293899 - protein, 8 aa, Influenza virus
MYTPGGGV

SEQ ID NO: 293900 - protein, 8 aa, Influenza virus
YTPGGGVR

SEQ ID NO: 293901 - protein, 8 aa, Influenza virus
TPGGGVRN

SEQ ID NO: 293902 - protein, 8 aa, Influenza virus
PGGGVRND

SEQ ID NO: 293903 - protein, 8 aa, Influenza virus
GGGVRNDD

SEQ ID NO: 293904 - protein, 8 aa, Influenza virus
VRNDDIDQ

SEQ ID NO: 293905 - protein, 8 aa, Influenza virus
RNDDIDQS

SEQ ID NO: 293906 - protein, 8 aa, Influenza virus
NDDIDQSL

SEQ ID NO: 293907 - protein, 8 aa, Influenza virus
DDIDQSLI

SEQ ID NO: 293908 - protein, 8 aa, Influenza virus
DIDQSLII

SEQ ID NO: 293909 - protein, 8 aa, Influenza virus
IDQSLIIA

SEQ ID NO: 293910 - protein, 8 aa, Influenza virus
DQSLVIAA

SEQ ID NO: 293911 - protein, 8 aa, Influenza virus
QSLVIAAR

SEQ ID NO: 293912 - protein, 8 aa, Influenza virus
SLIIAARS

SEQ ID NO: 293913 - protein, 8 aa, Influenza virus
LIIAARSI

SEQ ID NO: 293914 - protein, 8 aa, Influenza virus
IIAARSIV

SEQ ID NO: 293915 - protein, 8 aa, Influenza virus
IAARSIVR

SEQ ID NO: 293916 - protein, 8 aa, Influenza virus
AARSIVRR

SEQ ID NO: 293917 - protein, 8 aa, Influenza virus
ARSIVRRA

SEQ ID NO: 293918 - protein, 8 aa, Influenza virus
RNIVRRAT

SEQ ID NO: 293919 - protein, 8 aa, Influenza virus
NIVRRATV

SEQ ID NO: 293920 - protein, 8 aa, Influenza virus
IVRRATVS

SEQ ID NO: 293921 - protein, 8 aa, Influenza virus
VRRATVSA

SEQ ID NO: 293922 - protein, 8 aa, Influenza virus
RRATVSAD

SEQ ID NO: 293923 - protein, 8 aa, Influenza virus
RATVSADP

SEQ ID NO: 293924 - protein, 8 aa, Influenza virus
ATVSADPL

SEQ ID NO: 293925 - protein, 8 aa, Influenza virus
TVSADPLA

SEQ ID NO: 293926 - protein, 8 aa, Influenza virus
VSADPLLS

SEQ ID NO: 293927 - protein, 8 aa, Influenza virus
SADPLLSL

SEQ ID NO: 293928 - protein, 8 aa, Influenza virus
ADPLLSLL

SEQ ID NO: 293929 - protein, 8 aa, Influenza virus
DPLLSLLE

SEQ ID NO: 293930 - protein, 8 aa, Influenza virus
PLLSLLEM

SEQ ID NO: 293931 - protein, 8 aa, Influenza virus
LLSLLEMC

SEQ ID NO: 293932 - protein, 8 aa, Influenza virus
LSLLEMCH

SEQ ID NO: 293933 - protein, 8 aa, Influenza virus
LEMCHSTR

SEQ ID NO: 293934 - protein, 8 aa, Influenza virus
EMCHSTRI

SEQ ID NO: 293935 - protein, 8 aa, Influenza virus
MCHSTRIG

SEQ ID NO: 293936 - protein, 8 aa, Influenza virus
CHSTRIGG

SEQ ID NO: 293937 - protein, 8 aa, Influenza virus
DILKQNPT

SEQ ID NO: 293938 - protein, 8 aa, Influenza virus
ILKQNPTE

SEQ ID NO: 293939 - protein, 8 aa, Influenza virus
LKQNPTEE

SEQ ID NO: 293940 - protein, 8 aa, Influenza virus
KQNPTEEQ

SEQ ID NO: 293941 - protein, 8 aa, Influenza virus
PTEEQAVG

SEQ ID NO: 293942 - protein, 8 aa, Influenza virus
TEEQAVGI

SEQ ID NO: 293943 - protein, 8 aa, Influenza virus
EEQAVGIC

SEQ ID NO: 293944 - protein, 8 aa, Influenza virus
EQAVGICK

SEQ ID NO: 293945 - protein, 8 aa, Influenza virus
QAVGICKA

SEQ ID NO: 293946 - protein, 8 aa, Influenza virus
AVGICKAA

SEQ ID NO: 293947 - protein, 8 aa, Influenza virus
VDICKAAI

SEQ ID NO: 293948 - protein, 8 aa, Influenza virus
DICKAAIG

SEQ ID NO: 293949 - protein, 8 aa, Influenza virus
ICKAAIGL

SEQ ID NO: 293950 - protein, 8 aa, Influenza virus
CKAAIGLR

SEQ ID NO: 293951 - protein, 8 aa, Influenza virus
KAAIGLRI

SEQ ID NO: 293952 - protein, 8 aa, Influenza virus
AAIGLRIS

SEQ ID NO: 293953 - protein, 8 aa, Influenza virus
AIGLRISS

SEQ ID NO: 293954 - protein, 8 aa, Influenza virus
IGLRISSS

SEQ ID NO: 293955 - protein, 8 aa, Influenza virus
GLKISSSF

SEQ ID NO: 293956 - protein, 8 aa, Influenza virus
LKISSSFS

SEQ ID NO: 293957 - protein, 8 aa, Influenza virus
KISSSFSF

SEQ ID NO: 293958 - protein, 8 aa, Influenza virus
GFTFKRTK

SEQ ID NO: 293959 - protein, 8 aa, Influenza virus
FTFKRTKG

SEQ ID NO: 293960 - protein, 8 aa, Influenza virus
TFKRTKGS

SEQ ID NO: 293961 - protein, 8 aa, Influenza virus
FKRTKGSS

SEQ ID NO: 293962 - protein, 8 aa, Influenza virus
EEEMLTGN

SEQ ID NO: 293963 - protein, 8 aa, Influenza virus
EEMLTGNL

SEQ ID NO: 293964 - protein, 8 aa, Influenza virus
EMLTGNLQ

SEQ ID NO: 293965 - protein, 8 aa, Influenza virus
MLTGNLQT

SEQ ID NO: 293966 - protein, 8 aa, Influenza virus
TGNLQTLR

SEQ ID NO: 293967 - protein, 8 aa, Influenza virus
GNLQTLKL

SEQ ID NO: 293968 - protein, 8 aa, Influenza virus
IHEGYEEF

SEQ ID NO: 293969 - protein, 8 aa, Influenza virus
YEGYEEFT

SEQ ID NO: 293970 - protein, 8 aa, Influenza virus
EGYEEFTL

SEQ ID NO: 293971 - protein, 8 aa, Influenza virus
GYEEFTLV

SEQ ID NO: 293972 - protein, 8 aa, Influenza virus
YEEFTLVG

SEQ ID NO: 293973 - protein, 8 aa, Influenza virus
VGKRATAI

SEQ ID NO: 293974 - protein, 8 aa, Influenza virus
RATAILKK

SEQ ID NO: 293975 - protein, 8 aa, Influenza virus
ATAILKKA

SEQ ID NO: 293976 - protein, 8 aa, Influenza virus
TAILKKAT

SEQ ID NO: 293977 - protein, 8 aa, Influenza virus
AILKKATR

SEQ ID NO: 293978 - protein, 8 aa, Influenza virus
RKATRRLV

SEQ ID NO: 293979 - protein, 8 aa, Influenza virus
KATRRLVQ

SEQ ID NO: 293980 - protein, 8 aa, Influenza virus
ATRRLVQL

SEQ ID NO: 293981 - protein, 8 aa, Influenza virus
TRRLVQLI

SEQ ID NO: 293982 - protein, 8 aa, Influenza virus
RRLVQLIV

SEQ ID NO: 293983 - protein, 8 aa, Influenza virus
RLVQLIVS

SEQ ID NO: 293984 - protein, 8 aa, Influenza virus
LVQLIVSG

SEQ ID NO: 293985 - protein, 8 aa, Influenza virus
VQLIVSGR

SEQ ID NO: 293986 - protein, 8 aa, Influenza virus
QLIVSGKD

SEQ ID NO: 293987 - protein, 8 aa, Influenza virus
IVSGKDEQ

SEQ ID NO: 293988 - protein, 8 aa, Influenza virus
VSGKDEQS

SEQ ID NO: 293989 - protein, 8 aa, Influenza virus
SGKDEQSI

SEQ ID NO: 293990 - protein, 8 aa, Influenza virus
VVAMVFSQ

SEQ ID NO: 293991 - protein, 8 aa, Influenza virus
AMVFSQEE

SEQ ID NO: 293992 - protein, 8 aa, Influenza virus
MVFSQEEC

SEQ ID NO: 293993 - protein, 8 aa, Influenza virus
VFSQEECM

SEQ ID NO: 293994 - protein, 8 aa, Influenza virus
FSQEDCMV

SEQ ID NO: 293995 - protein, 8 aa, Influenza virus
SQEDCMVK

SEQ ID NO: 293996 - protein, 8 aa, Influenza virus
QEDCMVKA

SEQ ID NO: 293997 - protein, 8 aa, Influenza virus
EDCMVKAV

SEQ ID NO: 293998 - protein, 8 aa, Influenza virus
DCMVKAVR

SEQ ID NO: 293999 - protein, 8 aa, Influenza virus
CMVKAVRG

SEQ ID NO: 294000 - protein, 8 aa, Influenza virus
MVKAVRGD

SEQ ID NO: 294001 - protein, 8 aa, Influenza virus
VKAVRGDL

SEQ ID NO: 294002 - protein, 8 aa, Influenza virus
RANQRLNT

SEQ ID NO: 294003 - protein, 8 aa, Influenza virus
ANQRLNTM

SEQ ID NO: 294004 - protein, 8 aa, Influenza virus
NQRLNTMH

SEQ ID NO: 294005 - protein, 8 aa, Influenza virus
QRLNTMHQ

SEQ ID NO: 294006 - protein, 8 aa, Influenza virus
RLNTMHQL

SEQ ID NO: 294007 - protein, 8 aa, Influenza virus
LNTMHQLL

SEQ ID NO: 294008 - protein, 8 aa, Influenza virus
NTMHQLLR

SEQ ID NO: 294009 - protein, 8 aa, Influenza virus
TMHQLLRH

SEQ ID NO: 294010 - protein, 8 aa, Influenza virus
LRHFQKNA

SEQ ID NO: 294011 - protein, 8 aa, Influenza virus
RHFQKDAR

SEQ ID NO: 294012 - protein, 8 aa, Influenza virus
HFQKDAKI

SEQ ID NO: 294013 - protein, 8 aa, Influenza virus
FQKDAKIL

SEQ ID NO: 294014 - protein, 8 aa, Influenza virus
VMGMVGVL

SEQ ID NO: 294015 - protein, 8 aa, Influenza virus
MGMVGVLP

SEQ ID NO: 294016 - protein, 8 aa, Influenza virus
GMVGVLPD

SEQ ID NO: 294017 - protein, 8 aa, Influenza virus
GVLPDMTP

SEQ ID NO: 294018 - protein, 8 aa, Influenza virus
RISKMGVD

SEQ ID NO: 294019 - protein, 8 aa, Influenza virus
ISKMGVDE

SEQ ID NO: 294020 - protein, 8 aa, Influenza virus
SKVGVDEY

SEQ ID NO: 294021 - protein, 8 aa, Influenza virus
KVGVDEYS

SEQ ID NO: 294022 - protein, 8 aa, Influenza virus
MGVDEYSN

SEQ ID NO: 294023 - protein, 8 aa, Influenza virus
GVDEYSNA

SEQ ID NO: 294024 - protein, 8 aa, Influenza virus
VDEYSNAE

SEQ ID NO: 294025 - protein, 8 aa, Influenza virus
DEYSNAER

SEQ ID NO: 294026 - protein, 8 aa, Influenza virus
IVSIDRFL

SEQ ID NO: 294027 - protein, 8 aa, Influenza virus
VNIDRFLR

SEQ ID NO: 294028 - protein, 8 aa, Influenza virus
NIDRFLRV

SEQ ID NO: 294029 - protein, 8 aa, Influenza virus
IDRFLRVK

SEQ ID NO: 294030 - protein, 8 aa, Influenza virus
DRFLRVKD

SEQ ID NO: 294031 - protein, 8 aa, Influenza virus
RFLRVKDQ

SEQ ID NO: 294032 - protein, 8 aa, Influenza virus
FLRVRDQQ

SEQ ID NO: 294033 - protein, 8 aa, Influenza virus
LRVRDQQG

SEQ ID NO: 294034 - protein, 8 aa, Influenza virus
RVRDQQGN

SEQ ID NO: 294035 - protein, 8 aa, Influenza virus
DQQGNVLL

SEQ ID NO: 294036 - protein, 8 aa, Influenza virus
QGNVLLSP

SEQ ID NO: 294037 - protein, 8 aa, Influenza virus
GNILLSPE

SEQ ID NO: 294038 - protein, 8 aa, Influenza virus
NILLSPEE

SEQ ID NO: 294039 - protein, 8 aa, Influenza virus
ILLSPEEV

SEQ ID NO: 294040 - protein, 8 aa, Influenza virus
PEEVSEAQ

SEQ ID NO: 294041 - protein, 8 aa, Influenza virus
EEVSEAQG

SEQ ID NO: 294042 - protein, 8 aa, Influenza virus
EVSETQGI

SEQ ID NO: 294043 - protein, 8 aa, Influenza virus
VSETQGIE

SEQ ID NO: 294044 - protein, 8 aa, Influenza virus
QGTERLTI

SEQ ID NO: 294045 - protein, 8 aa, Influenza virus
ERLTITYS

SEQ ID NO: 294046 - protein, 8 aa, Influenza virus
RLTITYSS

SEQ ID NO: 294047 - protein, 8 aa, Influenza virus
LTIIYSSS

SEQ ID NO: 294048 - protein, 8 aa, Influenza virus
TITYSSSL

SEQ ID NO: 294049 - protein, 8 aa, Influenza virus
ITYSSSLM

SEQ ID NO: 294050 - protein, 8 aa, Influenza virus
TYSSSLMW

SEQ ID NO: 294051 - protein, 8 aa, Influenza virus
YSSSLMWE

SEQ ID NO: 294052 - protein, 8 aa, Influenza virus
SSSLMWEI

SEQ ID NO: 294053 - protein, 8 aa, Influenza virus
SSLMWEIN

SEQ ID NO: 294054 - protein, 8 aa, Influenza virus
SLMWEING

SEQ ID NO: 294055 - protein, 8 aa, Influenza virus
LMWEINGP

SEQ ID NO: 294056 - protein, 8 aa, Influenza virus
MWEVNGPE

SEQ ID NO: 294057 - protein, 8 aa, Influenza virus
WEVNGPES

SEQ ID NO: 294058 - protein, 8 aa, Influenza virus
EVNGPESV

SEQ ID NO: 294059 - protein, 8 aa, Influenza virus
VNGPESVL

SEQ ID NO: 294060 - protein, 8 aa, Influenza virus
NGPESVLI

SEQ ID NO: 294061 - protein, 8 aa, Influenza virus
GPESVLIN

SEQ ID NO: 294062 - protein, 8 aa, Influenza virus
PESVLINT

SEQ ID NO: 294063 - protein, 8 aa, Influenza virus
ESVLINTY

SEQ ID NO: 294064 - protein, 8 aa, Influenza virus
SVLINTYQ

SEQ ID NO: 294065 - protein, 8 aa, Influenza virus
VLINTYQW

SEQ ID NO: 294066 - protein, 8 aa, Influenza virus
LINTYQWI

SEQ ID NO: 294067 - protein, 8 aa, Influenza virus
INTYQWII

SEQ ID NO: 294068 - protein, 8 aa, Influenza virus
NTYQWVIR

SEQ ID NO: 294069 - protein, 8 aa, Influenza virus
TYQWVIRN

SEQ ID NO: 294070 - protein, 8 aa, Influenza virus
YQWVIRNW

SEQ ID NO: 294071 - protein, 8 aa, Influenza virus
QWVIRNWE

SEQ ID NO: 294072 - protein, 8 aa, Influenza virus
KIQWSQNP

SEQ ID NO: 294073 - protein, 8 aa, Influenza virus
IQWSQNPA

SEQ ID NO: 294074 - protein, 8 aa, Influenza virus
LYNKIEFE

SEQ ID NO: 294075 - protein, 8 aa, Influenza virus
YNKIEFEP

SEQ ID NO: 294076 - protein, 8 aa, Influenza virus
NKIEFEPF

SEQ ID NO: 294077 - protein, 8 aa, Influenza virus
KIEFEPFQ

SEQ ID NO: 294078 - protein, 8 aa, Influenza virus
IEFEPFQS

SEQ ID NO: 294079 - protein, 8 aa, Influenza virus
FEPFQSLI

SEQ ID NO: 294080 - protein, 8 aa, Influenza virus
EPFQSLIP

SEQ ID NO: 294081 - protein, 8 aa, Influenza virus
PFQSLVPR

SEQ ID NO: 294082 - protein, 8 aa, Influenza virus
FQSLVPRA

SEQ ID NO: 294083 - protein, 8 aa, Influenza virus
RSRYSGFV

SEQ ID NO: 294084 - protein, 8 aa, Influenza virus
SRYSGFVR

SEQ ID NO: 294085 - protein, 8 aa, Influenza virus
RYSGFVRT

SEQ ID NO: 294086 - protein, 8 aa, Influenza virus
FQQMRDIL

SEQ ID NO: 294087 - protein, 8 aa, Influenza virus
QQMRDILG

SEQ ID NO: 294088 - protein, 8 aa, Influenza virus
QMRDILGT

SEQ ID NO: 294089 - protein, 8 aa, Influenza virus
MRDILGTF

SEQ ID NO: 294090 - protein, 8 aa, Influenza virus
RDILGTFD

SEQ ID NO: 294091 - protein, 8 aa, Influenza virus
DILGTFDT

SEQ ID NO: 294092 - protein, 8 aa, Influenza virus
LGTFDTTQ

SEQ ID NO: 294093 - protein, 8 aa, Influenza virus
GTFDTTQI

SEQ ID NO: 294094 - protein, 8 aa, Influenza virus
TFDTTQII

SEQ ID NO: 294095 - protein, 8 aa, Influenza virus
FDTTQIIK

SEQ ID NO: 294096 - protein, 8 aa, Influenza virus
TTQIIKLL

SEQ ID NO: 294097 - protein, 8 aa, Influenza virus
TQIIKLLP

SEQ ID NO: 294098 - protein, 8 aa, Influenza virus
QVIKLLPF

SEQ ID NO: 294099 - protein, 8 aa, Influenza virus
VIKLLPFA

SEQ ID NO: 294100 - protein, 8 aa, Influenza virus
IKLLPFAS

SEQ ID NO: 294101 - protein, 8 aa, Influenza virus
KLLPFASA

SEQ ID NO: 294102 - protein, 8 aa, Influenza virus
LLPFASAP

SEQ ID NO: 294103 - protein, 8 aa, Influenza virus
PFAAAPPK

SEQ ID NO: 294104 - protein, 8 aa, Influenza virus
FAAAPPKQ

SEQ ID NO: 294105 - protein, 8 aa, Influenza virus
AAAPPKQS

SEQ ID NO: 294106 - protein, 8 aa, Influenza virus
AAPPKQSR

SEQ ID NO: 294107 - protein, 8 aa, Influenza virus
APPKQSRM

SEQ ID NO: 294108 - protein, 8 aa, Influenza virus
PPKQSRMQ

SEQ ID NO: 294109 - protein, 8 aa, Influenza virus
PKQSRMQF

SEQ ID NO: 294110 - protein, 8 aa, Influenza virus
KQSRMQFS

SEQ ID NO: 294111 - protein, 8 aa, Influenza virus
QSKMQFSS

SEQ ID NO: 294112 - protein, 8 aa, Influenza virus
SKMQFSSL

SEQ ID NO: 294113 - protein, 8 aa, Influenza virus
KMQFSSLT

SEQ ID NO: 294114 - protein, 8 aa, Influenza virus
QFSSLTVS

SEQ ID NO: 294115 - protein, 8 aa, Influenza virus
FSSLTVSV

SEQ ID NO: 294116 - protein, 8 aa, Influenza virus
SSLTVSVR

SEQ ID NO: 294117 - protein, 8 aa, Influenza virus
SLTVSVRG

SEQ ID NO: 294118 - protein, 8 aa, Influenza virus
LTVNVRGT

SEQ ID NO: 294119 - protein, 8 aa, Influenza virus
TVNVRGTG

SEQ ID NO: 294120 - protein, 8 aa, Influenza virus
VNVRGSGL

SEQ ID NO: 294121 - protein, 8 aa, Influenza virus
NVRGSGLR

SEQ ID NO: 294122 - protein, 8 aa, Influenza virus
VRGSGLRI

SEQ ID NO: 294123 - protein, 8 aa, Influenza virus
RGSGLRIL

SEQ ID NO: 294124 - protein, 8 aa, Influenza virus
GSGLRILV

SEQ ID NO: 294125 - protein, 8 aa, Influenza virus
SGLRILVR

SEQ ID NO: 294126 - protein, 8 aa, Influenza virus
GLRILVRG

SEQ ID NO: 294127 - protein, 8 aa, Influenza virus
LRILVRGN

SEQ ID NO: 294128 - protein, 8 aa, Influenza virus
RILIRGNS

SEQ ID NO: 294129 - protein, 8 aa, Influenza virus
ILIRGNSP

SEQ ID NO: 294130 - protein, 8 aa, Influenza virus
LIRGNSPV

SEQ ID NO: 294131 - protein, 8 aa, Influenza virus
IRGNSPVF

SEQ ID NO: 294132 - protein, 8 aa, Influenza virus
RGNSPIFN

SEQ ID NO: 294133 - protein, 8 aa, Influenza virus
GNSPIFNY

SEQ ID NO: 294134 - protein, 8 aa, Influenza virus
NSPIFNYN

SEQ ID NO: 294135 - protein, 8 aa, Influenza virus
SPVFNYNR

SEQ ID NO: 294136 - protein, 8 aa, Influenza virus
TKRLTILG

SEQ ID NO: 294137 - protein, 8 aa, Influenza virus
KRLTILGK

SEQ ID NO: 294138 - protein, 8 aa, Influenza virus
RLTILGKD

SEQ ID NO: 294139 - protein, 8 aa, Influenza virus
LTILGKDA

SEQ ID NO: 294140 - protein, 8 aa, Influenza virus
TILGKDAG

SEQ ID NO: 294141 - protein, 8 aa, Influenza virus
LGKDAGTL

SEQ ID NO: 294142 - protein, 8 aa, Influenza virus
SGVESAVL

SEQ ID NO: 294143 - protein, 8 aa, Influenza virus
VLRGFLII

SEQ ID NO: 294144 - protein, 8 aa, Influenza virus
LRGFLIIG

SEQ ID NO: 294145 - protein, 8 aa, Influenza virus
RGFLIIGK

SEQ ID NO: 294146 - protein, 8 aa, Influenza virus
GFLIIGKE

SEQ ID NO: 294147 - protein, 8 aa, Influenza virus
FLIIGKED

SEQ ID NO: 294148 - protein, 8 aa, Influenza virus
LIIGKEDR

SEQ ID NO: 294149 - protein, 8 aa, Influenza virus
GKEDRRYG

SEQ ID NO: 294150 - protein, 8 aa, Influenza virus
KEDRRYGP

SEQ ID NO: 294151 - protein, 8 aa, Influenza virus
EDRRYGPA

SEQ ID NO: 294152 - protein, 8 aa, Influenza virus
DRRYGPAL

SEQ ID NO: 294153 - protein, 8 aa, Influenza virus
RRYGPALS

SEQ ID NO: 294154 - protein, 8 aa, Influenza virus
KYGPALSI

SEQ ID NO: 294155 - protein, 8 aa, Influenza virus
YGPALSIS

SEQ ID NO: 294156 - protein, 8 aa, Influenza virus
GPALSISE

SEQ ID NO: 294157 - protein, 8 aa, Influenza virus
PALSISEL

SEQ ID NO: 294158 - protein, 8 aa, Influenza virus
ALSISELS

SEQ ID NO: 294159 - protein, 8 aa, Influenza virus
LSINELSS

SEQ ID NO: 294160 - protein, 8 aa, Influenza virus
LTKGEKAN

SEQ ID NO: 294161 - protein, 8 aa, Influenza virus
TKGEKANV

SEQ ID NO: 294162 - protein, 8 aa, Influenza virus
VLIGQGDI

SEQ ID NO: 294163 - protein, 8 aa, Influenza virus
LIGQGDIV

SEQ ID NO: 294164 - protein, 8 aa, Influenza virus
IGQGDIVL

SEQ ID NO: 294165 - protein, 8 aa, Influenza virus
GQGDIVLV

SEQ ID NO: 294166 - protein, 8 aa, Influenza virus
QGDIVLVM

SEQ ID NO: 294167 - protein, 8 aa, Influenza virus
GDIVLVMK

SEQ ID NO: 294168 - protein, 8 aa, Influenza virus
DIVLVMKR

SEQ ID NO: 294169 - protein, 8 aa, Influenza virus
IVLVMKRK

SEQ ID NO: 294170 - protein, 8 aa, Influenza virus
LVMKRKRN

SEQ ID NO: 294171 - protein, 8 aa, Influenza virus
VMKRKRNS

SEQ ID NO: 294172 - protein, 8 aa, Influenza virus
MKRKRNSS

SEQ ID NO: 294173 - protein, 8 aa, Influenza virus
KRKRNSSI

SEQ ID NO: 294174 - protein, 8 aa, Influenza virus
RKRNSSIL

SEQ ID NO: 294175 - protein, 8 aa, Influenza virus
KRNSSILT

SEQ ID NO: 294176 - protein, 8 aa, Influenza virus
RNSSILTD

SEQ ID NO: 294177 - protein, 8 aa, Influenza virus
NSSILTDS

SEQ ID NO: 294178 - protein, 8 aa, Influenza virus
SQTATKRL

SEQ ID NO: 294179 - protein, 8 aa, Influenza virus
QTATKRLR

SEQ ID NO: 294180 - protein, 8 aa, Influenza virus
TATKRLRM

SEQ ID NO: 294181 - protein, 8 aa, Influenza virus
ATKRLRMA

SEQ ID NO: 294182 - protein, 8 aa, Influenza virus
TKRLRMAI

SEQ ID NO: 294183 - protein, 8 aa, Influenza virus
IRMAINYS

SEQ ID NO: 294184 - protein, 8 aa, Influenza virus
RMAINWGR

SEQ ID NO: 294185 - protein, 8 aa, Influenza virus
MAINWGRI

SEQ ID NO: 294186 - protein, 8 aa, Influenza virus
ATNECRII

SEQ ID NO: 294187 - protein, 8 aa, Influenza virus
MKSRGYKM

SEQ ID NO: 294188 - protein, 8 aa, Influenza virus
IFNFILLT

SEQ ID NO: 294189 - protein, 8 aa, Influenza virus
FIFLLLTH

SEQ ID NO: 294190 - protein, 8 aa, Influenza virus
DNNKNATN

SEQ ID NO: 294191 - protein, 8 aa, Influenza virus
NNNKGAVF

SEQ ID NO: 294192 - protein, 8 aa, Influenza virus
EDIPIENC

SEQ ID NO: 294193 - protein, 8 aa, Influenza virus
RRRKRGLF

SEQ ID NO: 294194 - protein, 8 aa, Influenza virus
RKRGLFGA

SEQ ID NO: 294195 - protein, 8 aa, Influenza virus
IHKQLTHH

SEQ ID NO: 294196 - protein, 8 aa, Influenza virus
RKTRGLFG

SEQ ID NO: 294197 - protein, 8 aa, Influenza virus
KTRGLFGA

SEQ ID NO: 294198 - protein, 8 aa, Influenza virus
KRGLFGAI

SEQ ID NO: 294199 - protein, 8 aa, Influenza virus
RFVNSDCS

SEQ ID NO: 294200 - protein, 8 aa, Influenza virus
FVNSDCSK

SEQ ID NO: 294201 - protein, 8 aa, Influenza virus
FSGSQKQE

SEQ ID NO: 294202 - protein, 8 aa, Influenza virus
SGSQKQEF

SEQ ID NO: 294203 - protein, 8 aa, Influenza virus
AKAGVKMN

SEQ ID NO: 294204 - protein, 8 aa, Influenza virus
KAGVKMNP

SEQ ID NO: 294205 - protein, 8 aa, Influenza virus
AGVKMNPN

SEQ ID NO: 294206 - protein, 8 aa, Influenza virus
EIKMNPNQ

SEQ ID NO: 294207 - protein, 8 aa, Influenza virus
IKMNPNQK

SEQ ID NO: 294208 - protein, 8 aa, Influenza virus
IMRTQESE

SEQ ID NO: 294209 - protein, 8 aa, Influenza virus
MRTQESEC

SEQ ID NO: 294210 - protein, 8 aa, Influenza virus
RTQESSCT

SEQ ID NO: 294211 - protein, 8 aa, Influenza virus
TQESSCTC

SEQ ID NO: 294212 - protein, 8 aa, Influenza virus
REGLILEY

SEQ ID NO: 294213 - protein, 8 aa, Influenza virus
GKRGKWVK

SEQ ID NO: 294214 - protein, 8 aa, Influenza virus
VQHLEECS

SEQ ID NO: 294215 - protein, 8 aa, Influenza virus
HIEECSCY

SEQ ID NO: 294216 - protein, 8 aa, Influenza virus
IEECSCYP

SEQ ID NO: 294217 - protein, 8 aa, Influenza virus
FSGSQKQE

SEQ ID NO: 294218 - protein, 8 aa, Influenza virus
FREQKQEF

SEQ ID NO: 294219 - protein, 8 aa, Influenza virus
EIKMNPNQ

SEQ ID NO: 294220 - protein, 8 aa, Influenza virus
IKMNPNQK

SEQ ID NO: 294221 - protein, 8 aa, Influenza virus
GWAVYSKD

SEQ ID NO: 294222 - protein, 8 aa, Influenza virus
WAVYSKDN

SEQ ID NO: 294223 - protein, 8 aa, Influenza virus
SKDNSVRI

SEQ ID NO: 294224 - protein, 8 aa, Influenza virus
KDNGIRIG

SEQ ID NO: 294225 - protein, 8 aa, Influenza virus
DNGIRIGS

SEQ ID NO: 294226 - protein, 8 aa, Influenza virus
NGIRIGSK

SEQ ID NO: 294227 - protein, 8 aa, Influenza virus
GIRIGSKG

SEQ ID NO: 294228 - protein, 8 aa, Influenza virus
IRIGSRGD

SEQ ID NO: 294229 - protein, 8 aa, Influenza virus
RIGSRGDV

SEQ ID NO: 294230 - protein, 8 aa, Influenza virus
IGSRGDVF

SEQ ID NO: 294231 - protein, 8 aa, Influenza virus
GSRGDVFV

SEQ ID NO: 294232 - protein, 8 aa, Influenza virus
GDIFVMRE

SEQ ID NO: 294233 - protein, 8 aa, Influenza virus
DIFVMREP

SEQ ID NO: 294234 - protein, 8 aa, Influenza virus
IFVMREPF

SEQ ID NO: 294235 - protein, 8 aa, Influenza virus
FVVREPFI

SEQ ID NO: 294236 - protein, 8 aa, Influenza virus
VVREPFIS

SEQ ID NO: 294237 - protein, 8 aa, Influenza virus
VREPFISC

SEQ ID NO: 294238 - protein, 8 aa, Influenza virus
EPFISCSQ

SEQ ID NO: 294239 - protein, 8 aa, Influenza virus
MECRTFFL

SEQ ID NO: 294240 - protein, 8 aa, Influenza virus
DRHSNGTV

SEQ ID NO: 294241 - protein, 8 aa, Influenza virus
DRSPHRTL

SEQ ID NO: 294242 - protein, 8 aa, Influenza virus
RSPHRTLM

SEQ ID NO: 294243 - protein, 8 aa, Influenza virus
SPHRTLMS

SEQ ID NO: 294244 - protein, 8 aa, Influenza virus
PHRTLMSC

SEQ ID NO: 294245 - protein, 8 aa, Influenza virus
HRTLMSCP

SEQ ID NO: 294246 - protein, 8 aa, Influenza virus
RALMSCPL

SEQ ID NO: 294247 - protein, 8 aa, Influenza virus
ALMSCPLG

SEQ ID NO: 294248 - protein, 8 aa, Influenza virus
LMSCPLGE

SEQ ID NO: 294249 - protein, 8 aa, Influenza virus
SCPLGEAP

SEQ ID NO: 294250 - protein, 8 aa, Influenza virus
PLGEAPSP

SEQ ID NO: 294251 - protein, 8 aa, Influenza virus
LGEAPSPY

SEQ ID NO: 294252 - protein, 8 aa, Influenza virus
APSPYNSK

SEQ ID NO: 294253 - protein, 8 aa, Influenza virus
ASACHDGT

SEQ ID NO: 294254 - protein, 8 aa, Influenza virus
GWLTIGIS

SEQ ID NO: 294255 - protein, 8 aa, Influenza virus
IGISGPDS

SEQ ID NO: 294256 - protein, 8 aa, Influenza virus
GISGPDNE

SEQ ID NO: 294257 - protein, 8 aa, Influenza virus
ISGPDNEA

SEQ ID NO: 294258 - protein, 8 aa, Influenza virus
SGPDNEAV

SEQ ID NO: 294259 - protein, 8 aa, Influenza virus
GPDNEAVA

SEQ ID NO: 294260 - protein, 8 aa, Influenza virus
PDNEAVAV

SEQ ID NO: 294261 - protein, 8 aa, Influenza virus
DNEAVAVL

SEQ ID NO: 294262 - protein, 8 aa, Influenza virus
NEAVAVLK

SEQ ID NO: 294263 - protein, 8 aa, Influenza virus
AVAVLKYK

SEQ ID NO: 294264 - protein, 8 aa, Influenza virus
VAVLKYKG

SEQ ID NO: 294265 - protein, 8 aa, Influenza virus
AVVKYNGI

SEQ ID NO: 294266 - protein, 8 aa, Influenza virus
VVKYNGII

SEQ ID NO: 294267 - protein, 8 aa, Influenza virus
VKYNGIIT

SEQ ID NO: 294268 - protein, 8 aa, Influenza virus
ITETIKSW

SEQ ID NO: 294269 - protein, 8 aa, Influenza virus
CINGSCFT

SEQ ID NO: 294270 - protein, 8 aa, Influenza virus
NGSCFTVL

SEQ ID NO: 294271 - protein, 8 aa, Influenza virus
GSCFTVLT

SEQ ID NO: 294272 - protein, 8 aa, Influenza virus
SCFTVLTD

SEQ ID NO: 294273 - protein, 8 aa, Influenza virus
CFTVLTDG

SEQ ID NO: 294274 - protein, 8 aa, Influenza virus
FTVLTDGP

SEQ ID NO: 294275 - protein, 8 aa, Influenza virus
TVLTDGPS

SEQ ID NO: 294276 - protein, 8 aa, Influenza virus
EKGKVVKS

SEQ ID NO: 294277 - protein, 8 aa, Influenza virus
APNFYYEE

SEQ ID NO: 294278 - protein, 8 aa, Influenza virus
PNFYYEEC

SEQ ID NO: 294279 - protein, 8 aa, Influenza virus
NFYYEECS

SEQ ID NO: 294280 - protein, 8 aa, Influenza virus
FYYEECSC

SEQ ID NO: 294281 - protein, 8 aa, Influenza virus
ECSCYPDA

SEQ ID NO: 294282 - protein, 8 aa, Influenza virus
VCVCRDNW

SEQ ID NO: 294283 - protein, 8 aa, Influenza virus
HASNRPWI

SEQ ID NO: 294284 - protein, 8 aa, Influenza virus
ASNRPWIS

SEQ ID NO: 294285 - protein, 8 aa, Influenza virus
NRPWISFD

SEQ ID NO: 294286 - protein, 8 aa, Influenza virus
RPWISFDQ

SEQ ID NO: 294287 - protein, 8 aa, Influenza virus
YKIGYICS

SEQ ID NO: 294288 - protein, 8 aa, Influenza virus
KIGYICSG

SEQ ID NO: 294289 - protein, 8 aa, Influenza virus
MGYICSGI

SEQ ID NO: 294290 - protein, 8 aa, Influenza virus
CSGVFGDS

SEQ ID NO: 294291 - protein, 8 aa, Influenza virus
SGVFGDSP

SEQ ID NO: 294292 - protein, 8 aa, Influenza virus
GVFGDSPR

SEQ ID NO: 294293 - protein, 8 aa, Influenza virus
VFGDNPRS

SEQ ID NO: 294294 - protein, 8 aa, Influenza virus
GVKGFSFR

SEQ ID NO: 294295 - protein, 8 aa, Influenza virus
VKGFSFRY

SEQ ID NO: 294296 - protein, 8 aa, Influenza virus
KGFSFRYG

SEQ ID NO: 294297 - protein, 8 aa, Influenza virus
KYDNGVWI

SEQ ID NO: 294298 - protein, 8 aa, Influenza virus
YGDGVWIG

SEQ ID NO: 294299 - protein, 8 aa, Influenza virus
GDGVWIGR

SEQ ID NO: 294300 - protein, 8 aa, Influenza virus
NGVWMGRT

SEQ ID NO: 294301 - protein, 8 aa, Influenza virus
FEMVWDPN

SEQ ID NO: 294302 - protein, 8 aa, Influenza virus
EMVWDPNG

SEQ ID NO: 294303 - protein, 8 aa, Influenza virus
MVWDPNGW

SEQ ID NO: 294304 - protein, 8 aa, Influenza virus
VWDPNGWT

SEQ ID NO: 294305 - protein, 8 aa, Influenza virus
NDWSGYSG

SEQ ID NO: 294306 - protein, 8 aa, Influenza virus
HPELTGLN

SEQ ID NO: 294307 - protein, 8 aa, Influenza virus
PELTGLNC

SEQ ID NO: 294308 - protein, 8 aa, Influenza virus
NCIRPCFW

SEQ ID NO: 294309 - protein, 8 aa, Influenza virus
CIKPCFWV

SEQ ID NO: 294310 - protein, 8 aa, Influenza virus
IKPCFWVE

SEQ ID NO: 294311 - protein, 8 aa, Influenza virus
WVELIRGQ

SEQ ID NO: 294312 - protein, 8 aa, Influenza virus
VELIRGQP

SEQ ID NO: 294313 - protein, 8 aa, Influenza virus
TVWTSGSS

SEQ ID NO: 294314 - protein, 8 aa, Influenza virus
VWTSGSSI

SEQ ID NO: 294315 - protein, 8 aa, Influenza virus
WTSGSIIS

SEQ ID NO: 294316 - protein, 8 aa, Influenza virus
TSGSIISF

SEQ ID NO: 294317 - protein, 8 aa, Influenza virus
SISFCGVS

SEQ ID NO: 294318 - protein, 8 aa, Influenza virus
SWSWPDGA

SEQ ID NO: 294319 - protein, 8 aa, Influenza virus
WSWPDDAE

SEQ ID NO: 294320 - protein, 8 aa, Influenza virus
SWPDGAEV

SEQ ID NO: 294321 - protein, 8 aa, Influenza virus
WPDGAEVP

SEQ ID NO: 294322 - protein, 8 aa, Influenza virus
PDGAEVPF

SEQ ID NO: 294323 - protein, 8 aa, Influenza virus
GFVPFSKD

SEQ ID NO: 294324 - protein, 8 aa, Influenza virus
FVPFSKDN

SEQ ID NO: 294325 - protein, 8 aa, Influenza virus
VPFSKDNS

SEQ ID NO: 294326 - protein, 8 aa, Influenza virus
PFTKDNSI

SEQ ID NO: 294327 - protein, 8 aa, Influenza virus
FTKDNSIR

SEQ ID NO: 294328 - protein, 8 aa, Influenza virus
TKDNSIRL

SEQ ID NO: 294329 - protein, 8 aa, Influenza virus
KDNSIRLA

SEQ ID NO: 294330 - protein, 8 aa, Influenza virus
DNSIRLAA

SEQ ID NO: 294331 - protein, 8 aa, Influenza virus
NSVRLSAG

SEQ ID NO: 294332 - protein, 8 aa, Influenza virus
SVRLSAGG

SEQ ID NO: 294333 - protein, 8 aa, Influenza virus
IWVTRELY

SEQ ID NO: 294334 - protein, 8 aa, Influenza virus
WVTRELYV

SEQ ID NO: 294335 - protein, 8 aa, Influenza virus
VTRELYVS

SEQ ID NO: 294336 - protein, 8 aa, Influenza virus
REPYVSCS

SEQ ID NO: 294337 - protein, 8 aa, Influenza virus
PHRTLLMS

SEQ ID NO: 294338 - protein, 8 aa, Influenza virus
HRTLLMSE

SEQ ID NO: 294339 - protein, 8 aa, Influenza virus
LLMNELGI

SEQ ID NO: 294340 - protein, 8 aa, Influenza virus
LMNELGIP

SEQ ID NO: 294341 - protein, 8 aa, Influenza virus
MNELGIPF

SEQ ID NO: 294342 - protein, 8 aa, Influenza virus
NELGIPFH

SEQ ID NO: 294343 - protein, 8 aa, Influenza virus
LGIPFHLG

SEQ ID NO: 294344 - protein, 8 aa, Influenza virus
GIPFHLGT

SEQ ID NO: 294345 - protein, 8 aa, Influenza virus
VPFHLATK

SEQ ID NO: 294346 - protein, 8 aa, Influenza virus
PFHLATKQ

SEQ ID NO: 294347 - protein, 8 aa, Influenza virus
FHLATKQV

SEQ ID NO: 294348 - protein, 8 aa, Influenza virus
HLATKQVC

SEQ ID NO: 294349 - protein, 8 aa, Influenza virus
TKQVCMAW

SEQ ID NO: 294350 - protein, 8 aa, Influenza virus
KQVCMAWS

SEQ ID NO: 294351 - protein, 8 aa, Influenza virus
QVCVAWSS

SEQ ID NO: 294352 - protein, 8 aa, Influenza virus
VCVAWSSS

SEQ ID NO: 294353 - protein, 8 aa, Influenza virus
CVAWSSSS

SEQ ID NO: 294354 - protein, 8 aa, Influenza virus
VAWSSSSC

SEQ ID NO: 294355 - protein, 8 aa, Influenza virus
SSSCYDGK

SEQ ID NO: 294356 - protein, 8 aa, Influenza virus
SSCYDGKA

SEQ ID NO: 294357 - protein, 8 aa, Influenza virus
SCYDGKAW

SEQ ID NO: 294358 - protein, 8 aa, Influenza virus
CYDGKAWL

SEQ ID NO: 294359 - protein, 8 aa, Influenza virus
YDGKAWLH

SEQ ID NO: 294360 - protein, 8 aa, Influenza virus
DGKAWLHI

SEQ ID NO: 294361 - protein, 8 aa, Influenza virus
GKAWLHIC

SEQ ID NO: 294362 - protein, 8 aa, Influenza virus
AWLHICVT

SEQ ID NO: 294363 - protein, 8 aa, Influenza virus
WLHICVTG

SEQ ID NO: 294364 - protein, 8 aa, Influenza virus
NATASFVY

SEQ ID NO: 294365 - protein, 8 aa, Influenza virus
EILRTQES

SEQ ID NO: 294366 - protein, 8 aa, Influenza virus
ESECICIN

SEQ ID NO: 294367 - protein, 8 aa, Influenza virus
SECICING

SEQ ID NO: 294368 - protein, 8 aa, Influenza virus
TVVMTDGN

SEQ ID NO: 294369 - protein, 8 aa, Influenza virus
MTDGNASG

SEQ ID NO: 294370 - protein, 8 aa, Influenza virus
GNAQHVEE

SEQ ID NO: 294371 - protein, 8 aa, Influenza virus
NAQHVEEC

SEQ ID NO: 294372 - protein, 8 aa, Influenza virus
ECSCYPRF

SEQ ID NO: 294373 - protein, 8 aa, Influenza virus
IRCVCRDN

SEQ ID NO: 294374 - protein, 8 aa, Influenza virus
CVCRDNWR

SEQ ID NO: 294375 - protein, 8 aa, Influenza virus
VCRDNWRG

SEQ ID NO: 294376 - protein, 8 aa, Influenza virus
WRGSNRPV

SEQ ID NO: 294377 - protein, 8 aa, Influenza virus
YMCSGLVG

SEQ ID NO: 294378 - protein, 8 aa, Influenza virus
MCSGLVGD

SEQ ID NO: 294379 - protein, 8 aa, Influenza virus
LVGDTPRS

SEQ ID NO: 294380 - protein, 8 aa, Influenza virus
QGVKGWAF

SEQ ID NO: 294381 - protein, 8 aa, Influenza virus
VKGWAFDS

SEQ ID NO: 294382 - protein, 8 aa, Influenza virus
DLWMGRTI

SEQ ID NO: 294383 - protein, 8 aa, Influenza virus
RLGYETFK

SEQ ID NO: 294384 - protein, 8 aa, Influenza virus
LGYETFKV

SEQ ID NO: 294385 - protein, 8 aa, Influenza virus
GYETFRVV

SEQ ID NO: 294386 - protein, 8 aa, Influenza virus
GYSGIFSI

SEQ ID NO: 294387 - protein, 8 aa, Influenza virus
YSGIFSIE

SEQ ID NO: 294388 - protein, 8 aa, Influenza virus
YVELVRGR

SEQ ID NO: 294389 - protein, 8 aa, Influenza virus
WWTSNSII

SEQ ID NO: 294390 - protein, 8 aa, Influenza virus
WTSNSIVA

SEQ ID NO: 294391 - protein, 8 aa, Influenza virus
TSNSIVAF

SEQ ID NO: 294392 - protein, 8 aa, Influenza virus
SNSIVAFC

SEQ ID NO: 294393 - protein, 8 aa, Influenza virus
NSIVAFCG

SEQ ID NO: 294394 - protein, 8 aa, Influenza virus
SIVAFCGT

SEQ ID NO: 294395 - protein, 8 aa, Influenza virus
IVAFCGTS

SEQ ID NO: 294396 - protein, 8 aa, Influenza virus
VAFCGTSG

SEQ ID NO: 294397 - protein, 8 aa, Influenza virus
GTSGTYGA

SEQ ID NO: 294398 - protein, 8 aa, Influenza virus
TSGTYGAG

SEQ ID NO: 294399 - protein, 8 aa, Influenza virus
SGTYGAGS

SEQ ID NO: 294400 - protein, 8 aa, Influenza virus
GTYGAGSW

SEQ ID NO: 294401 - protein, 8 aa, Influenza virus
TYGAGSWP

SEQ ID NO: 294402 - protein, 8 aa, Influenza virus
GAGSWPDG

SEQ ID NO: 294403 - protein, 8 aa, Influenza virus
AGSWPDGA

SEQ ID NO: 294404 - protein, 8 aa, Influenza virus
GSWPDGAE

SEQ ID NO: 294405 - protein, 8 aa, Influenza virus
SWPDGADL

SEQ ID NO: 294406 - protein, 8 aa, Influenza virus
SISCLYKL

SEQ ID NO: 294407 - protein, 8 aa, Influenza virus
IKSHAYIS

SEQ ID NO: 294408 - protein, 8 aa, Influenza virus
KSHAYISF

SEQ ID NO: 294409 - protein, 8 aa, Influenza virus
LMGRTRIS

SEQ ID NO: 294410 - protein, 8 aa, Influenza virus
ALFIGVGN

SEQ ID NO: 294411 - protein, 8 aa, Influenza virus
LFIGVGNL

SEQ ID NO: 294412 - protein, 8 aa, Influenza virus
GIGNLIFN

SEQ ID NO: 294413 - protein, 8 aa, Influenza virus
GNLAFNAV

SEQ ID NO: 294414 - protein, 8 aa, Influenza virus
NLAFNAVI

SEQ ID NO: 294415 - protein, 8 aa, Influenza virus
LAFNAVIH

SEQ ID NO: 294416 - protein, 8 aa, Influenza virus
FNAVIHGK

SEQ ID NO: 294417 - protein, 8 aa, Influenza virus
LPLCPFQG

SEQ ID NO: 294418 - protein, 8 aa, Influenza virus
PLCPFQGF

SEQ ID NO: 294419 - protein, 8 aa, Influenza virus
LCPFQGFF

SEQ ID NO: 294420 - protein, 8 aa, Influenza virus
CPFQGFFP

SEQ ID NO: 294421 - protein, 8 aa, Influenza virus
PFQGFFPF

SEQ ID NO: 294422 - protein, 8 aa, Influenza virus
FQGFFPFH

SEQ ID NO: 294423 - protein, 8 aa, Influenza virus
QGFFPFHK

SEQ ID NO: 294424 - protein, 8 aa, Influenza virus
PFHKDNAV

SEQ ID NO: 294425 - protein, 8 aa, Influenza virus
FHKDNAVR

SEQ ID NO: 294426 - protein, 8 aa, Influenza virus
HKDNAVRL

SEQ ID NO: 294427 - protein, 8 aa, Influenza virus
KDNAVRLG

SEQ ID NO: 294428 - protein, 8 aa, Influenza virus
DNAVRLGE

SEQ ID NO: 294429 - protein, 8 aa, Influenza virus
NAVRLGEN

SEQ ID NO: 294430 - protein, 8 aa, Influenza virus
VLVTREPY

SEQ ID NO: 294431 - protein, 8 aa, Influenza virus
LVTREPYI

SEQ ID NO: 294432 - protein, 8 aa, Influenza virus
ITREPYVS

SEQ ID NO: 294433 - protein, 8 aa, Influenza virus
EPYVSCDY

SEQ ID NO: 294434 - protein, 8 aa, Influenza virus
GCWSFALA

SEQ ID NO: 294435 - protein, 8 aa, Influenza virus
SFALAQGV

SEQ ID NO: 294436 - protein, 8 aa, Influenza virus
FALAQGVL

SEQ ID NO: 294437 - protein, 8 aa, Influenza virus
ALAQGTLL

SEQ ID NO: 294438 - protein, 8 aa, Influenza virus
LAQGTLLG

SEQ ID NO: 294439 - protein, 8 aa, Influenza virus
AQGTLLGT

SEQ ID NO: 294440 - protein, 8 aa, Influenza virus
LLGTNHSN

SEQ ID NO: 294441 - protein, 8 aa, Influenza virus
VGTKHSNG

SEQ ID NO: 294442 - protein, 8 aa, Influenza virus
GTRHSNGT

SEQ ID NO: 294443 - protein, 8 aa, Influenza virus
HSNGTVKD

SEQ ID NO: 294444 - protein, 8 aa, Influenza virus
SNGTVKDR

SEQ ID NO: 294445 - protein, 8 aa, Influenza virus
NGTVKDRT

SEQ ID NO: 294446 - protein, 8 aa, Influenza virus
EDRTPYRS

SEQ ID NO: 294447 - protein, 8 aa, Influenza virus
DRAPYRSL

SEQ ID NO: 294448 - protein, 8 aa, Influenza virus
RAPYRSLI

SEQ ID NO: 294449 - protein, 8 aa, Influenza virus
TSYRSLIR

SEQ ID NO: 294450 - protein, 8 aa, Influenza virus
SYRSLIRF

SEQ ID NO: 294451 - protein, 8 aa, Influenza virus
YRSLIKFP

SEQ ID NO: 294452 - protein, 8 aa, Influenza virus
RSLIQFPI

SEQ ID NO: 294453 - protein, 8 aa, Influenza virus
SLIQFPIG

SEQ ID NO: 294454 - protein, 8 aa, Influenza virus
GTAPILGN

SEQ ID NO: 294455 - protein, 8 aa, Influenza virus
TAPILGNY

SEQ ID NO: 294456 - protein, 8 aa, Influenza virus
APILGNYK

SEQ ID NO: 294457 - protein, 8 aa, Influenza virus
PILGNYKE

SEQ ID NO: 294458 - protein, 8 aa, Influenza virus
EMCAAWSS

SEQ ID NO: 294459 - protein, 8 aa, Influenza virus
CAAWSSSS

SEQ ID NO: 294460 - protein, 8 aa, Influenza virus
AAWSSSSC

SEQ ID NO: 294461 - protein, 8 aa, Influenza virus
CFDGREWM

SEQ ID NO: 294462 - protein, 8 aa, Influenza virus
FDGREWMH

SEQ ID NO: 294463 - protein, 8 aa, Influenza virus
DGKEWLHV

SEQ ID NO: 294464 - protein, 8 aa, Influenza virus
GKEWLHVC

SEQ ID NO: 294465 - protein, 8 aa, Influenza virus
NNILRTQE

SEQ ID NO: 294466 - protein, 8 aa, Influenza virus
VTDGPADN

SEQ ID NO: 294467 - protein, 8 aa, Influenza virus
TDGPAASS

SEQ ID NO: 294468 - protein, 8 aa, Influenza virus
DGPAASSA

SEQ ID NO: 294469 - protein, 8 aa, Influenza virus
ADHRIYWV

SEQ ID NO: 294470 - protein, 8 aa, Influenza virus
DHRIYWIK

SEQ ID NO: 294471 - protein, 8 aa, Influenza virus
RIQHLEEC

SEQ ID NO: 294472 - protein, 8 aa, Influenza virus
VQHLEECS

SEQ ID NO: 294473 - protein, 8 aa, Influenza virus
RHLEECSC

SEQ ID NO: 294474 - protein, 8 aa, Influenza virus
DIYCICRD

SEQ ID NO: 294475 - protein, 8 aa, Influenza virus
IYCICRDN

SEQ ID NO: 294476 - protein, 8 aa, Influenza virus
KGSNRPWI

SEQ ID NO: 294477 - protein, 8 aa, Influenza virus
GSNRPWIR

SEQ ID NO: 294478 - protein, 8 aa, Influenza virus
SNRPWVRI

SEQ ID NO: 294479 - protein, 8 aa, Influenza virus
NRPWMRIS

SEQ ID NO: 294480 - protein, 8 aa, Influenza virus
RPWMRISN

SEQ ID NO: 294481 - protein, 8 aa, Influenza virus
PWMRISNE

SEQ ID NO: 294482 - protein, 8 aa, Influenza virus
WMRISNET

SEQ ID NO: 294483 - protein, 8 aa, Influenza virus
MRISNETI

SEQ ID NO: 294484 - protein, 8 aa, Influenza virus
RISNETIL

SEQ ID NO: 294485 - protein, 8 aa, Influenza virus
ISNETILE

SEQ ID NO: 294486 - protein, 8 aa, Influenza virus
NNETIIET

SEQ ID NO: 294487 - protein, 8 aa, Influenza virus
NETIVETG

SEQ ID NO: 294488 - protein, 8 aa, Influenza virus
ETIVETGY

SEQ ID NO: 294489 - protein, 8 aa, Influenza virus
TIIETGYV

SEQ ID NO: 294490 - protein, 8 aa, Influenza virus
IIETGYVC

SEQ ID NO: 294491 - protein, 8 aa, Influenza virus
IETGYVCS

SEQ ID NO: 294492 - protein, 8 aa, Influenza virus
ETGYVCGK

SEQ ID NO: 294493 - protein, 8 aa, Influenza virus
HSDTPRPV

SEQ ID NO: 294494 - protein, 8 aa, Influenza virus
SDTPRPVD

SEQ ID NO: 294495 - protein, 8 aa, Influenza virus
DTPRPVDP

SEQ ID NO: 294496 - protein, 8 aa, Influenza virus
TPRPVDPS

SEQ ID NO: 294497 - protein, 8 aa, Influenza virus
RRGVKGFG

SEQ ID NO: 294498 - protein, 8 aa, Influenza virus
LGVKGFGF

SEQ ID NO: 294499 - protein, 8 aa, Influenza virus
QNDVWLGR

SEQ ID NO: 294500 - protein, 8 aa, Influenza virus
SDVWLGRT

SEQ ID NO: 294501 - protein, 8 aa, Influenza virus
VWLGRTMS

SEQ ID NO: 294502 - protein, 8 aa, Influenza virus
SRSGFEVI

SEQ ID NO: 294503 - protein, 8 aa, Influenza virus
RSGFEIIR

SEQ ID NO: 294504 - protein, 8 aa, Influenza virus
SGFEIIRV

SEQ ID NO: 294505 - protein, 8 aa, Influenza virus
IKVAEGWI

SEQ ID NO: 294506 - protein, 8 aa, Influenza virus
IQTLVSNN

SEQ ID NO: 294507 - protein, 8 aa, Influenza virus
QTLVANND

SEQ ID NO: 294508 - protein, 8 aa, Influenza virus
TLVANNDW

SEQ ID NO: 294509 - protein, 8 aa, Influenza virus
GYSGSFVI

SEQ ID NO: 294510 - protein, 8 aa, Influenza virus
ACFQPCFY

SEQ ID NO: 294511 - protein, 8 aa, Influenza virus
PCFYVELT

SEQ ID NO: 294512 - protein, 8 aa, Influenza virus
CFYVELTR

SEQ ID NO: 294513 - protein, 8 aa, Influenza virus
FYVELTRG

SEQ ID NO: 294514 - protein, 8 aa, Influenza virus
YIELIRGK

SEQ ID NO: 294515 - protein, 8 aa, Influenza virus
ELTRGVPN

SEQ ID NO: 294516 - protein, 8 aa, Influenza virus
VSWTSNSM

SEQ ID NO: 294517 - protein, 8 aa, Influenza virus
SWTSNSMV

SEQ ID NO: 294518 - protein, 8 aa, Influenza virus
WTSNSMVT

SEQ ID NO: 294519 - protein, 8 aa, Influenza virus
ASNSIVTF

SEQ ID NO: 294520 - protein, 8 aa, Influenza virus
MVTFCGLD

SEQ ID NO: 294521 - protein, 8 aa, Influenza virus
LDNEPGSE

SEQ ID NO: 294522 - protein, 8 aa, Influenza virus
NEPGSGNG

SEQ ID NO: 294523 - protein, 8 aa, Influenza virus
SGDWPDGS

SEQ ID NO: 294524 - protein, 8 aa, Influenza virus
WPDGSDIG

SEQ ID NO: 294525 - protein, 8 aa, Influenza virus
PDGSDIGF

SEQ ID NO: 294526 - protein, 8 aa, Influenza virus
DGSDIGFM

SEQ ID NO: 294527 - protein, 8 aa, Influenza virus
GSDIGFMP

SEQ ID NO: 294528 - protein, 8 aa, Influenza virus
SDIGFMPK

SEQ ID NO: 294529 - protein, 8 aa, Influenza virus
MNPNQKIV

SEQ ID NO: 294530 - protein, 8 aa, Influenza virus
NPNQKIVT

SEQ ID NO: 294531 - protein, 8 aa, Influenza virus
PNQMIITI

SEQ ID NO: 294532 - protein, 8 aa, Influenza virus
NQMIITIG

SEQ ID NO: 294533 - protein, 8 aa, Influenza virus
SKIITIGS

SEQ ID NO: 294534 - protein, 8 aa, Influenza virus
IITIGSAS

SEQ ID NO: 294535 - protein, 8 aa, Influenza virus
TIGPLLQI

SEQ ID NO: 294536 - protein, 8 aa, Influenza virus
VGLLLQII

SEQ ID NO: 294537 - protein, 8 aa, Influenza virus
GLLLQVTS

SEQ ID NO: 294538 - protein, 8 aa, Influenza virus
LLLQVTSL

SEQ ID NO: 294539 - protein, 8 aa, Influenza virus
FSHYNQMK

SEQ ID NO: 294540 - protein, 8 aa, Influenza virus
SHYNQMKQ

SEQ ID NO: 294541 - protein, 8 aa, Influenza virus
HYNQVTQP

SEQ ID NO: 294542 - protein, 8 aa, Influenza virus
ETFVNMTN

SEQ ID NO: 294543 - protein, 8 aa, Influenza virus
TFVNITNV

SEQ ID NO: 294544 - protein, 8 aa, Influenza virus
FVNMTNVQ

SEQ ID NO: 294545 - protein, 8 aa, Influenza virus
VNMTNVQN

SEQ ID NO: 294546 - protein, 8 aa, Influenza virus
NVTNVQND

SEQ ID NO: 294547 - protein, 8 aa, Influenza virus
VTNVQNDY

SEQ ID NO: 294548 - protein, 8 aa, Influenza virus
TNVQNDYT

SEQ ID NO: 294549 - protein, 8 aa, Influenza virus
NVQNDYTT

SEQ ID NO: 294550 - protein, 8 aa, Influenza virus
VQNDYTTV

SEQ ID NO: 294551 - protein, 8 aa, Influenza virus
LCPIKGWA

SEQ ID NO: 294552 - protein, 8 aa, Influenza virus
CPIKGWAP

SEQ ID NO: 294553 - protein, 8 aa, Influenza virus
PIKGWAPL

SEQ ID NO: 294554 - protein, 8 aa, Influenza virus
IKGWAPLS

SEQ ID NO: 294555 - protein, 8 aa, Influenza virus
FVIREPFV

SEQ ID NO: 294556 - protein, 8 aa, Influenza virus
EPCISCSI

SEQ ID NO: 294557 - protein, 8 aa, Influenza virus
ISCSIDEC

SEQ ID NO: 294558 - protein, 8 aa, Influenza virus
SCSIDECR

SEQ ID NO: 294559 - protein, 8 aa, Influenza virus
CSIDECRT

SEQ ID NO: 294560 - protein, 8 aa, Influenza virus
SIDECRTF

SEQ ID NO: 294561 - protein, 8 aa, Influenza virus
IDECRTFF

SEQ ID NO: 294562 - protein, 8 aa, Influenza virus
DECRTFFL

SEQ ID NO: 294563 - protein, 8 aa, Influenza virus
RTLMSCPV

SEQ ID NO: 294564 - protein, 8 aa, Influenza virus
TLMSCPVG

SEQ ID NO: 294565 - protein, 8 aa, Influenza virus
LMSCPVGV

SEQ ID NO: 294566 - protein, 8 aa, Influenza virus
MSCPVGVA

SEQ ID NO: 294567 - protein, 8 aa, Influenza virus
SCPVGVAP

SEQ ID NO: 294568 - protein, 8 aa, Influenza virus
CPVGVAPS

SEQ ID NO: 294569 - protein, 8 aa, Influenza virus
PVGVAPSP

SEQ ID NO: 294570 - protein, 8 aa, Influenza virus
VGVAPSPS

SEQ ID NO: 294571 - protein, 8 aa, Influenza virus
DGSGWLTL

SEQ ID NO: 294572 - protein, 8 aa, Influenza virus
GSGWLTLG

SEQ ID NO: 294573 - protein, 8 aa, Influenza virus
SGWLTLGI

SEQ ID NO: 294574 - protein, 8 aa, Influenza virus
LGITGPDT

SEQ ID NO: 294575 - protein, 8 aa, Influenza virus
GITGPDTT

SEQ ID NO: 294576 - protein, 8 aa, Influenza virus
ITGPDTTA

SEQ ID NO: 294577 - protein, 8 aa, Influenza virus
TGPDTTAV

SEQ ID NO: 294578 - protein, 8 aa, Influenza virus
GPDTTAVA

SEQ ID NO: 294579 - protein, 8 aa, Influenza virus
PDTTAVAV

SEQ ID NO: 294580 - protein, 8 aa, Influenza virus
DTTAVAVL

SEQ ID NO: 294581 - protein, 8 aa, Influenza virus
TTAVAVLK

SEQ ID NO: 294582 - protein, 8 aa, Influenza virus
AVLKYNGV

SEQ ID NO: 294583 - protein, 8 aa, Influenza virus
VLKYNGVI

SEQ ID NO: 294584 - protein, 8 aa, Influenza virus
LKYNGVIT

SEQ ID NO: 294585 - protein, 8 aa, Influenza virus
NGIITDTF

SEQ ID NO: 294586 - protein, 8 aa, Influenza virus
GIITDTFK

SEQ ID NO: 294587 - protein, 8 aa, Influenza virus
IITDTFKS

SEQ ID NO: 294588 - protein, 8 aa, Influenza virus
DEFCYTLV

SEQ ID NO: 294589 - protein, 8 aa, Influenza virus
EFCYTLVT

SEQ ID NO: 294590 - protein, 8 aa, Influenza virus
FCYTLVTD

SEQ ID NO: 294591 - protein, 8 aa, Influenza virus
CYTLVTDG

SEQ ID NO: 294592 - protein, 8 aa, Influenza virus
YTLVTDGP

SEQ ID NO: 294593 - protein, 8 aa, Influenza virus
TLVTDGPS

SEQ ID NO: 294594 - protein, 8 aa, Influenza virus
LITDGPSN

SEQ ID NO: 294595 - protein, 8 aa, Influenza virus
ITDGPSNA

SEQ ID NO: 294596 - protein, 8 aa, Influenza virus
DGQAFYKI

SEQ ID NO: 294597 - protein, 8 aa, Influenza virus
KIRKGKIM

SEQ ID NO: 294598 - protein, 8 aa, Influenza virus
DVNATGFH

SEQ ID NO: 294599 - protein, 8 aa, Influenza virus
APGFHFEE

SEQ ID NO: 294600 - protein, 8 aa, Influenza virus
PGFHFEEC

SEQ ID NO: 294601 - protein, 8 aa, Influenza virus
SCYPSGES

SEQ ID NO: 294602 - protein, 8 aa, Influenza virus
DVECVCRD

SEQ ID NO: 294603 - protein, 8 aa, Influenza virus
WIRFNSDP

SEQ ID NO: 294604 - protein, 8 aa, Influenza virus
VRFNSDLD

SEQ ID NO: 294605 - protein, 8 aa, Influenza virus
RFNSDLNY

SEQ ID NO: 294606 - protein, 8 aa, Influenza virus
FNSDLNYQ

SEQ ID NO: 294607 - protein, 8 aa, Influenza virus
NSDLNYQI

SEQ ID NO: 294608 - protein, 8 aa, Influenza virus
SDPDYQIG

SEQ ID NO: 294609 - protein, 8 aa, Influenza virus
DLNYQIGY

SEQ ID NO: 294610 - protein, 8 aa, Influenza virus
LNYQIGYI

SEQ ID NO: 294611 - protein, 8 aa, Influenza virus
IGYICSGV

SEQ ID NO: 294612 - protein, 8 aa, Influenza virus
GYICSGVF

SEQ ID NO: 294613 - protein, 8 aa, Influenza virus
YICSGVFG

SEQ ID NO: 294614 - protein, 8 aa, Influenza virus
ICSGVFGD

SEQ ID NO: 294615 - protein, 8 aa, Influenza virus
IFGDSPRP

SEQ ID NO: 294616 - protein, 8 aa, Influenza virus
FGDNPRPM

SEQ ID NO: 294617 - protein, 8 aa, Influenza virus
GDNPRPMD

SEQ ID NO: 294618 - protein, 8 aa, Influenza virus
DNPRPMDS

SEQ ID NO: 294619 - protein, 8 aa, Influenza virus
PRPVDGIG

SEQ ID NO: 294620 - protein, 8 aa, Influenza virus
RPVDGIGS

SEQ ID NO: 294621 - protein, 8 aa, Influenza virus
PVDGIGSC

SEQ ID NO: 294622 - protein, 8 aa, Influenza virus
SPINNGKG

SEQ ID NO: 294623 - protein, 8 aa, Influenza virus
GWVTADKD

SEQ ID NO: 294624 - protein, 8 aa, Influenza virus
WVTADKDS

SEQ ID NO: 294625 - protein, 8 aa, Influenza virus
VSTDKSSN

SEQ ID NO: 294626 - protein, 8 aa, Influenza virus
STDKSSNG

SEQ ID NO: 294627 - protein, 8 aa, Influenza virus
ADKDSNGV

SEQ ID NO: 294628 - protein, 8 aa, Influenza virus
RGQPKERT

SEQ ID NO: 294629 - protein, 8 aa, Influenza virus
GQPNERTI

SEQ ID NO: 294630 - protein, 8 aa, Influenza virus
QPNERTIW

SEQ ID NO: 294631 - protein, 8 aa, Influenza virus
PNERTIWT

SEQ ID NO: 294632 - protein, 8 aa, Influenza virus
NERTIWTS

SEQ ID NO: 294633 - protein, 8 aa, Influenza virus
ERTIWTSG

SEQ ID NO: 294634 - protein, 8 aa, Influenza virus
RTIWTSGS

SEQ ID NO: 294635 - protein, 8 aa, Influenza virus
AFCGVNFD

SEQ ID NO: 294636 - protein, 8 aa, Influenza virus
FCGVNSNT

SEQ ID NO: 294637 - protein, 8 aa, Influenza virus
GVDSDTTS

SEQ ID NO: 294638 - protein, 8 aa, Influenza virus
VDSDTTSW

SEQ ID NO: 294639 - protein, 8 aa, Influenza virus
SDTTGWPW

SEQ ID NO: 294640 - protein, 8 aa, Influenza virus
DTTGWPWP

SEQ ID NO: 294641 - protein, 8 aa, Influenza virus
TTGWPWPD

SEQ ID NO: 294642 - protein, 8 aa, Influenza virus
TGWPWPDG

SEQ ID NO: 294643 - protein, 8 aa, Influenza virus
GWPWPDGA

SEQ ID NO: 294644 - protein, 8 aa, Influenza virus
KIITIGSA

SEQ ID NO: 294645 - protein, 8 aa, Influenza virus
IITIGSAS

SEQ ID NO: 294646 - protein, 8 aa, Influenza virus
ITIGSASL

SEQ ID NO: 294647 - protein, 8 aa, Influenza virus
TIGSASLG

SEQ ID NO: 294648 - protein, 8 aa, Influenza virus
IGSASLGL

SEQ ID NO: 294649 - protein, 8 aa, Influenza virus
GSASLGLV

SEQ ID NO: 294650 - protein, 8 aa, Influenza virus
NILLHIVS

SEQ ID NO: 294651 - protein, 8 aa, Influenza virus
ILLHIVSI

SEQ ID NO: 294652 - protein, 8 aa, Influenza virus
ITEIYNET

SEQ ID NO: 294653 - protein, 8 aa, Influenza virus
TEVYSETV

SEQ ID NO: 294654 - protein, 8 aa, Influenza virus
EVYSETVR

SEQ ID NO: 294655 - protein, 8 aa, Influenza virus
VYNETVRV

SEQ ID NO: 294656 - protein, 8 aa, Influenza virus
YSETVRVE

SEQ ID NO: 294657 - protein, 8 aa, Influenza virus
NETVRVKT

SEQ ID NO: 294658 - protein, 8 aa, Influenza virus
ETVRLETV

SEQ ID NO: 294659 - protein, 8 aa, Influenza virus
VIIPVNNT

SEQ ID NO: 294660 - protein, 8 aa, Influenza virus
TIPVNNTI

SEQ ID NO: 294661 - protein, 8 aa, Influenza virus
IPINNTIY

SEQ ID NO: 294662 - protein, 8 aa, Influenza virus
EFFNNTEP

SEQ ID NO: 294663 - protein, 8 aa, Influenza virus
NNTEPLCD

SEQ ID NO: 294664 - protein, 8 aa, Influenza virus
NTEPLCDV

SEQ ID NO: 294665 - protein, 8 aa, Influenza virus
TEPLCDVS

SEQ ID NO: 294666 - protein, 8 aa, Influenza virus
EPLCDVSG

SEQ ID NO: 294667 - protein, 8 aa, Influenza virus
PLCDVSGF

SEQ ID NO: 294668 - protein, 8 aa, Influenza virus
LCDVSGFA

SEQ ID NO: 294669 - protein, 8 aa, Influenza virus
CDVSGFAI

SEQ ID NO: 294670 - protein, 8 aa, Influenza virus
SGFAIFSK

SEQ ID NO: 294671 - protein, 8 aa, Influenza virus
GFAIISKD

SEQ ID NO: 294672 - protein, 8 aa, Influenza virus
FAIISKDN

SEQ ID NO: 294673 - protein, 8 aa, Influenza virus
AIFSKDNG

SEQ ID NO: 294674 - protein, 8 aa, Influenza virus
IFSKDNGI

SEQ ID NO: 294675 - protein, 8 aa, Influenza virus
FSKDNGIR

SEQ ID NO: 294676 - protein, 8 aa, Influenza virus
RVGSRGHV

SEQ ID NO: 294677 - protein, 8 aa, Influenza virus
VGSRGHVF

SEQ ID NO: 294678 - protein, 8 aa, Influenza virus
REPFVACS

SEQ ID NO: 294679 - protein, 8 aa, Influenza virus
EPFVACSP

SEQ ID NO: 294680 - protein, 8 aa, Influenza virus
PFVSCGPS

SEQ ID NO: 294681 - protein, 8 aa, Influenza virus
FVSCGPSE

SEQ ID NO: 294682 - protein, 8 aa, Influenza virus
VSCGPSEC

SEQ ID NO: 294683 - protein, 8 aa, Influenza virus
SCGPSECR

SEQ ID NO: 294684 - protein, 8 aa, Influenza virus
CGPAECRT

SEQ ID NO: 294685 - protein, 8 aa, Influenza virus
GPAECRTF

SEQ ID NO: 294686 - protein, 8 aa, Influenza virus
PAECRTFF

SEQ ID NO: 294687 - protein, 8 aa, Influenza virus
AECRTFFL

SEQ ID NO: 294688 - protein, 8 aa, Influenza virus
SVPMGSSP

SEQ ID NO: 294689 - protein, 8 aa, Influenza virus
VPLGSSSN

SEQ ID NO: 294690 - protein, 8 aa, Influenza virus
PMGSSPNA

SEQ ID NO: 294691 - protein, 8 aa, Influenza virus
SSNAYQAK

SEQ ID NO: 294692 - protein, 8 aa, Influenza virus
PNAYQAQF

SEQ ID NO: 294693 - protein, 8 aa, Influenza virus
YQAKFESI

SEQ ID NO: 294694 - protein, 8 aa, Influenza virus
FESVEWSA

SEQ ID NO: 294695 - protein, 8 aa, Influenza virus
ESVEWSAT

SEQ ID NO: 294696 - protein, 8 aa, Influenza virus
SVEWSATA

SEQ ID NO: 294697 - protein, 8 aa, Influenza virus
VEWSATAC

SEQ ID NO: 294698 - protein, 8 aa, Influenza virus
TACHDGKG

SEQ ID NO: 294699 - protein, 8 aa, Influenza virus
ACHDGKGW

SEQ ID NO: 294700 - protein, 8 aa, Influenza virus
CHDGKEWM

SEQ ID NO: 294701 - protein, 8 aa, Influenza virus
WLAVGVSG

SEQ ID NO: 294702 - protein, 8 aa, Influenza virus
GVSGADND

SEQ ID NO: 294703 - protein, 8 aa, Influenza virus
VSGADNDA

SEQ ID NO: 294704 - protein, 8 aa, Influenza virus
SGTDDDAY

SEQ ID NO: 294705 - protein, 8 aa, Influenza virus
GTDDDAYA

SEQ ID NO: 294706 - protein, 8 aa, Influenza virus
TDDDAYAV

SEQ ID NO: 294707 - protein, 8 aa, Influenza virus
AVIHYGGI

SEQ ID NO: 294708 - protein, 8 aa, Influenza virus
VIHYGGIP

SEQ ID NO: 294709 - protein, 8 aa, Influenza virus
IHYGGIPT

SEQ ID NO: 294710 - protein, 8 aa, Influenza virus
HYGGIPTD

SEQ ID NO: 294711 - protein, 8 aa, Influenza virus
YGGIPTDV

SEQ ID NO: 294712 - protein, 8 aa, Influenza virus
GGIPTDVV

SEQ ID NO: 294713 - protein, 8 aa, Influenza virus
GIPTDVVR

SEQ ID NO: 294714 - protein, 8 aa, Influenza virus
IPTDVVRS

SEQ ID NO: 294715 - protein, 8 aa, Influenza virus
TDVIRSWR

SEQ ID NO: 294716 - protein, 8 aa, Influenza virus
DVIRSWRK

SEQ ID NO: 294717 - protein, 8 aa, Influenza virus
VIRSWRKQ

SEQ ID NO: 294718 - protein, 8 aa, Influenza virus
IRSWRKQI

SEQ ID NO: 294719 - protein, 8 aa, Influenza virus
RSWRKKIL

SEQ ID NO: 294720 - protein, 8 aa, Influenza virus
SWRKKILR

SEQ ID NO: 294721 - protein, 8 aa, Influenza virus
WRKKILRT

SEQ ID NO: 294722 - protein, 8 aa, Influenza virus
RKKILRTQ

SEQ ID NO: 294723 - protein, 8 aa, Influenza virus
RQILRTQE

SEQ ID NO: 294724 - protein, 8 aa, Influenza virus
QESSCVCI

SEQ ID NO: 294725 - protein, 8 aa, Influenza virus
ESSCVCVK

SEQ ID NO: 294726 - protein, 8 aa, Influenza virus
SSCVCVKG

SEQ ID NO: 294727 - protein, 8 aa, Influenza virus
MTDGPANK

SEQ ID NO: 294728 - protein, 8 aa, Influenza virus
TDGPANKQ

SEQ ID NO: 294729 - protein, 8 aa, Influenza virus
DGPANKQA

SEQ ID NO: 294730 - protein, 8 aa, Influenza virus
GPANKQAS

SEQ ID NO: 294731 - protein, 8 aa, Influenza virus
PASNQASY

SEQ ID NO: 294732 - protein, 8 aa, Influenza virus
ANKQASYK

SEQ ID NO: 294733 - protein, 8 aa, Influenza virus
SNQASYKI

SEQ ID NO: 294734 - protein, 8 aa, Influenza virus
KQASYKIF

SEQ ID NO: 294735 - protein, 8 aa, Influenza virus
SYKIFKSY

SEQ ID NO: 294736 - protein, 8 aa, Influenza virus
EVLFQGGH

SEQ ID NO: 294737 - protein, 8 aa, Influenza virus
VLFQGGHI

SEQ ID NO: 294738 - protein, 8 aa, Influenza virus
SFQSGHIE

SEQ ID NO: 294739 - protein, 8 aa, Influenza virus
ECSCYPNS

SEQ ID NO: 294740 - protein, 8 aa, Influenza virus
CSCYPNSG

SEQ ID NO: 294741 - protein, 8 aa, Influenza virus
SCYPNSGK

SEQ ID NO: 294742 - protein, 8 aa, Influenza virus
CYPNSGKV

SEQ ID NO: 294743 - protein, 8 aa, Influenza virus
YPNSGKVE

SEQ ID NO: 294744 - protein, 8 aa, Influenza virus
PNSGKVEC

SEQ ID NO: 294745 - protein, 8 aa, Influenza virus
NSGKVECV

SEQ ID NO: 294746 - protein, 8 aa, Influenza virus
SGKVECVC

SEQ ID NO: 294747 - protein, 8 aa, Influenza virus
GIVECVCR

SEQ ID NO: 294748 - protein, 8 aa, Influenza virus
YKVGYLCA

SEQ ID NO: 294749 - protein, 8 aa, Influenza virus
DVGYLCAG

SEQ ID NO: 294750 - protein, 8 aa, Influenza virus
DTPRIQDS

SEQ ID NO: 294751 - protein, 8 aa, Influenza virus
DAVGGSGT

SEQ ID NO: 294752 - protein, 8 aa, Influenza virus
AVGGSGTD

SEQ ID NO: 294753 - protein, 8 aa, Influenza virus
VGGSGTDN

SEQ ID NO: 294754 - protein, 8 aa, Influenza virus
FAFKQGNS

SEQ ID NO: 294755 - protein, 8 aa, Influenza virus
AFKQGNSV

SEQ ID NO: 294756 - protein, 8 aa, Influenza virus
FKQGNSVW

SEQ ID NO: 294757 - protein, 8 aa, Influenza virus
RQGNNVWA

SEQ ID NO: 294758 - protein, 8 aa, Influenza virus
SVWAGRTM

SEQ ID NO: 294759 - protein, 8 aa, Influenza virus
VWAGRTMS

SEQ ID NO: 294760 - protein, 8 aa, Influenza virus
SVSSRSGF

SEQ ID NO: 294761 - protein, 8 aa, Influenza virus
VSSRSGFE

SEQ ID NO: 294762 - protein, 8 aa, Influenza virus
SSRNGFEI

SEQ ID NO: 294763 - protein, 8 aa, Influenza virus
RSGFEVLF

SEQ ID NO: 294764 - protein, 8 aa, Influenza virus
SGFEVLFI

SEQ ID NO: 294765 - protein, 8 aa, Influenza virus
FEILLIEE

SEQ ID NO: 294766 - protein, 8 aa, Influenza virus
EILLIEEG

SEQ ID NO: 294767 - protein, 8 aa, Influenza virus
ILLIEEGW

SEQ ID NO: 294768 - protein, 8 aa, Influenza virus
EVLNNMNW

SEQ ID NO: 294769 - protein, 8 aa, Influenza virus
ILNNKNWS

SEQ ID NO: 294770 - protein, 8 aa, Influenza virus
LNNKHWSG

SEQ ID NO: 294771 - protein, 8 aa, Influenza virus
DNKNWSGY

SEQ ID NO: 294772 - protein, 8 aa, Influenza virus
NKHWSGYS

SEQ ID NO: 294773 - protein, 8 aa, Influenza virus
MNWSGYSG

SEQ ID NO: 294774 - protein, 8 aa, Influenza virus
GYSGAFTV

SEQ ID NO: 294775 - protein, 8 aa, Influenza virus
YSGAFTVP

SEQ ID NO: 294776 - protein, 8 aa, Influenza virus
SGSFTIPT

SEQ ID NO: 294777 - protein, 8 aa, Influenza virus
FTIPTTMT

SEQ ID NO: 294778 - protein, 8 aa, Influenza virus
EMIRGKPK

SEQ ID NO: 294779 - protein, 8 aa, Influenza virus
MIRGKPKE

SEQ ID NO: 294780 - protein, 8 aa, Influenza virus
IRGRPEER

SEQ ID NO: 294781 - protein, 8 aa, Influenza virus
PKERTSIW

SEQ ID NO: 294782 - protein, 8 aa, Influenza virus
KERTSIWT

SEQ ID NO: 294783 - protein, 8 aa, Influenza virus
ERNSIWTS

SEQ ID NO: 294784 - protein, 8 aa, Influenza virus
RNSIWTSS

SEQ ID NO: 294785 - protein, 8 aa, Influenza virus
GVSSEAPG

SEQ ID NO: 294786 - protein, 8 aa, Influenza virus
VSSEAPGW

SEQ ID NO: 294787 - protein, 8 aa, Influenza virus
SSEVPGCT

SEQ ID NO: 294788 - protein, 8 aa, Influenza virus
SEVPGCTM

SEQ ID NO: 294789 - protein, 8 aa, Influenza virus
EVPGWSWG

SEQ ID NO: 294790 - protein, 8 aa, Influenza virus
APGWSWDD

SEQ ID NO: 294791 - protein, 8 aa, Influenza virus
MNPNQKIM

SEQ ID NO: 294792 - protein, 8 aa, Influenza virus
PNQKIMCI

SEQ ID NO: 294793 - protein, 8 aa, Influenza virus
NQKIMCIS

SEQ ID NO: 294794 - protein, 8 aa, Influenza virus
QKIICIST

SEQ ID NO: 294795 - protein, 8 aa, Influenza virus
IMCISATG

SEQ ID NO: 294796 - protein, 8 aa, Influenza virus
CISTTGMT

SEQ ID NO: 294797 - protein, 8 aa, Influenza virus
ISTTGMTL

SEQ ID NO: 294798 - protein, 8 aa, Influenza virus
STTGMTLS

SEQ ID NO: 294799 - protein, 8 aa, Influenza virus
TTGMTLSV

SEQ ID NO: 294800 - protein, 8 aa, Influenza virus
TGMILSVV

SEQ ID NO: 294801 - protein, 8 aa, Influenza virus
GMALSVVS

SEQ ID NO: 294802 - protein, 8 aa, Influenza virus
MALSVVSL

SEQ ID NO: 294803 - protein, 8 aa, Influenza virus
ILSVVSLL

SEQ ID NO: 294804 - protein, 8 aa, Influenza virus
LSVVNLLI

SEQ ID NO: 294805 - protein, 8 aa, Influenza virus
SVVNLLIG

SEQ ID NO: 294806 - protein, 8 aa, Influenza virus
GVANLGLN

SEQ ID NO: 294807 - protein, 8 aa, Influenza virus
VANLGLNI

SEQ ID NO: 294808 - protein, 8 aa, Influenza virus
VNLGLNIG

SEQ ID NO: 294809 - protein, 8 aa, Influenza virus
NLGLNVGL

SEQ ID NO: 294810 - protein, 8 aa, Influenza virus
LGLNVGLH

SEQ ID NO: 294811 - protein, 8 aa, Influenza virus
LTKPLCAV

SEQ ID NO: 294812 - protein, 8 aa, Influenza virus
KPLCAVNS

SEQ ID NO: 294813 - protein, 8 aa, Influenza virus
PLCAVNSW

SEQ ID NO: 294814 - protein, 8 aa, Influenza virus
LCAVNSWH

SEQ ID NO: 294815 - protein, 8 aa, Influenza virus
CAVNSWHI

SEQ ID NO: 294816 - protein, 8 aa, Influenza virus
AVNSWHIL

SEQ ID NO: 294817 - protein, 8 aa, Influenza virus
VNSWHIFS

SEQ ID NO: 294818 - protein, 8 aa, Influenza virus
NSWHIFSK

SEQ ID NO: 294819 - protein, 8 aa, Influenza virus
NAIRIGEE

SEQ ID NO: 294820 - protein, 8 aa, Influenza virus
AIRIGEEA

SEQ ID NO: 294821 - protein, 8 aa, Influenza virus
IRIGEEAH

SEQ ID NO: 294822 - protein, 8 aa, Influenza virus
RIGEEAHI

SEQ ID NO: 294823 - protein, 8 aa, Influenza virus
IGEEAHIL

SEQ ID NO: 294824 - protein, 8 aa, Influenza virus
EAHILVTR

SEQ ID NO: 294825 - protein, 8 aa, Influenza virus
SCRMFALS

SEQ ID NO: 294826 - protein, 8 aa, Influenza virus
QGTTLKGR

SEQ ID NO: 294827 - protein, 8 aa, Influenza virus
GTTLKGRH

SEQ ID NO: 294828 - protein, 8 aa, Influenza virus
TTLKGRHA

SEQ ID NO: 294829 - protein, 8 aa, Influenza virus
TLKGRHAN

SEQ ID NO: 294830 - protein, 8 aa, Influenza virus
LKGRHANG

SEQ ID NO: 294831 - protein, 8 aa, Influenza virus
KGRHANGT

SEQ ID NO: 294832 - protein, 8 aa, Influenza virus
GRHANGTM

SEQ ID NO: 294833 - protein, 8 aa, Influenza virus
RHANGTMH

SEQ ID NO: 294834 - protein, 8 aa, Influenza virus
HANGTIND

SEQ ID NO: 294835 - protein, 8 aa, Influenza virus
ANGTINDR

SEQ ID NO: 294836 - protein, 8 aa, Influenza virus
NGTINDRS

SEQ ID NO: 294837 - protein, 8 aa, Influenza virus
GTMHDRSP

SEQ ID NO: 294838 - protein, 8 aa, Influenza virus
TIHDRSPY

SEQ ID NO: 294839 - protein, 8 aa, Influenza virus
IHDRSPYR

SEQ ID NO: 294840 - protein, 8 aa, Influenza virus
HDRSPYRA

SEQ ID NO: 294841 - protein, 8 aa, Influenza virus
DRSPYRAL

SEQ ID NO: 294842 - protein, 8 aa, Influenza virus
RSQFRALI

SEQ ID NO: 294843 - protein, 8 aa, Influenza virus
SQFRALIS

SEQ ID NO: 294844 - protein, 8 aa, Influenza virus
QFRALISW

SEQ ID NO: 294845 - protein, 8 aa, Influenza virus
YRALISWE

SEQ ID NO: 294846 - protein, 8 aa, Influenza virus
RALISWGM

SEQ ID NO: 294847 - protein, 8 aa, Influenza virus
ALISWGMG

SEQ ID NO: 294848 - protein, 8 aa, Influenza virus
LISWGMGQ

SEQ ID NO: 294849 - protein, 8 aa, Influenza virus
ISWGMGQA

SEQ ID NO: 294850 - protein, 8 aa, Influenza virus
SWEMGLAP

SEQ ID NO: 294851 - protein, 8 aa, Influenza virus
WEMGLAPS

SEQ ID NO: 294852 - protein, 8 aa, Influenza virus
EMGLAPSP

SEQ ID NO: 294853 - protein, 8 aa, Influenza virus
GLAPSPYN

SEQ ID NO: 294854 - protein, 8 aa, Influenza virus
IECIGWSS

SEQ ID NO: 294855 - protein, 8 aa, Influenza virus
STSCHDGV

SEQ ID NO: 294856 - protein, 8 aa, Influenza virus
TSCHDGVS

SEQ ID NO: 294857 - protein, 8 aa, Influenza virus
SCHDGVSR

SEQ ID NO: 294858 - protein, 8 aa, Influenza virus
CHDGVSRM

SEQ ID NO: 294859 - protein, 8 aa, Influenza virus
HDGVSRMS

SEQ ID NO: 294860 - protein, 8 aa, Influenza virus
SRMSVCMS

SEQ ID NO: 294861 - protein, 8 aa, Influenza virus
RMSVCMSG

SEQ ID NO: 294862 - protein, 8 aa, Influenza virus
MSVCMSGP

SEQ ID NO: 294863 - protein, 8 aa, Influenza virus
SVCMSGPN

SEQ ID NO: 294864 - protein, 8 aa, Influenza virus
ICMSGPND

SEQ ID NO: 294865 - protein, 8 aa, Influenza virus
CMSGPNDN

SEQ ID NO: 294866 - protein, 8 aa, Influenza virus
MSGPNDNA

SEQ ID NO: 294867 - protein, 8 aa, Influenza virus
NNNASAVI

SEQ ID NO: 294868 - protein, 8 aa, Influenza virus
NNASAVIW

SEQ ID NO: 294869 - protein, 8 aa, Influenza virus
TEIPSWEG

SEQ ID NO: 294870 - protein, 8 aa, Influenza virus
EIPSWEGN

SEQ ID NO: 294871 - protein, 8 aa, Influenza virus
IPSWEGNI

SEQ ID NO: 294872 - protein, 8 aa, Influenza virus
PSWEGNIL

SEQ ID NO: 294873 - protein, 8 aa, Influenza virus
ECVCHKGV

SEQ ID NO: 294874 - protein, 8 aa, Influenza virus
CVCHKGVC

SEQ ID NO: 294875 - protein, 8 aa, Influenza virus
VCHKGVCP

SEQ ID NO: 294876 - protein, 8 aa, Influenza virus
CHKGVCPV

SEQ ID NO: 294877 - protein, 8 aa, Influenza virus
HKGVCPVV

SEQ ID NO: 294878 - protein, 8 aa, Influenza virus
IMTDGPAN

SEQ ID NO: 294879 - protein, 8 aa, Influenza virus
MTDGPAND

SEQ ID NO: 294880 - protein, 8 aa, Influenza virus
TDGPASNK

SEQ ID NO: 294881 - protein, 8 aa, Influenza virus
DGPASNKA

SEQ ID NO: 294882 - protein, 8 aa, Influenza virus
GTAQHIEE

SEQ ID NO: 294883 - protein, 8 aa, Influenza virus
SAEHIEEC

SEQ ID NO: 294884 - protein, 8 aa, Influenza virus
IKCVCRDN

SEQ ID NO: 294885 - protein, 8 aa, Influenza virus
CICRDNWR

SEQ ID NO: 294886 - protein, 8 aa, Influenza virus
ICRDNWRG

SEQ ID NO: 294887 - protein, 8 aa, Influenza virus
WRGANRPV

SEQ ID NO: 294888 - protein, 8 aa, Influenza virus
RGANRPVI

SEQ ID NO: 294889 - protein, 8 aa, Influenza virus
GANRPIIT

SEQ ID NO: 294890 - protein, 8 aa, Influenza virus
ANRPIITI

SEQ ID NO: 294891 - protein, 8 aa, Influenza virus
NRPVIIID

SEQ ID NO: 294892 - protein, 8 aa, Influenza virus
MTHTSRYL

SEQ ID NO: 294893 - protein, 8 aa, Influenza virus
THTSRYLC

SEQ ID NO: 294894 - protein, 8 aa, Influenza virus
HTSRYLCS

SEQ ID NO: 294895 - protein, 8 aa, Influenza virus
YLCSRILT

SEQ ID NO: 294896 - protein, 8 aa, Influenza virus
LCSRILTD

SEQ ID NO: 294897 - protein, 8 aa, Influenza virus
CSRILTDT

SEQ ID NO: 294898 - protein, 8 aa, Influenza virus
SRILTDTS

SEQ ID NO: 294899 - protein, 8 aa, Influenza virus
RILTDTSR

SEQ ID NO: 294900 - protein, 8 aa, Influenza virus
TLTDTSRP

SEQ ID NO: 294901 - protein, 8 aa, Influenza virus
LTDTSRPT

SEQ ID NO: 294902 - protein, 8 aa, Influenza virus
TDTSRPTD

SEQ ID NO: 294903 - protein, 8 aa, Influenza virus
DTSRPTDP

SEQ ID NO: 294904 - protein, 8 aa, Influenza virus
GGNPDPGV

SEQ ID NO: 294905 - protein, 8 aa, Influenza virus
GTPDPGVK

SEQ ID NO: 294906 - protein, 8 aa, Influenza virus
TPDPGVKG

SEQ ID NO: 294907 - protein, 8 aa, Influenza virus
IKGFAFLD

SEQ ID NO: 294908 - protein, 8 aa, Influenza virus
KGFAFLDE

SEQ ID NO: 294909 - protein, 8 aa, Influenza virus
KNSWLGRT

SEQ ID NO: 294910 - protein, 8 aa, Influenza virus
GRTISKDL

SEQ ID NO: 294911 - protein, 8 aa, Influenza virus
RTISKDLR

SEQ ID NO: 294912 - protein, 8 aa, Influenza virus
TISKDLRS

SEQ ID NO: 294913 - protein, 8 aa, Influenza virus
ISKDLRSG

SEQ ID NO: 294914 - protein, 8 aa, Influenza virus
SKDTRSGY

SEQ ID NO: 294915 - protein, 8 aa, Influenza virus
KDTRSGYE

SEQ ID NO: 294916 - protein, 8 aa, Influenza virus
DSRSGYEI

SEQ ID NO: 294917 - protein, 8 aa, Influenza virus
SRSGYEIL

SEQ ID NO: 294918 - protein, 8 aa, Influenza virus
RSGYEILK

SEQ ID NO: 294919 - protein, 8 aa, Influenza virus
SGYEILKV

SEQ ID NO: 294920 - protein, 8 aa, Influenza virus
GYEILKVP

SEQ ID NO: 294921 - protein, 8 aa, Influenza virus
YEILKVPN

SEQ ID NO: 294922 - protein, 8 aa, Influenza virus
EILKVPNA

SEQ ID NO: 294923 - protein, 8 aa, Influenza virus
ILKVPNAE

SEQ ID NO: 294924 - protein, 8 aa, Influenza virus
LKVPDAET

SEQ ID NO: 294925 - protein, 8 aa, Influenza virus
IINNQNWS

SEQ ID NO: 294926 - protein, 8 aa, Influenza virus
INNQNWSG

SEQ ID NO: 294927 - protein, 8 aa, Influenza virus
NNQKWSGY

SEQ ID NO: 294928 - protein, 8 aa, Influenza virus
DWSGYSGA

SEQ ID NO: 294929 - protein, 8 aa, Influenza virus
SGYSGAFM

SEQ ID NO: 294930 - protein, 8 aa, Influenza virus
GYSGAFMD

SEQ ID NO: 294931 - protein, 8 aa, Influenza virus
YSGAFMDY

SEQ ID NO: 294932 - protein, 8 aa, Influenza virus
SGAFMDYW

SEQ ID NO: 294933 - protein, 8 aa, Influenza virus
ELIRGRPR

SEQ ID NO: 294934 - protein, 8 aa, Influenza virus
LIRGRPRE

SEQ ID NO: 294935 - protein, 8 aa, Influenza virus
IRGMPKES

SEQ ID NO: 294936 - protein, 8 aa, Influenza virus
ESNVLWTS

SEQ ID NO: 294937 - protein, 8 aa, Influenza virus
SNVLWTSN

SEQ ID NO: 294938 - protein, 8 aa, Influenza virus
NVLWTSNS

SEQ ID NO: 294939 - protein, 8 aa, Influenza virus
VLWTSNSM

SEQ ID NO: 294940 - protein, 8 aa, Influenza virus
WWTSNSIV

SEQ ID NO: 294941 - protein, 8 aa, Influenza virus
ALCGSKEQ

SEQ ID NO: 294942 - protein, 8 aa, Influenza virus
LCGSKEQL

SEQ ID NO: 294943 - protein, 8 aa, Influenza virus
CGSKEQLG

SEQ ID NO: 294944 - protein, 8 aa, Influenza virus
GSKEQLGS

SEQ ID NO: 294945 - protein, 8 aa, Influenza virus
SKEQLGSW

SEQ ID NO: 294946 - protein, 8 aa, Influenza virus
KEQLGSWS

SEQ ID NO: 294947 - protein, 8 aa, Influenza virus
KRLGSWSW

SEQ ID NO: 294948 - protein, 8 aa, Influenza virus
GAEIIYFE

SEQ ID NO: 294949 - protein, 8 aa, Influenza virus
MNPKSKLF

SEQ ID NO: 294950 - protein, 8 aa, Influenza virus
NPSQKLFA

SEQ ID NO: 294951 - protein, 8 aa, Influenza virus
PNQKLFTL

SEQ ID NO: 294952 - protein, 8 aa, Influenza virus
NQKLFTLS

SEQ ID NO: 294953 - protein, 8 aa, Influenza virus
QKLFTLSG

SEQ ID NO: 294954 - protein, 8 aa, Influenza virus
KLFTLSGV

SEQ ID NO: 294955 - protein, 8 aa, Influenza virus
LFTLSGVA

SEQ ID NO: 294956 - protein, 8 aa, Influenza virus
FTLSGVAI

SEQ ID NO: 294957 - protein, 8 aa, Influenza virus
INLLIGIS

SEQ ID NO: 294958 - protein, 8 aa, Influenza virus
NLLIGVSN

SEQ ID NO: 294959 - protein, 8 aa, Influenza virus
LLIGISNM

SEQ ID NO: 294960 - protein, 8 aa, Influenza virus
LIGISNMS

SEQ ID NO: 294961 - protein, 8 aa, Influenza virus
IGVSNVGL

SEQ ID NO: 294962 - protein, 8 aa, Influenza virus
GVSNVGLN

SEQ ID NO: 294963 - protein, 8 aa, Influenza virus
SNVVLNVS

SEQ ID NO: 294964 - protein, 8 aa, Influenza virus
NVVLNVSL

SEQ ID NO: 294965 - protein, 8 aa, Influenza virus
VVLNVSLH

SEQ ID NO: 294966 - protein, 8 aa, Influenza virus
VLNVSLHL

SEQ ID NO: 294967 - protein, 8 aa, Influenza virus
LNVSLHLR

SEQ ID NO: 294968 - protein, 8 aa, Influenza virus
ENKYVNNT

SEQ ID NO: 294969 - protein, 8 aa, Influenza virus
NTYINNAT

SEQ ID NO: 294970 - protein, 8 aa, Influenza virus
TYINNTTI

SEQ ID NO: 294971 - protein, 8 aa, Influenza virus
YINNATII

SEQ ID NO: 294972 - protein, 8 aa, Influenza virus
YLVLNKSL

SEQ ID NO: 294973 - protein, 8 aa, Influenza virus
LVLNKSLC

SEQ ID NO: 294974 - protein, 8 aa, Influenza virus
VLNKSLCK

SEQ ID NO: 294975 - protein, 8 aa, Influenza virus
LNKSLCSV

SEQ ID NO: 294976 - protein, 8 aa, Influenza virus
LCSVEGWV

SEQ ID NO: 294977 - protein, 8 aa, Influenza virus
GWVAVAKD

SEQ ID NO: 294978 - protein, 8 aa, Influenza virus
WVAVAKDN

SEQ ID NO: 294979 - protein, 8 aa, Influenza virus
VAVAKDNA

SEQ ID NO: 294980 - protein, 8 aa, Influenza virus
VIAKDNAI

SEQ ID NO: 294981 - protein, 8 aa, Influenza virus
IAKDNAIR

SEQ ID NO: 294982 - protein, 8 aa, Influenza virus
FGEGEQII

SEQ ID NO: 294983 - protein, 8 aa, Influenza virus
GEGEQIIV

SEQ ID NO: 294984 - protein, 8 aa, Influenza virus
EGEQIIVT

SEQ ID NO: 294985 - protein, 8 aa, Influenza virus
GEQIIVTR

SEQ ID NO: 294986 - protein, 8 aa, Influenza virus
PYVSCDPS

SEQ ID NO: 294987 - protein, 8 aa, Influenza virus
SCKMYALH

SEQ ID NO: 294988 - protein, 8 aa, Influenza virus
IRNRHSNG

SEQ ID NO: 294989 - protein, 8 aa, Influenza virus
RNRHSNGT

SEQ ID NO: 294990 - protein, 8 aa, Influenza virus
NKHSNGTT

SEQ ID NO: 294991 - protein, 8 aa, Influenza virus
KHSNGTTH

SEQ ID NO: 294992 - protein, 8 aa, Influenza virus
HSNGTTHD

SEQ ID NO: 294993 - protein, 8 aa, Influenza virus
SNGTTHDR

SEQ ID NO: 294994 - protein, 8 aa, Influenza virus
NGTTHDRT

SEQ ID NO: 294995 - protein, 8 aa, Influenza virus
TIHDRTTF

SEQ ID NO: 294996 - protein, 8 aa, Influenza virus
IHDRTTFR

SEQ ID NO: 294997 - protein, 8 aa, Influenza virus
HDRNAFRG

SEQ ID NO: 294998 - protein, 8 aa, Influenza virus
DRAAFRGL

SEQ ID NO: 294999 - protein, 8 aa, Influenza virus
RNAFRGLI

SEQ ID NO: 295000 - protein, 8 aa, Influenza virus
NAFRGLIS

SEQ ID NO: 295001 - protein, 8 aa, Influenza virus
FRGLMSTP

SEQ ID NO: 295002 - protein, 8 aa, Influenza virus
RGLMSTPL

SEQ ID NO: 295003 - protein, 8 aa, Influenza virus
GLMSTPLG

SEQ ID NO: 295004 - protein, 8 aa, Influenza virus
STPLGNPP

SEQ ID NO: 295005 - protein, 8 aa, Influenza virus
SNSDFICV

SEQ ID NO: 295006 - protein, 8 aa, Influenza virus
NSDFICVG

SEQ ID NO: 295007 - protein, 8 aa, Influenza virus
SDFICVGW

SEQ ID NO: 295008 - protein, 8 aa, Influenza virus
DFICVGWS

SEQ ID NO: 295009 - protein, 8 aa, Influenza virus
FICVGWSS

SEQ ID NO: 295010 - protein, 8 aa, Influenza virus
ICVGWSST

SEQ ID NO: 295011 - protein, 8 aa, Influenza virus
STSCHDGV

SEQ ID NO: 295012 - protein, 8 aa, Influenza virus
CHDGVSRM

SEQ ID NO: 295013 - protein, 8 aa, Influenza virus
HDGIARMT

SEQ ID NO: 295014 - protein, 8 aa, Influenza virus
DGIARMTI

SEQ ID NO: 295015 - protein, 8 aa, Influenza virus
GIARMTIC

SEQ ID NO: 295016 - protein, 8 aa, Influenza virus
NRMTICVQ

SEQ ID NO: 295017 - protein, 8 aa, Influenza virus
MTICVQGD

SEQ ID NO: 295018 - protein, 8 aa, Influenza virus
TICVQGDN

SEQ ID NO: 295019 - protein, 8 aa, Influenza virus
QGDNENAT

SEQ ID NO: 295020 - protein, 8 aa, Influenza virus
GDNENATA

SEQ ID NO: 295021 - protein, 8 aa, Influenza virus
DNENATAT

SEQ ID NO: 295022 - protein, 8 aa, Influenza virus
NENATATV

SEQ ID NO: 295023 - protein, 8 aa, Influenza virus
ENATATVY

SEQ ID NO: 295024 - protein, 8 aa, Influenza virus
TATVYYNK

SEQ ID NO: 295025 - protein, 8 aa, Influenza virus
ATVYYNKR

SEQ ID NO: 295026 - protein, 8 aa, Influenza virus
TVYYNKRL

SEQ ID NO: 295027 - protein, 8 aa, Influenza virus
VYYNKRLT

SEQ ID NO: 295028 - protein, 8 aa, Influenza virus
YYNKRLTT

SEQ ID NO: 295029 - protein, 8 aa, Influenza virus
YNKRLTTT

SEQ ID NO: 295030 - protein, 8 aa, Influenza virus
NKRLTTTI

SEQ ID NO: 295031 - protein, 8 aa, Influenza virus
GRLTTTIK

SEQ ID NO: 295032 - protein, 8 aa, Influenza virus
RLTTTVKT

SEQ ID NO: 295033 - protein, 8 aa, Influenza virus
PTTTIKTW

SEQ ID NO: 295034 - protein, 8 aa, Influenza virus
TTIKTWAK

SEQ ID NO: 295035 - protein, 8 aa, Influenza virus
TIKTWAKN

SEQ ID NO: 295036 - protein, 8 aa, Influenza virus
IKTWAKNI

SEQ ID NO: 295037 - protein, 8 aa, Influenza virus
KTWAKNIL

SEQ ID NO: 295038 - protein, 8 aa, Influenza virus
TWAKNILR

SEQ ID NO: 295039 - protein, 8 aa, Influenza virus
WAKNILRT

SEQ ID NO: 295040 - protein, 8 aa, Influenza virus
AKNILRTQ

SEQ ID NO: 295041 - protein, 8 aa, Influenza virus
KNILRTQE

SEQ ID NO: 295042 - protein, 8 aa, Influenza virus
SECVCHDG

SEQ ID NO: 295043 - protein, 8 aa, Influenza virus
ECVSHNGT

SEQ ID NO: 295044 - protein, 8 aa, Influenza virus
CVSHNGTW

SEQ ID NO: 295045 - protein, 8 aa, Influenza virus
VCHNSTCV

SEQ ID NO: 295046 - protein, 8 aa, Influenza virus
GTCVVVMT

SEQ ID NO: 295047 - protein, 8 aa, Influenza virus
TCVVVMTD

SEQ ID NO: 295048 - protein, 8 aa, Influenza virus
CVVVMTDG

SEQ ID NO: 295049 - protein, 8 aa, Influenza virus
VVMTDGPA

SEQ ID NO: 295050 - protein, 8 aa, Influenza virus
VMTDGPAN

SEQ ID NO: 295051 - protein, 8 aa, Influenza virus
MTDGPASS

SEQ ID NO: 295052 - protein, 8 aa, Influenza virus
TDGPASSQ

SEQ ID NO: 295053 - protein, 8 aa, Influenza virus
DGPASSQA

SEQ ID NO: 295054 - protein, 8 aa, Influenza virus
ANNQAFTK

SEQ ID NO: 295055 - protein, 8 aa, Influenza virus
LRGSARHI

SEQ ID NO: 295056 - protein, 8 aa, Influenza virus
RGSARHIE

SEQ ID NO: 295057 - protein, 8 aa, Influenza virus
SARHVEEC

SEQ ID NO: 295058 - protein, 8 aa, Influenza virus
AMHIEECS

SEQ ID NO: 295059 - protein, 8 aa, Influenza virus
MHIEECSC

SEQ ID NO: 295060 - protein, 8 aa, Influenza virus
ECSCYGHD

SEQ ID NO: 295061 - protein, 8 aa, Influenza virus
KATCVCRD

SEQ ID NO: 295062 - protein, 8 aa, Influenza virus
ITCVCRDN

SEQ ID NO: 295063 - protein, 8 aa, Influenza virus
GANRPVIK

SEQ ID NO: 295064 - protein, 8 aa, Influenza virus
ANRPVIKI

SEQ ID NO: 295065 - protein, 8 aa, Influenza virus
NRPVIKID

SEQ ID NO: 295066 - protein, 8 aa, Influenza virus
RPVIKIDM

SEQ ID NO: 295067 - protein, 8 aa, Influenza virus
HTSRYICT

SEQ ID NO: 295068 - protein, 8 aa, Influenza virus
TSRYICTG

SEQ ID NO: 295069 - protein, 8 aa, Influenza virus
LTDTSRPK

SEQ ID NO: 295070 - protein, 8 aa, Influenza virus
TDTSRPKD

SEQ ID NO: 295071 - protein, 8 aa, Influenza virus
DTSRPKDK

SEQ ID NO: 295072 - protein, 8 aa, Influenza virus
GECFNPIT

SEQ ID NO: 295073 - protein, 8 aa, Influenza virus
ECFNPITG

SEQ ID NO: 295074 - protein, 8 aa, Influenza virus
CFNPITGS

SEQ ID NO: 295075 - protein, 8 aa, Influenza virus
FNPITGSP

SEQ ID NO: 295076 - protein, 8 aa, Influenza virus
PITGSPGV

SEQ ID NO: 295077 - protein, 8 aa, Influenza virus
ITGSPGVP

SEQ ID NO: 295078 - protein, 8 aa, Influenza virus
TGSPGVPG

SEQ ID NO: 295079 - protein, 8 aa, Influenza virus
VPGVKGFG

SEQ ID NO: 295080 - protein, 8 aa, Influenza virus
IKGFGFLN

SEQ ID NO: 295081 - protein, 8 aa, Influenza virus
KGFGFLNE

SEQ ID NO: 295082 - protein, 8 aa, Influenza virus
SNTWLGRT

SEQ ID NO: 295083 - protein, 8 aa, Influenza virus
LGRTISPH

SEQ ID NO: 295084 - protein, 8 aa, Influenza virus
GRTISPKL

SEQ ID NO: 295085 - protein, 8 aa, Influenza virus
RTISPKLR

SEQ ID NO: 295086 - protein, 8 aa, Influenza virus
TISPKLRS

SEQ ID NO: 295087 - protein, 8 aa, Influenza virus
ISPKLRSG

SEQ ID NO: 295088 - protein, 8 aa, Influenza virus
SPRLRSGF

SEQ ID NO: 295089 - protein, 8 aa, Influenza virus
PKLRSGFE

SEQ ID NO: 295090 - protein, 8 aa, Influenza virus
KLRSGFEM

SEQ ID NO: 295091 - protein, 8 aa, Influenza virus
NGFEMLKI

SEQ ID NO: 295092 - protein, 8 aa, Influenza virus
GFEVLKVP

SEQ ID NO: 295093 - protein, 8 aa, Influenza virus
FEMLKIHN

SEQ ID NO: 295094 - protein, 8 aa, Influenza virus
EVLKVPNA

SEQ ID NO: 295095 - protein, 8 aa, Influenza virus
MLKVPNAG

SEQ ID NO: 295096 - protein, 8 aa, Influenza virus
LKIPNAGI

SEQ ID NO: 295097 - protein, 8 aa, Influenza virus
KIPNAGID

SEQ ID NO: 295098 - protein, 8 aa, Influenza virus
IPNAGIDP

SEQ ID NO: 295099 - protein, 8 aa, Influenza virus
ERQEIVSN

SEQ ID NO: 295100 - protein, 8 aa, Influenza virus
NLSGYSGS

SEQ ID NO: 295101 - protein, 8 aa, Influenza virus
SFIDYWDD

SEQ ID NO: 295102 - protein, 8 aa, Influenza virus
SVCYNPCF

SEQ ID NO: 295103 - protein, 8 aa, Influenza virus
ACYNPCFY

SEQ ID NO: 295104 - protein, 8 aa, Influenza virus
PEEVKYVW

SEQ ID NO: 295105 - protein, 8 aa, Influenza virus
EEVKYVWW

SEQ ID NO: 295106 - protein, 8 aa, Influenza virus
EAKYVWWA

SEQ ID NO: 295107 - protein, 8 aa, Influenza virus
AKYVWWAS

SEQ ID NO: 295108 - protein, 8 aa, Influenza virus
KYVWWASN

SEQ ID NO: 295109 - protein, 8 aa, Influenza virus
YVWWASNS

SEQ ID NO: 295110 - protein, 8 aa, Influenza virus
VWWASNSL

SEQ ID NO: 295111 - protein, 8 aa, Influenza virus
EWTSNSLI

SEQ ID NO: 295112 - protein, 8 aa, Influenza virus
WASNSLIA

SEQ ID NO: 295113 - protein, 8 aa, Influenza virus
ASNSLIAL

SEQ ID NO: 295114 - protein, 8 aa, Influenza virus
IALCGSPF

SEQ ID NO: 295115 - protein, 8 aa, Influenza virus
PVGPGSFP

SEQ ID NO: 295116 - protein, 8 aa, Influenza virus
VGSGSLPD

SEQ ID NO: 295117 - protein, 8 aa, Influenza virus
GSGSLPDG

SEQ ID NO: 295118 - protein, 8 aa, Influenza virus
SGSFPNGA

SEQ ID NO: 295119 - protein, 8 aa, Influenza virus
GSFPNGAQ

SEQ ID NO: 295120 - protein, 8 aa, Influenza virus
FFPDGPQI

SEQ ID NO: 295121 - protein, 8 aa, Influenza virus
FPNGAQIQ

SEQ ID NO: 295122 - protein, 8 aa, Influenza virus
PDGAKIQY

SEQ ID NO: 295123 - protein, 8 aa, Influenza virus
DGARIQYF

SEQ ID NO: 295124 - protein, 8 aa, Influenza virus
GARIQYFS

SEQ ID NO: 295125 - protein, 8 aa, Influenza virus
REYNETIR

SEQ ID NO: 295126 - protein, 8 aa, Influenza virus
EYNETIRI

SEQ ID NO: 295127 - protein, 8 aa, Influenza virus
YNETIRIE

SEQ ID NO: 295128 - protein, 8 aa, Influenza virus
RGFAPFSK

SEQ ID NO: 295129 - protein, 8 aa, Influenza virus
IGSKGHVF

SEQ ID NO: 295130 - protein, 8 aa, Influenza virus
GSKGHVFV

SEQ ID NO: 295131 - protein, 8 aa, Influenza virus
SKGHVFVI

SEQ ID NO: 295132 - protein, 8 aa, Influenza virus
KGHVFVIR

SEQ ID NO: 295133 - protein, 8 aa, Influenza virus
DCRTFFLT

SEQ ID NO: 295134 - protein, 8 aa, Influenza virus
ITQGSLLN

SEQ ID NO: 295135 - protein, 8 aa, Influenza virus
HGSLLNDK

SEQ ID NO: 295136 - protein, 8 aa, Influenza virus
SLLNDKHF

SEQ ID NO: 295137 - protein, 8 aa, Influenza virus
LLNDKHSS

SEQ ID NO: 295138 - protein, 8 aa, Influenza virus
LNDKHSSG

SEQ ID NO: 295139 - protein, 8 aa, Influenza virus
DRHSNGTV

SEQ ID NO: 295140 - protein, 8 aa, Influenza virus
RHSNGTVK

SEQ ID NO: 295141 - protein, 8 aa, Influenza virus
HSNGTMKD

SEQ ID NO: 295142 - protein, 8 aa, Influenza virus
SNGTMKDR

SEQ ID NO: 295143 - protein, 8 aa, Influenza virus
NGTMKDRS

SEQ ID NO: 295144 - protein, 8 aa, Influenza virus
GTMKDRSP

SEQ ID NO: 295145 - protein, 8 aa, Influenza virus
TIKDRSPY

SEQ ID NO: 295146 - protein, 8 aa, Influenza virus
IKDRSPYR

SEQ ID NO: 295147 - protein, 8 aa, Influenza virus
FRTLMSVE

SEQ ID NO: 295148 - protein, 8 aa, Influenza virus
RTLMSVEV

SEQ ID NO: 295149 - protein, 8 aa, Influenza virus
TLMSVEVG

SEQ ID NO: 295150 - protein, 8 aa, Influenza virus
LMSVEVGQ

SEQ ID NO: 295151 - protein, 8 aa, Influenza virus
MSVEVGQS

SEQ ID NO: 295152 - protein, 8 aa, Influenza virus
IGLSPNVY

SEQ ID NO: 295153 - protein, 8 aa, Influenza virus
LSPNVYQA

SEQ ID NO: 295154 - protein, 8 aa, Influenza virus
SPNVYQSR

SEQ ID NO: 295155 - protein, 8 aa, Influenza virus
PNVYQSRF

SEQ ID NO: 295156 - protein, 8 aa, Influenza virus
NVYQSRFE

SEQ ID NO: 295157 - protein, 8 aa, Influenza virus
VYQAKFES

SEQ ID NO: 295158 - protein, 8 aa, Influenza virus
YQAKFESV

SEQ ID NO: 295159 - protein, 8 aa, Influenza virus
QAKFESVA

SEQ ID NO: 295160 - protein, 8 aa, Influenza virus
AKFESVAW

SEQ ID NO: 295161 - protein, 8 aa, Influenza virus
KFESVAWS

SEQ ID NO: 295162 - protein, 8 aa, Influenza virus
HDGKKWMA

SEQ ID NO: 295163 - protein, 8 aa, Influenza virus
KWMTIGIT

SEQ ID NO: 295164 - protein, 8 aa, Influenza virus
WMTIGITG

SEQ ID NO: 295165 - protein, 8 aa, Influenza virus
TIGITGPD

SEQ ID NO: 295166 - protein, 8 aa, Influenza virus
SWEGDILR

SEQ ID NO: 295167 - protein, 8 aa, Influenza virus
WEGDILRT

SEQ ID NO: 295168 - protein, 8 aa, Influenza virus
EGDILRTQ

SEQ ID NO: 295169 - protein, 8 aa, Influenza virus
GDIMRTQE

SEQ ID NO: 295170 - protein, 8 aa, Influenza virus
DIMRTQES

SEQ ID NO: 295171 - protein, 8 aa, Influenza virus
ESSCTCIR

SEQ ID NO: 295172 - protein, 8 aa, Influenza virus
SSCTCIRG

SEQ ID NO: 295173 - protein, 8 aa, Influenza virus
GECFWVMT

SEQ ID NO: 295174 - protein, 8 aa, Influenza virus
ECFWVMTD

SEQ ID NO: 295175 - protein, 8 aa, Influenza virus
MTDGPANS

SEQ ID NO: 295176 - protein, 8 aa, Influenza virus
TDGPANSQ

SEQ ID NO: 295177 - protein, 8 aa, Influenza virus
DGPANSQA

SEQ ID NO: 295178 - protein, 8 aa, Influenza virus
FDGGHIEE

SEQ ID NO: 295179 - protein, 8 aa, Influenza virus
DGGHIEEC

SEQ ID NO: 295180 - protein, 8 aa, Influenza virus
CYPNNGKV

SEQ ID NO: 295181 - protein, 8 aa, Influenza virus
YPNNGKVE

SEQ ID NO: 295182 - protein, 8 aa, Influenza virus
PNNGKVEC

SEQ ID NO: 295183 - protein, 8 aa, Influenza virus
NDGKVECV

SEQ ID NO: 295184 - protein, 8 aa, Influenza virus
DGKVECVC

SEQ ID NO: 295185 - protein, 8 aa, Influenza virus
GTNRPVLI

SEQ ID NO: 295186 - protein, 8 aa, Influenza virus
TNRPVLII

SEQ ID NO: 295187 - protein, 8 aa, Influenza virus
NRPVLIIS

SEQ ID NO: 295188 - protein, 8 aa, Influenza virus
LIISPDLS

SEQ ID NO: 295189 - protein, 8 aa, Influenza virus
IISPDLSY

SEQ ID NO: 295190 - protein, 8 aa, Influenza virus
LSYKVGYL

SEQ ID NO: 295191 - protein, 8 aa, Influenza virus
SYKVGYLC

SEQ ID NO: 295192 - protein, 8 aa, Influenza virus
YKVGYLCA

SEQ ID NO: 295193 - protein, 8 aa, Influenza virus
KVGYLCAG

SEQ ID NO: 295194 - protein, 8 aa, Influenza virus
YLCAGIPS

SEQ ID NO: 295195 - protein, 8 aa, Influenza virus
LCAGIPSD

SEQ ID NO: 295196 - protein, 8 aa, Influenza virus
CAGIPSDT

SEQ ID NO: 295197 - protein, 8 aa, Influenza virus
AGIPSDTP

SEQ ID NO: 295198 - protein, 8 aa, Influenza virus
GIPSDTPR

SEQ ID NO: 295199 - protein, 8 aa, Influenza virus
IPSDTPRG

SEQ ID NO: 295200 - protein, 8 aa, Influenza virus
DTPRGEDN

SEQ ID NO: 295201 - protein, 8 aa, Influenza virus
TPRGEDNQ

SEQ ID NO: 295202 - protein, 8 aa, Influenza virus
PRGEDNQF

SEQ ID NO: 295203 - protein, 8 aa, Influenza virus
LGYGVKGF

SEQ ID NO: 295204 - protein, 8 aa, Influenza virus
GFGFRQGD

SEQ ID NO: 295205 - protein, 8 aa, Influenza virus
FGFRQGDD

SEQ ID NO: 295206 - protein, 8 aa, Influenza virus
GFRQGDDV

SEQ ID NO: 295207 - protein, 8 aa, Influenza virus
FRQGDDVW

SEQ ID NO: 295208 - protein, 8 aa, Influenza virus
DVWIGRTI

SEQ ID NO: 295209 - protein, 8 aa, Influenza virus
VWIGRTIS

SEQ ID NO: 295210 - protein, 8 aa, Influenza virus
KTSRSGFE

SEQ ID NO: 295211 - protein, 8 aa, Influenza virus
TSRTGFEI

SEQ ID NO: 295212 - protein, 8 aa, Influenza virus
DNSNWSGY

SEQ ID NO: 295213 - protein, 8 aa, Influenza virus
NSNWSGYS

SEQ ID NO: 295214 - protein, 8 aa, Influenza virus
SNWSGYSG

SEQ ID NO: 295215 - protein, 8 aa, Influenza virus
GSFTLPVG

SEQ ID NO: 295216 - protein, 8 aa, Influenza virus
SFTLPVGL

SEQ ID NO: 295217 - protein, 8 aa, Influenza virus
GCLVPCFW

SEQ ID NO: 295218 - protein, 8 aa, Influenza virus
WVEMIRGR

SEQ ID NO: 295219 - protein, 8 aa, Influenza virus
VEMIRGEP

SEQ ID NO: 295220 - protein, 8 aa, Influenza virus
EMIRGEPE

SEQ ID NO: 295221 - protein, 8 aa, Influenza virus
MIRGEPEE

SEQ ID NO: 295222 - protein, 8 aa, Influenza virus
AIWTSSSS

SEQ ID NO: 295223 - protein, 8 aa, Influenza virus
SIVMCGVN

SEQ ID NO: 295224 - protein, 8 aa, Influenza virus
VVMCGVDH

SEQ ID NO: 295225 - protein, 8 aa, Influenza virus
ANWSWHDG

SEQ ID NO: 295226 - protein, 8 aa, Influenza virus
NWSWHDGA

SEQ ID NO: 295227 - protein, 8 aa, Influenza virus
HDGAILPL

SEQ ID NO: 295228 - protein, 8 aa, Influenza virus
DGAILPFG

SEQ ID NO: 295229 - protein, 8 aa, Influenza virus
GAILPFDF

SEQ ID NO: 295230 - protein, 8 aa, Influenza virus
AILPFGID

SEQ ID NO: 295231 - protein, 8 aa, Influenza virus
NPNQKIQC

SEQ ID NO: 295232 - protein, 8 aa, Influenza virus
PNQKILFA

SEQ ID NO: 295233 - protein, 8 aa, Influenza virus
NQKILFAS

SEQ ID NO: 295234 - protein, 8 aa, Influenza virus
QKILFASA

SEQ ID NO: 295235 - protein, 8 aa, Influenza virus
KILCTSAI

SEQ ID NO: 295236 - protein, 8 aa, Influenza virus
ILCASATA

SEQ ID NO: 295237 - protein, 8 aa, Influenza virus
LCASATAI

SEQ ID NO: 295238 - protein, 8 aa, Influenza virus
GIVNLGLN

SEQ ID NO: 295239 - protein, 8 aa, Influenza virus
ANLGLNVG

SEQ ID NO: 295240 - protein, 8 aa, Influenza virus
LNVGLHLK

SEQ ID NO: 295241 - protein, 8 aa, Influenza virus
NVGLHLKP

SEQ ID NO: 295242 - protein, 8 aa, Influenza virus
SQIIINNY

SEQ ID NO: 295243 - protein, 8 aa, Influenza virus
QTIINNYH

SEQ ID NO: 295244 - protein, 8 aa, Influenza virus
TIINNYHN

SEQ ID NO: 295245 - protein, 8 aa, Influenza virus
IINNYYNK

SEQ ID NO: 295246 - protein, 8 aa, Influenza virus
INNYHNET

SEQ ID NO: 295247 - protein, 8 aa, Influenza virus
NNYHNETN

SEQ ID NO: 295248 - protein, 8 aa, Influenza virus
LTQISNTN

SEQ ID NO: 295249 - protein, 8 aa, Influenza virus
TQVSNTNI

SEQ ID NO: 295250 - protein, 8 aa, Influenza virus
FNNLTRGL

SEQ ID NO: 295251 - protein, 8 aa, Influenza virus
NNLTRGLC

SEQ ID NO: 295252 - protein, 8 aa, Influenza virus
NLTRGLCT

SEQ ID NO: 295253 - protein, 8 aa, Influenza virus
LTRGLCTI

SEQ ID NO: 295254 - protein, 8 aa, Influenza virus
TRGLCTIN

SEQ ID NO: 295255 - protein, 8 aa, Influenza virus
RGLCTINS

SEQ ID NO: 295256 - protein, 8 aa, Influenza virus
RLCTINSW

SEQ ID NO: 295257 - protein, 8 aa, Influenza virus
KINSWHIF

SEQ ID NO: 295258 - protein, 8 aa, Influenza virus
IFGKDNAV

SEQ ID NO: 295259 - protein, 8 aa, Influenza virus
FGKDNAVR

SEQ ID NO: 295260 - protein, 8 aa, Influenza virus
NAIRIGEN

SEQ ID NO: 295261 - protein, 8 aa, Influenza virus
AIRIGENS

SEQ ID NO: 295262 - protein, 8 aa, Influenza virus
RIGEDSDI

SEQ ID NO: 295263 - protein, 8 aa, Influenza virus
IGEDSDIL

SEQ ID NO: 295264 - protein, 8 aa, Influenza virus
GEDSDILV

SEQ ID NO: 295265 - protein, 8 aa, Influenza virus
EDSDILVT

SEQ ID NO: 295266 - protein, 8 aa, Influenza virus
DSDILVTR

SEQ ID NO: 295267 - protein, 8 aa, Influenza virus
PYVSCDPN

SEQ ID NO: 295268 - protein, 8 aa, Influenza virus
YVSCEPDE

SEQ ID NO: 295269 - protein, 8 aa, Influenza virus
VSCEPDEC

SEQ ID NO: 295270 - protein, 8 aa, Influenza virus
SCEPDECR

SEQ ID NO: 295271 - protein, 8 aa, Influenza virus
CEPDECRF

SEQ ID NO: 295272 - protein, 8 aa, Influenza virus
EPDECRFY

SEQ ID NO: 295273 - protein, 8 aa, Influenza virus
PNECRFYA

SEQ ID NO: 295274 - protein, 8 aa, Influenza virus
NECRFYAL

SEQ ID NO: 295275 - protein, 8 aa, Influenza virus
RSQYRALV

SEQ ID NO: 295276 - protein, 8 aa, Influenza virus
SQYRALVS

SEQ ID NO: 295277 - protein, 8 aa, Influenza virus
QYRALVSW

SEQ ID NO: 295278 - protein, 8 aa, Influenza virus
YRALVSWP

SEQ ID NO: 295279 - protein, 8 aa, Influenza virus
RALVSWPL

SEQ ID NO: 295280 - protein, 8 aa, Influenza virus
ALVSWPLS

SEQ ID NO: 295281 - protein, 8 aa, Influenza virus
LISWPQSS

SEQ ID NO: 295282 - protein, 8 aa, Influenza virus
ISWPQSSP

SEQ ID NO: 295283 - protein, 8 aa, Influenza virus
SPPTVYNN

SEQ ID NO: 295284 - protein, 8 aa, Influenza virus
PPTVYNNR

SEQ ID NO: 295285 - protein, 8 aa, Influenza virus
KVECIGWS

SEQ ID NO: 295286 - protein, 8 aa, Influenza virus
TSCHDGKA

SEQ ID NO: 295287 - protein, 8 aa, Influenza virus
SCHDGKAR

SEQ ID NO: 295288 - protein, 8 aa, Influenza virus
CHDGKARM

SEQ ID NO: 295289 - protein, 8 aa, Influenza virus
HDGKARMS

SEQ ID NO: 295290 - protein, 8 aa, Influenza virus
RMSVCISG

SEQ ID NO: 295291 - protein, 8 aa, Influenza virus
MSVCISGP

SEQ ID NO: 295292 - protein, 8 aa, Influenza virus
SVCISGPN

SEQ ID NO: 295293 - protein, 8 aa, Influenza virus
VCISGPNN

SEQ ID NO: 295294 - protein, 8 aa, Influenza virus
NNNASAIV

SEQ ID NO: 295295 - protein, 8 aa, Influenza virus
NNASAIVW

SEQ ID NO: 295296 - protein, 8 aa, Influenza virus
NASAIVWY

SEQ ID NO: 295297 - protein, 8 aa, Influenza virus
ASAIVWYN

SEQ ID NO: 295298 - protein, 8 aa, Influenza virus
GRPITEIN

SEQ ID NO: 295299 - protein, 8 aa, Influenza virus
RPITEINT

SEQ ID NO: 295300 - protein, 8 aa, Influenza virus
PITEINTW

SEQ ID NO: 295301 - protein, 8 aa, Influenza virus
ITEINTWA

SEQ ID NO: 295302 - protein, 8 aa, Influenza virus
ECVCHSGI

SEQ ID NO: 295303 - protein, 8 aa, Influenza virus
CVCHSGIC

SEQ ID NO: 295304 - protein, 8 aa, Influenza virus
VCHSGICP

SEQ ID NO: 295305 - protein, 8 aa, Influenza virus
CHSGICPV

SEQ ID NO: 295306 - protein, 8 aa, Influenza virus
HSGICPVV

SEQ ID NO: 295307 - protein, 8 aa, Influenza virus
SGICPVVF

SEQ ID NO: 295308 - protein, 8 aa, Influenza virus
TGPADTRI

SEQ ID NO: 295309 - protein, 8 aa, Influenza virus
GPADTRIY

SEQ ID NO: 295310 - protein, 8 aa, Influenza virus
PADTRIYY

SEQ ID NO: 295311 - protein, 8 aa, Influenza virus
ADTRIYYF

SEQ ID NO: 295312 - protein, 8 aa, Influenza virus
TRVYYFRE

SEQ ID NO: 295313 - protein, 8 aa, Influenza virus
RVYYFREG

SEQ ID NO: 295314 - protein, 8 aa, Influenza virus
EGRILKWE

SEQ ID NO: 295315 - protein, 8 aa, Influenza virus
GKTLKWEP

SEQ ID NO: 295316 - protein, 8 aa, Influenza virus
KTLKWEPL

SEQ ID NO: 295317 - protein, 8 aa, Influenza virus
KWEPLAGT

SEQ ID NO: 295318 - protein, 8 aa, Influenza virus
WEPLAGTA

SEQ ID NO: 295319 - protein, 8 aa, Influenza virus
LNGTAKHI

SEQ ID NO: 295320 - protein, 8 aa, Influenza virus
NGTAKHIE

SEQ ID NO: 295321 - protein, 8 aa, Influenza virus
EECSCYGK

SEQ ID NO: 295322 - protein, 8 aa, Influenza virus
VTCTCRDN

SEQ ID NO: 295323 - protein, 8 aa, Influenza virus
NRPVIRID

SEQ ID NO: 295324 - protein, 8 aa, Influenza virus
RPVIRIDP

SEQ ID NO: 295325 - protein, 8 aa, Influenza virus
MMTHTSQY

SEQ ID NO: 295326 - protein, 8 aa, Influenza virus
NPRPNDPN

SEQ ID NO: 295327 - protein, 8 aa, Influenza virus
VGKCNEPY

SEQ ID NO: 295328 - protein, 8 aa, Influenza virus
DPYPGSNN

SEQ ID NO: 295329 - protein, 8 aa, Influenza virus
PYPGNNBN

SEQ ID NO: 295330 - protein, 8 aa, Influenza virus
YPGNSNNG

SEQ ID NO: 295331 - protein, 8 aa, Influenza virus
PGSNNNGV

SEQ ID NO: 295332 - protein, 8 aa, Influenza virus
GSNNNGVK

SEQ ID NO: 295333 - protein, 8 aa, Influenza virus
NNNKGVKG

SEQ ID NO: 295334 - protein, 8 aa, Influenza virus
VKGFAYLD

SEQ ID NO: 295335 - protein, 8 aa, Influenza virus
KGFAYLDG

SEQ ID NO: 295336 - protein, 8 aa, Influenza virus
DNTWLGRT

SEQ ID NO: 295337 - protein, 8 aa, Influenza virus
TWLGRTIN

SEQ ID NO: 295338 - protein, 8 aa, Influenza virus
WLGRTTST

SEQ ID NO: 295339 - protein, 8 aa, Influenza virus
VGRTISIA

SEQ ID NO: 295340 - protein, 8 aa, Influenza virus
GRTLNTAS

SEQ ID NO: 295341 - protein, 8 aa, Influenza virus
RTINTASR

SEQ ID NO: 295342 - protein, 8 aa, Influenza virus
TISTASRA

SEQ ID NO: 295343 - protein, 8 aa, Influenza virus
INTASRSG

SEQ ID NO: 295344 - protein, 8 aa, Influenza virus
NTASRSGY

SEQ ID NO: 295345 - protein, 8 aa, Influenza virus
ASRSGYEV

SEQ ID NO: 295346 - protein, 8 aa, Influenza virus
SRYGYEML

SEQ ID NO: 295347 - protein, 8 aa, Influenza virus
RYGYEMLK

SEQ ID NO: 295348 - protein, 8 aa, Influenza virus
AGYEMLKV

SEQ ID NO: 295349 - protein, 8 aa, Influenza virus
VPNALIDD

SEQ ID NO: 295350 - protein, 8 aa, Influenza virus
PNALTDDK

SEQ ID NO: 295351 - protein, 8 aa, Influenza virus
NALTDNRS

SEQ ID NO: 295352 - protein, 8 aa, Influenza virus
ALTDNRSK

SEQ ID NO: 295353 - protein, 8 aa, Influenza virus
LTDNRSKP

SEQ ID NO: 295354 - protein, 8 aa, Influenza virus
KSKPTQGQ

SEQ ID NO: 295355 - protein, 8 aa, Influenza virus
SKPVQGQT

SEQ ID NO: 295356 - protein, 8 aa, Influenza virus
PVQGQTIV

SEQ ID NO: 295357 - protein, 8 aa, Influenza virus
QGQIIVLN

SEQ ID NO: 295358 - protein, 8 aa, Influenza virus
GQTIVSNT

SEQ ID NO: 295359 - protein, 8 aa, Influenza virus
QTIVLTTD

SEQ ID NO: 295360 - protein, 8 aa, Influenza virus
TIVLDTDW

SEQ ID NO: 295361 - protein, 8 aa, Influenza virus
IVLDTDWS

SEQ ID NO: 295362 - protein, 8 aa, Influenza virus
SGYSGSFV

SEQ ID NO: 295363 - protein, 8 aa, Influenza virus
GYSGSFVD

SEQ ID NO: 295364 - protein, 8 aa, Influenza virus
YSGSFVDY

SEQ ID NO: 295365 - protein, 8 aa, Influenza virus
SGSFVDYW

SEQ ID NO: 295366 - protein, 8 aa, Influenza virus
GSFVDYWA

SEQ ID NO: 295367 - protein, 8 aa, Influenza virus
SFIDYWAE

SEQ ID NO: 295368 - protein, 8 aa, Influenza virus
FVDYWAEG

SEQ ID NO: 295369 - protein, 8 aa, Influenza virus
DYWAKGEC

SEQ ID NO: 295370 - protein, 8 aa, Influenza virus
YWAKGECY

SEQ ID NO: 295371 - protein, 8 aa, Influenza virus
WAKGECYR

SEQ ID NO: 295372 - protein, 8 aa, Influenza virus
AKGECYRA

SEQ ID NO: 295373 - protein, 8 aa, Influenza virus
KGECYRAC

SEQ ID NO: 295374 - protein, 8 aa, Influenza virus
EECYRACF

SEQ ID NO: 295375 - protein, 8 aa, Influenza virus
RGRPKEDR

SEQ ID NO: 295376 - protein, 8 aa, Influenza virus
GRPKEDRV

SEQ ID NO: 295377 - protein, 8 aa, Influenza virus
RPKEDRVW

SEQ ID NO: 295378 - protein, 8 aa, Influenza virus
PKEDRVWW

SEQ ID NO: 295379 - protein, 8 aa, Influenza virus
KEDRVWWT

SEQ ID NO: 295380 - protein, 8 aa, Influenza virus
EDRVWWTS

SEQ ID NO: 295381 - protein, 8 aa, Influenza virus
DRVWWTSN

SEQ ID NO: 295382 - protein, 8 aa, Influenza virus
EVWWTSNS

SEQ ID NO: 295383 - protein, 8 aa, Influenza virus
WNWPDGAE

SEQ ID NO: 295384 - protein, 8 aa, Influenza virus
NWPDGAEI

SEQ ID NO: 295385 - protein, 8 aa, Influenza virus
PDGAKIET

SEQ ID NO: 295386 - protein, 8 aa, Influenza virus
DGAKIEYS

SEQ ID NO: 295387 - protein, 8 aa, Influenza virus
GAKIKYFL

SEQ ID NO: 295388 - protein, 8 aa, Influenza virus
GLDRICLG

SEQ ID NO: 295389 - protein, 8 aa, Influenza virus
LDRICLGH

SEQ ID NO: 295390 - protein, 8 aa, Influenza virus
CLGHHAVA

SEQ ID NO: 295391 - protein, 8 aa, Influenza virus
LGHHAVAN

SEQ ID NO: 295392 - protein, 8 aa, Influenza virus
GHHAVANG

SEQ ID NO: 295393 - protein, 8 aa, Influenza virus
HHAVANGT

SEQ ID NO: 295394 - protein, 8 aa, Influenza virus
NGTVVKTL

SEQ ID NO: 295395 - protein, 8 aa, Influenza virus
GTVVKTLT

SEQ ID NO: 295396 - protein, 8 aa, Influenza virus
HEEVTNAT

SEQ ID NO: 295397 - protein, 8 aa, Influenza virus
KDLDNCHP

SEQ ID NO: 295398 - protein, 8 aa, Influenza virus
DLGNCHPV

SEQ ID NO: 295399 - protein, 8 aa, Influenza virus
LGNCHPVG

SEQ ID NO: 295400 - protein, 8 aa, Influenza virus
GNCHPVGM

SEQ ID NO: 295401 - protein, 8 aa, Influenza virus
HLTGKWDT

SEQ ID NO: 295402 - protein, 8 aa, Influenza virus
GTWNTLIE

SEQ ID NO: 295403 - protein, 8 aa, Influenza virus
TWNTLIER

SEQ ID NO: 295404 - protein, 8 aa, Influenza virus
WDTLIERG

SEQ ID NO: 295405 - protein, 8 aa, Influenza virus
AHCYPGAT

SEQ ID NO: 295406 - protein, 8 aa, Influenza virus
VNEGALRQ

SEQ ID NO: 295407 - protein, 8 aa, Influenza virus
KIMESGEI

SEQ ID NO: 295408 - protein, 8 aa, Influenza virus
MESGGINK

SEQ ID NO: 295409 - protein, 8 aa, Influenza virus
SFYGELKW

SEQ ID NO: 295410 - protein, 8 aa, Influenza virus
FYAELRWL

SEQ ID NO: 295411 - protein, 8 aa, Influenza virus
ELKWLISK

SEQ ID NO: 295412 - protein, 8 aa, Influenza virus
KGQNFPRT

SEQ ID NO: 295413 - protein, 8 aa, Influenza virus
GQNFPRTT

SEQ ID NO: 295414 - protein, 8 aa, Influenza virus
QSFPQTTN

SEQ ID NO: 295415 - protein, 8 aa, Influenza virus
SFPQTTNT

SEQ ID NO: 295416 - protein, 8 aa, Influenza virus
FPRTTNTY

SEQ ID NO: 295417 - protein, 8 aa, Influenza virus
PRTTNTYR

SEQ ID NO: 295418 - protein, 8 aa, Influenza virus
RTTNTYRN

SEQ ID NO: 295419 - protein, 8 aa, Influenza virus
NTYRNTDP

SEQ ID NO: 295420 - protein, 8 aa, Influenza virus
MWGIHHPS

SEQ ID NO: 295421 - protein, 8 aa, Influenza virus
GIHHPSNT

SEQ ID NO: 295422 - protein, 8 aa, Influenza virus
EKNELYGT

SEQ ID NO: 295423 - protein, 8 aa, Influenza virus
LYGAQSLS

SEQ ID NO: 295424 - protein, 8 aa, Influenza virus
YGAQSLSI

SEQ ID NO: 295425 - protein, 8 aa, Influenza virus
GTQPLSIS

SEQ ID NO: 295426 - protein, 8 aa, Influenza virus
TQPLSISV

SEQ ID NO: 295427 - protein, 8 aa, Influenza virus
QSLSISVE

SEQ ID NO: 295428 - protein, 8 aa, Influenza virus
SLSISVES

SEQ ID NO: 295429 - protein, 8 aa, Influenza virus
LSISVESS

SEQ ID NO: 295430 - protein, 8 aa, Influenza virus
SISIGSST

SEQ ID NO: 295431 - protein, 8 aa, Influenza virus
ISIGSSTY

SEQ ID NO: 295432 - protein, 8 aa, Influenza virus
SIGSSTYQ

SEQ ID NO: 295433 - protein, 8 aa, Influenza virus
VESSTYQN

SEQ ID NO: 295434 - protein, 8 aa, Influenza virus
ESSTYQNN

SEQ ID NO: 295435 - protein, 8 aa, Influenza virus
SSTYQSNF

SEQ ID NO: 295436 - protein, 8 aa, Influenza virus
STYHNSFV

SEQ ID NO: 295437 - protein, 8 aa, Influenza virus
TYHNSFVP

SEQ ID NO: 295438 - protein, 8 aa, Influenza virus
QNNFVPVI

SEQ ID NO: 295439 - protein, 8 aa, Influenza virus
NNFVPVIG

SEQ ID NO: 295440 - protein, 8 aa, Influenza virus
NFVPVIGA

SEQ ID NO: 295441 - protein, 8 aa, Influenza virus
FVPVVRAR

SEQ ID NO: 295442 - protein, 8 aa, Influenza virus
VPVMGARP

SEQ ID NO: 295443 - protein, 8 aa, Influenza virus
PVVRARPQ

SEQ ID NO: 295444 - protein, 8 aa, Influenza virus
VMGARPQV

SEQ ID NO: 295445 - protein, 8 aa, Influenza virus
VRARPQVN

SEQ ID NO: 295446 - protein, 8 aa, Influenza virus
GARPKVNG

SEQ ID NO: 295447 - protein, 8 aa, Influenza virus
RPLVNGQR

SEQ ID NO: 295448 - protein, 8 aa, Influenza virus
PKVNGQSG

SEQ ID NO: 295449 - protein, 8 aa, Influenza virus
QVNGQRGR

SEQ ID NO: 295450 - protein, 8 aa, Influenza virus
NGQSGRIN

SEQ ID NO: 295451 - protein, 8 aa, Influenza virus
GQSGRINF

SEQ ID NO: 295452 - protein, 8 aa, Influenza virus
QSGRIVFH

SEQ ID NO: 295453 - protein, 8 aa, Influenza virus
RGRIDFHW

SEQ ID NO: 295454 - protein, 8 aa, Influenza virus
GRIDFHWA

SEQ ID NO: 295455 - protein, 8 aa, Influenza virus
QPGDSITF

SEQ ID NO: 295456 - protein, 8 aa, Influenza virus
PGHNITFS

SEQ ID NO: 295457 - protein, 8 aa, Influenza virus
GDNIIFSH

SEQ ID NO: 295458 - protein, 8 aa, Influenza virus
DNIIFSHN

SEQ ID NO: 295459 - protein, 8 aa, Influenza virus
NITFSDNG

SEQ ID NO: 295460 - protein, 8 aa, Influenza virus
TFLHNGGL

SEQ ID NO: 295461 - protein, 8 aa, Influenza virus
FSDNGGLI

SEQ ID NO: 295462 - protein, 8 aa, Influenza virus
SDNGGLIA

SEQ ID NO: 295463 - protein, 8 aa, Influenza virus
NGGLIAPN

SEQ ID NO: 295464 - protein, 8 aa, Influenza virus
GGLIAPNR

SEQ ID NO: 295465 - protein, 8 aa, Influenza virus
GLIAPNRV

SEQ ID NO: 295466 - protein, 8 aa, Influenza virus
IAPDRVSK

SEQ ID NO: 295467 - protein, 8 aa, Influenza virus
APDRVSKL

SEQ ID NO: 295468 - protein, 8 aa, Influenza virus
GKGLGIQS

SEQ ID NO: 295469 - protein, 8 aa, Influenza virus
GCESKCFW

SEQ ID NO: 295470 - protein, 8 aa, Influenza virus
KSKCFWRG

SEQ ID NO: 295471 - protein, 8 aa, Influenza virus
KCFWKGGT

SEQ ID NO: 295472 - protein, 8 aa, Influenza virus
CFWREGSI

SEQ ID NO: 295473 - protein, 8 aa, Influenza virus
FWKGGSIK

SEQ ID NO: 295474 - protein, 8 aa, Influenza virus
WKGGSIKT

SEQ ID NO: 295475 - protein, 8 aa, Influenza virus
GGSIKTKL

SEQ ID NO: 295476 - protein, 8 aa, Influenza virus
GSIKTKLP

SEQ ID NO: 295477 - protein, 8 aa, Influenza virus
SIKTKLPF

SEQ ID NO: 295478 - protein, 8 aa, Influenza virus
IKTKLPFQ

SEQ ID NO: 295479 - protein, 8 aa, Influenza virus
KTKLPFQN

SEQ ID NO: 295480 - protein, 8 aa, Influenza virus
TELPFQNL

SEQ ID NO: 295481 - protein, 8 aa, Influenza virus
ELPFQNLS

SEQ ID NO: 295482 - protein, 8 aa, Influenza virus
GQCPKYVK

SEQ ID NO: 295483 - protein, 8 aa, Influenza virus
QCPKYVNQ

SEQ ID NO: 295484 - protein, 8 aa, Influenza virus
KSLMLATG

SEQ ID NO: 295485 - protein, 8 aa, Influenza virus
GMRNVPET

SEQ ID NO: 295486 - protein, 8 aa, Influenza virus
GRGLFGAK

SEQ ID NO: 295487 - protein, 8 aa, Influenza virus
NDQGTGQA

SEQ ID NO: 295488 - protein, 8 aa, Influenza virus
AQGTGLAA

SEQ ID NO: 295489 - protein, 8 aa, Influenza virus
TGQAADYE

SEQ ID NO: 295490 - protein, 8 aa, Influenza virus
ADYESTQA

SEQ ID NO: 295491 - protein, 8 aa, Influenza virus
DYESTQAA

SEQ ID NO: 295492 - protein, 8 aa, Influenza virus
YKSTQTAI

SEQ ID NO: 295493 - protein, 8 aa, Influenza virus
AIVQITGK

SEQ ID NO: 295494 - protein, 8 aa, Influenza virus
IDQVTGKL

SEQ ID NO: 295495 - protein, 8 aa, Influenza virus
VQITGKLN

SEQ ID NO: 295496 - protein, 8 aa, Influenza virus
IESEFSET

SEQ ID NO: 295497 - protein, 8 aa, Influenza virus
ESEFSETE

SEQ ID NO: 295498 - protein, 8 aa, Influenza virus
SEFSETEH

SEQ ID NO: 295499 - protein, 8 aa, Influenza virus
EFSETEHQ

SEQ ID NO: 295500 - protein, 8 aa, Influenza virus
FSETEHQI

SEQ ID NO: 295501 - protein, 8 aa, Influenza virus
SETEHQIG

SEQ ID NO: 295502 - protein, 8 aa, Influenza virus
EIEHQISN

SEQ ID NO: 295503 - protein, 8 aa, Influenza virus
IEYQIGNV

SEQ ID NO: 295504 - protein, 8 aa, Influenza virus
TIDMGDSE

SEQ ID NO: 295505 - protein, 8 aa, Influenza virus
IDLADSEM

SEQ ID NO: 295506 - protein, 8 aa, Influenza virus
DMGDSEML

SEQ ID NO: 295507 - protein, 8 aa, Influenza virus
MADSTMLN

SEQ ID NO: 295508 - protein, 8 aa, Influenza virus
GCFEIYHT

SEQ ID NO: 295509 - protein, 8 aa, Influenza virus
CFEIYHTC

SEQ ID NO: 295510 - protein, 8 aa, Influenza virus
FEIYHTCD

SEQ ID NO: 295511 - protein, 8 aa, Influenza virus
NCMESIRD

SEQ ID NO: 295512 - protein, 8 aa, Influenza virus
RIRNNTYD

SEQ ID NO: 295513 - protein, 8 aa, Influenza virus
RNNTYDHA

SEQ ID NO: 295514 - protein, 8 aa, Influenza virus
NNTYDHAQ

SEQ ID NO: 295515 - protein, 8 aa, Influenza virus
NTYDHAQY

SEQ ID NO: 295516 - protein, 8 aa, Influenza virus
TYDHAQYR

SEQ ID NO: 295517 - protein, 8 aa, Influenza virus
YDHAQYRE

SEQ ID NO: 295518 - protein, 8 aa, Influenza virus
DHAQYREE

SEQ ID NO: 295519 - protein, 8 aa, Influenza virus
HAQYREEA

SEQ ID NO: 295520 - protein, 8 aa, Influenza virus
AQYREEAL

SEQ ID NO: 295521 - protein, 8 aa, Influenza virus
QYREESLL

SEQ ID NO: 295522 - protein, 8 aa, Influenza virus
EEAPLNRL

SEQ ID NO: 295523 - protein, 8 aa, Influenza virus
ESLLNRLS

SEQ ID NO: 295524 - protein, 8 aa, Influenza virus
SLLNRLSI

SEQ ID NO: 295525 - protein, 8 aa, Influenza virus
PLNRLNIN

SEQ ID NO: 295526 - protein, 8 aa, Influenza virus
LNRLSINP

SEQ ID NO: 295527 - protein, 8 aa, Influenza virus
NRLSINPV

SEQ ID NO: 295528 - protein, 8 aa, Influenza virus
INPVTLSS

SEQ ID NO: 295529 - protein, 8 aa, Influenza virus
NPVTLSSG

SEQ ID NO: 295530 - protein, 8 aa, Influenza virus
PVTLSSGY

SEQ ID NO: 295531 - protein, 8 aa, Influenza virus
VKLSSSYK

SEQ ID NO: 295532 - protein, 8 aa, Influenza virus
KLSSSYKD

SEQ ID NO: 295533 - protein, 8 aa, Influenza virus
LFSGYKDI

SEQ ID NO: 295534 - protein, 8 aa, Influenza virus
SSSYKDII

SEQ ID NO: 295535 - protein, 8 aa, Influenza virus
SFGASSFV

SEQ ID NO: 295536 - protein, 8 aa, Influenza virus
FGASSFVL

SEQ ID NO: 295537 - protein, 8 aa, Influenza virus
GASSFVLL

SEQ ID NO: 295538 - protein, 8 aa, Influenza virus
ASSFVLLA

SEQ ID NO: 295539 - protein, 8 aa, Influenza virus
SCFVLLAA

SEQ ID NO: 295540 - protein, 8 aa, Influenza virus
FLCLKNGN

SEQ ID NO: 295541 - protein, 8 aa, Influenza virus
FCLKNGNT

SEQ ID NO: 295542 - protein, 8 aa, Influenza virus
CLKNGNMQ

SEQ ID NO: 295543 - protein, 8 aa, Influenza virus
GLDRICLG

SEQ ID NO: 295544 - protein, 8 aa, Influenza virus
LDRICLGH

SEQ ID NO: 295545 - protein, 8 aa, Influenza virus
CLGHHAVA

SEQ ID NO: 295546 - protein, 8 aa, Influenza virus
LGHHAVAN

SEQ ID NO: 295547 - protein, 8 aa, Influenza virus
GHHAVANG

SEQ ID NO: 295548 - protein, 8 aa, Influenza virus
HHAVANGT

SEQ ID NO: 295549 - protein, 8 aa, Influenza virus
HAVANGTI

SEQ ID NO: 295550 - protein, 8 aa, Influenza virus
ANGTIVKT

SEQ ID NO: 295551 - protein, 8 aa, Influenza virus
TIIKTLTN

SEQ ID NO: 295552 - protein, 8 aa, Influenza virus
VVKTLTNE

SEQ ID NO: 295553 - protein, 8 aa, Influenza virus
VKTLTSEK

SEQ ID NO: 295554 - protein, 8 aa, Influenza virus
KTLTSEKE

SEQ ID NO: 295555 - protein, 8 aa, Influenza virus
TLTSEKEE

SEQ ID NO: 295556 - protein, 8 aa, Influenza virus
LTSEKEEV

SEQ ID NO: 295557 - protein, 8 aa, Influenza virus
EKEEVINA

SEQ ID NO: 295558 - protein, 8 aa, Influenza virus
KEKVTNAT

SEQ ID NO: 295559 - protein, 8 aa, Influenza virus
ATETVESR

SEQ ID NO: 295560 - protein, 8 aa, Influenza virus
HKDLGNCH

SEQ ID NO: 295561 - protein, 8 aa, Influenza virus
KDLDNCHP

SEQ ID NO: 295562 - protein, 8 aa, Influenza virus
DLGNCHPV

SEQ ID NO: 295563 - protein, 8 aa, Influenza virus
LGNCHPVG

SEQ ID NO: 295564 - protein, 8 aa, Influenza virus
DNCHPIGM

SEQ ID NO: 295565 - protein, 8 aa, Influenza virus
NCHPIGMI

SEQ ID NO: 295566 - protein, 8 aa, Influenza virus
CHPIGMLI

SEQ ID NO: 295567 - protein, 8 aa, Influenza virus
HPIGMLIG

SEQ ID NO: 295568 - protein, 8 aa, Influenza virus
IGAPACDL

SEQ ID NO: 295569 - protein, 8 aa, Influenza virus
GTPACDLY

SEQ ID NO: 295570 - protein, 8 aa, Influenza virus
TPACDLYL

SEQ ID NO: 295571 - protein, 8 aa, Influenza virus
PACDLYLT

SEQ ID NO: 295572 - protein, 8 aa, Influenza virus
VCDPHLTG

SEQ ID NO: 295573 - protein, 8 aa, Influenza virus
CDLYLTGT

SEQ ID NO: 295574 - protein, 8 aa, Influenza virus
DLYLTGTW

SEQ ID NO: 295575 - protein, 8 aa, Influenza virus
PHLTGTWD

SEQ ID NO: 295576 - protein, 8 aa, Influenza virus
HLTGIWDT

SEQ ID NO: 295577 - protein, 8 aa, Influenza virus
LTGKWDTL

SEQ ID NO: 295578 - protein, 8 aa, Influenza virus
TGMWDTLI

SEQ ID NO: 295579 - protein, 8 aa, Influenza virus
GIWDTLIE

SEQ ID NO: 295580 - protein, 8 aa, Influenza virus
IWDTLIER

SEQ ID NO: 295581 - protein, 8 aa, Influenza virus
WDTLIERG

SEQ ID NO: 295582 - protein, 8 aa, Influenza virus
DTLIERGS

SEQ ID NO: 295583 - protein, 8 aa, Influenza virus
TLIERENS

SEQ ID NO: 295584 - protein, 8 aa, Influenza virus
AIAHCYPG

SEQ ID NO: 295585 - protein, 8 aa, Influenza virus
IAYCYPGT

SEQ ID NO: 295586 - protein, 8 aa, Influenza virus
AYCYPGTT

SEQ ID NO: 295587 - protein, 8 aa, Influenza virus
YCYPGTTV

SEQ ID NO: 295588 - protein, 8 aa, Influenza virus
CYPGTTVN

SEQ ID NO: 295589 - protein, 8 aa, Influenza virus
YPGTTVNE

SEQ ID NO: 295590 - protein, 8 aa, Influenza virus
PGTTVNEE

SEQ ID NO: 295591 - protein, 8 aa, Influenza virus
GTTVNEEA

SEQ ID NO: 295592 - protein, 8 aa, Influenza virus
TTVNEEAL

SEQ ID NO: 295593 - protein, 8 aa, Influenza virus
TVNEGALR

SEQ ID NO: 295594 - protein, 8 aa, Influenza virus
VNEGALRQ

SEQ ID NO: 295595 - protein, 8 aa, Influenza virus
ESGGISKM

SEQ ID NO: 295596 - protein, 8 aa, Influenza virus
SGGISKIS

SEQ ID NO: 295597 - protein, 8 aa, Influenza virus
GGISKIST

SEQ ID NO: 295598 - protein, 8 aa, Influenza virus
FAYGSSIN

SEQ ID NO: 295599 - protein, 8 aa, Influenza virus
TYESSINP

SEQ ID NO: 295600 - protein, 8 aa, Influenza virus
YGSSITSA

SEQ ID NO: 295601 - protein, 8 aa, Influenza virus
GSSITSAG

SEQ ID NO: 295602 - protein, 8 aa, Influenza virus
SINPAGTT

SEQ ID NO: 295603 - protein, 8 aa, Influenza virus
GKNSFYAE

SEQ ID NO: 295604 - protein, 8 aa, Influenza virus
KNSFYAEL

SEQ ID NO: 295605 - protein, 8 aa, Influenza virus
LKWLVSKN

SEQ ID NO: 295606 - protein, 8 aa, Influenza virus
KWLVSKNK

SEQ ID NO: 295607 - protein, 8 aa, Influenza virus
WLVSKNKG

SEQ ID NO: 295608 - protein, 8 aa, Influenza virus
LVSKNKGQ

SEQ ID NO: 295609 - protein, 8 aa, Influenza virus
KGRNFPQT

SEQ ID NO: 295610 - protein, 8 aa, Influenza virus
QNFPRTTN

SEQ ID NO: 295611 - protein, 8 aa, Influenza virus
NFPRTTNT

SEQ ID NO: 295612 - protein, 8 aa, Influenza virus
FPRTTNTY

SEQ ID NO: 295613 - protein, 8 aa, Influenza virus
PRTTNTYR

SEQ ID NO: 295614 - protein, 8 aa, Influenza virus
RTTNTYRN

SEQ ID NO: 295615 - protein, 8 aa, Influenza virus
NTYRNTDP

SEQ ID NO: 295616 - protein, 8 aa, Influenza virus
EHLIMWGI

SEQ ID NO: 295617 - protein, 8 aa, Influenza virus
HLITWGIH

SEQ ID NO: 295618 - protein, 8 aa, Influenza virus
LITWGIHH

SEQ ID NO: 295619 - protein, 8 aa, Influenza virus
IMWGIHHP

SEQ ID NO: 295620 - protein, 8 aa, Influenza virus
MWGIHHPS

SEQ ID NO: 295621 - protein, 8 aa, Influenza virus
IHHPSSAQ

SEQ ID NO: 295622 - protein, 8 aa, Influenza virus
HHPSSAQE

SEQ ID NO: 295623 - protein, 8 aa, Influenza virus
HPSSAQEK

SEQ ID NO: 295624 - protein, 8 aa, Influenza virus
PSSAQEKN

SEQ ID NO: 295625 - protein, 8 aa, Influenza virus
SSTKEKND

SEQ ID NO: 295626 - protein, 8 aa, Influenza virus
STKEKNDL

SEQ ID NO: 295627 - protein, 8 aa, Influenza virus
AQEKNDLY

SEQ ID NO: 295628 - protein, 8 aa, Influenza virus
KEKNELYG

SEQ ID NO: 295629 - protein, 8 aa, Influenza virus
EKNDLYGA

SEQ ID NO: 295630 - protein, 8 aa, Influenza virus
RNDLYGTQ

SEQ ID NO: 295631 - protein, 8 aa, Influenza virus
NDLYGTQP

SEQ ID NO: 295632 - protein, 8 aa, Influenza virus
ELYGTQSL

SEQ ID NO: 295633 - protein, 8 aa, Influenza virus
TQPLSISV

SEQ ID NO: 295634 - protein, 8 aa, Influenza virus
QPLSISVG

SEQ ID NO: 295635 - protein, 8 aa, Influenza virus
SLSISIGS

SEQ ID NO: 295636 - protein, 8 aa, Influenza virus
LSISIGSS

SEQ ID NO: 295637 - protein, 8 aa, Influenza virus
SISIGSST

SEQ ID NO: 295638 - protein, 8 aa, Influenza virus
ISIGSSTY

SEQ ID NO: 295639 - protein, 8 aa, Influenza virus
SIGSSTYQ

SEQ ID NO: 295640 - protein, 8 aa, Influenza virus
IGSSTYQN

SEQ ID NO: 295641 - protein, 8 aa, Influenza virus
GSSTYQNS

SEQ ID NO: 295642 - protein, 8 aa, Influenza virus
SSTYHNSF

SEQ ID NO: 295643 - protein, 8 aa, Influenza virus
STYHNSFV

SEQ ID NO: 295644 - protein, 8 aa, Influenza virus
IYQNSFVP

SEQ ID NO: 295645 - protein, 8 aa, Influenza virus
HNSFVPVV

SEQ ID NO: 295646 - protein, 8 aa, Influenza virus
GRINFHWT

SEQ ID NO: 295647 - protein, 8 aa, Influenza virus
LVQPGDNI

SEQ ID NO: 295648 - protein, 8 aa, Influenza virus
IQPGDNIT

SEQ ID NO: 295649 - protein, 8 aa, Influenza virus
GDNITFSD

SEQ ID NO: 295650 - protein, 8 aa, Influenza virus
DNIIFSHN

SEQ ID NO: 295651 - protein, 8 aa, Influenza virus
NITFSDNG

SEQ ID NO: 295652 - protein, 8 aa, Influenza virus
IIFSHNGG

SEQ ID NO: 295653 - protein, 8 aa, Influenza virus
TFSDNGGL

SEQ ID NO: 295654 - protein, 8 aa, Influenza virus
FSDNGGLI

SEQ ID NO: 295655 - protein, 8 aa, Influenza virus
LHNGGLIA

SEQ ID NO: 295656 - protein, 8 aa, Influenza virus
LIAPDRVS

SEQ ID NO: 295657 - protein, 8 aa, Influenza virus
VAPSRVSK

SEQ ID NO: 295658 - protein, 8 aa, Influenza virus
PSRVTKLK

SEQ ID NO: 295659 - protein, 8 aa, Influenza virus
SRVTKLKG

SEQ ID NO: 295660 - protein, 8 aa, Influenza virus
GKGLGIQS

SEQ ID NO: 295661 - protein, 8 aa, Influenza virus
RGLGIQSE

SEQ ID NO: 295662 - protein, 8 aa, Influenza virus
GLGIQSDA

SEQ ID NO: 295663 - protein, 8 aa, Influenza virus
DNSCESKC

SEQ ID NO: 295664 - protein, 8 aa, Influenza virus
NSCESKCF

SEQ ID NO: 295665 - protein, 8 aa, Influenza virus
SCESKCFW

SEQ ID NO: 295666 - protein, 8 aa, Influenza virus
FWRGGSIN

SEQ ID NO: 295667 - protein, 8 aa, Influenza virus
WRGGSINT

SEQ ID NO: 295668 - protein, 8 aa, Influenza virus
RGGSINTK

SEQ ID NO: 295669 - protein, 8 aa, Influenza virus
GGSINTRL

SEQ ID NO: 295670 - protein, 8 aa, Influenza virus
GSINTRLP

SEQ ID NO: 295671 - protein, 8 aa, Influenza virus
SINTRLPF

SEQ ID NO: 295672 - protein, 8 aa, Influenza virus
INTRLPFQ

SEQ ID NO: 295673 - protein, 8 aa, Influenza virus
NTRLPFQN

SEQ ID NO: 295674 - protein, 8 aa, Influenza virus
QCPKYVNQ

SEQ ID NO: 295675 - protein, 8 aa, Influenza virus
KSLMLATG

SEQ ID NO: 295676 - protein, 8 aa, Influenza virus
GMRNVPET

SEQ ID NO: 295677 - protein, 8 aa, Influenza virus
ADYKSTQK

SEQ ID NO: 295678 - protein, 8 aa, Influenza virus
DYKSTQKT

SEQ ID NO: 295679 - protein, 8 aa, Influenza virus
YESTQAAI

SEQ ID NO: 295680 - protein, 8 aa, Influenza virus
ESTQAAID

SEQ ID NO: 295681 - protein, 8 aa, Influenza virus
STQKTIDQ

SEQ ID NO: 295682 - protein, 8 aa, Influenza virus
TQKTIDQV

SEQ ID NO: 295683 - protein, 8 aa, Influenza virus
QKTIDQVT

SEQ ID NO: 295684 - protein, 8 aa, Influenza virus
KTIDQVTG

SEQ ID NO: 295685 - protein, 8 aa, Influenza virus
TIDQVTGK

SEQ ID NO: 295686 - protein, 8 aa, Influenza virus
IDQVTGKL

SEQ ID NO: 295687 - protein, 8 aa, Influenza virus
IESEFSET

SEQ ID NO: 295688 - protein, 8 aa, Influenza virus
ESEFSETE

SEQ ID NO: 295689 - protein, 8 aa, Influenza virus
SEFSETEH

SEQ ID NO: 295690 - protein, 8 aa, Influenza virus
EFSETEHQ

SEQ ID NO: 295691 - protein, 8 aa, Influenza virus
FSETEHQI

SEQ ID NO: 295692 - protein, 8 aa, Influenza virus
SETEHQIG

SEQ ID NO: 295693 - protein, 8 aa, Influenza virus
EIEYQIGN

SEQ ID NO: 295694 - protein, 8 aa, Influenza virus
IEYQIGNV

SEQ ID NO: 295695 - protein, 8 aa, Influenza virus
EMLNLYEG

SEQ ID NO: 295696 - protein, 8 aa, Influenza virus
GCFEIYHT

SEQ ID NO: 295697 - protein, 8 aa, Influenza virus
CFEIYHTC

SEQ ID NO: 295698 - protein, 8 aa, Influenza virus
FEIYHTCD

SEQ ID NO: 295699 - protein, 8 aa, Influenza virus
CDNNCMES

SEQ ID NO: 295700 - protein, 8 aa, Influenza virus
DNNCMESI

SEQ ID NO: 295701 - protein, 8 aa, Influenza virus
NNCMESIR

SEQ ID NO: 295702 - protein, 8 aa, Influenza virus
NCMESIRD

SEQ ID NO: 295703 - protein, 8 aa, Influenza virus
RNNTYDHS

SEQ ID NO: 295704 - protein, 8 aa, Influenza virus
NNTYDHSQ

SEQ ID NO: 295705 - protein, 8 aa, Influenza virus
NTYDHSQY

SEQ ID NO: 295706 - protein, 8 aa, Influenza virus
TYDHSQYR

SEQ ID NO: 295707 - protein, 8 aa, Influenza virus
YDHSQYRE

SEQ ID NO: 295708 - protein, 8 aa, Influenza virus
DHSQYREE

SEQ ID NO: 295709 - protein, 8 aa, Influenza virus
HSQYREEA

SEQ ID NO: 295710 - protein, 8 aa, Influenza virus
SQYREEAL

SEQ ID NO: 295711 - protein, 8 aa, Influenza virus
LNRLSINP

SEQ ID NO: 295712 - protein, 8 aa, Influenza virus
NRLSINPV

SEQ ID NO: 295713 - protein, 8 aa, Influenza virus
RLSINPVK

SEQ ID NO: 295714 - protein, 8 aa, Influenza virus
LSINPVKL

SEQ ID NO: 295715 - protein, 8 aa, Influenza virus
SINPVKLS

SEQ ID NO: 295716 - protein, 8 aa, Influenza virus
INPVTLSS

SEQ ID NO: 295717 - protein, 8 aa, Influenza virus
NPVTLSSG

SEQ ID NO: 295718 - protein, 8 aa, Influenza virus
PVTLSSGY

SEQ ID NO: 295719 - protein, 8 aa, Influenza virus
RLSSGYKD

SEQ ID NO: 295720 - protein, 8 aa, Influenza virus
SCFVLLAA

SEQ ID NO: 295721 - protein, 8 aa, Influenza virus
CFILLAVI

SEQ ID NO: 295722 - protein, 8 aa, Influenza virus
LLAAIMGL

SEQ ID NO: 295723 - protein, 8 aa, Influenza virus
IMGLFFFC

SEQ ID NO: 295724 - protein, 8 aa, Influenza virus
MGLFFFCL

SEQ ID NO: 295725 - protein, 8 aa, Influenza virus
GLFFFCLK

SEQ ID NO: 295726 - protein, 8 aa, Influenza virus
LFFFCLKN

SEQ ID NO: 295727 - protein, 8 aa, Influenza virus
FFFCLKNG

SEQ ID NO: 295728 - protein, 8 aa, Influenza virus
NPNQNLFT

SEQ ID NO: 295729 - protein, 8 aa, Influenza virus
PKSKLFTL

SEQ ID NO: 295730 - protein, 8 aa, Influenza virus
NQNLFTLS

SEQ ID NO: 295731 - protein, 8 aa, Influenza virus
QNLFTLSG

SEQ ID NO: 295732 - protein, 8 aa, Influenza virus
FALSGVAV

SEQ ID NO: 295733 - protein, 8 aa, Influenza virus
ALSGVAVA

SEQ ID NO: 295734 - protein, 8 aa, Influenza virus
LSGVAITL

SEQ ID NO: 295735 - protein, 8 aa, Influenza virus
SGVAISLS

SEQ ID NO: 295736 - protein, 8 aa, Influenza virus
MNLLIGIS

SEQ ID NO: 295737 - protein, 8 aa, Influenza virus
LKVSLHLK

SEQ ID NO: 295738 - protein, 8 aa, Influenza virus
EKGAKQEE

SEQ ID NO: 295739 - protein, 8 aa, Influenza virus
NQNNTTVV

SEQ ID NO: 295740 - protein, 8 aa, Influenza virus
VENKYVNN

SEQ ID NO: 295741 - protein, 8 aa, Influenza virus
KYVNNTTI

SEQ ID NO: 295742 - protein, 8 aa, Influenza virus
VNNTTIIN

SEQ ID NO: 295743 - protein, 8 aa, Influenza virus
NKTTVINK

SEQ ID NO: 295744 - protein, 8 aa, Influenza virus
YLVLNKSL

SEQ ID NO: 295745 - protein, 8 aa, Influenza virus
LVLNKSLC

SEQ ID NO: 295746 - protein, 8 aa, Influenza virus
LLNKSLCN

SEQ ID NO: 295747 - protein, 8 aa, Influenza virus
LNKSLCSV

SEQ ID NO: 295748 - protein, 8 aa, Influenza virus
NKSLCSVE

SEQ ID NO: 295749 - protein, 8 aa, Influenza virus
KSLCSVEG

SEQ ID NO: 295750 - protein, 8 aa, Influenza virus
SLCSVEGW

SEQ ID NO: 295751 - protein, 8 aa, Influenza virus
LCSVEGWV

SEQ ID NO: 295752 - protein, 8 aa, Influenza virus
CSVEGWVV

SEQ ID NO: 295753 - protein, 8 aa, Influenza virus
SVEGWVVI

SEQ ID NO: 295754 - protein, 8 aa, Influenza virus
VIAKDNAI

SEQ ID NO: 295755 - protein, 8 aa, Influenza virus
IAKDNAIR

SEQ ID NO: 295756 - protein, 8 aa, Influenza virus
NAIRFGEG

SEQ ID NO: 295757 - protein, 8 aa, Influenza virus
AIRFGEGE

SEQ ID NO: 295758 - protein, 8 aa, Influenza virus
IRFGEGEQ

SEQ ID NO: 295759 - protein, 8 aa, Influenza virus
RFGEGEQI

SEQ ID NO: 295760 - protein, 8 aa, Influenza virus
FGEGEQII

SEQ ID NO: 295761 - protein, 8 aa, Influenza virus
GEGEQIIV

SEQ ID NO: 295762 - protein, 8 aa, Influenza virus
EGEQIIVT

SEQ ID NO: 295763 - protein, 8 aa, Influenza virus
GEQIIVTR

SEQ ID NO: 295764 - protein, 8 aa, Influenza virus
PYVSCDPS

SEQ ID NO: 295765 - protein, 8 aa, Influenza virus
YVSCDPSG

SEQ ID NO: 295766 - protein, 8 aa, Influenza virus
VSCDPTGC

SEQ ID NO: 295767 - protein, 8 aa, Influenza virus
SCDPTGCK

SEQ ID NO: 295768 - protein, 8 aa, Influenza virus
CDPTGCKM

SEQ ID NO: 295769 - protein, 8 aa, Influenza virus
DPSGCKMY

SEQ ID NO: 295770 - protein, 8 aa, Influenza virus
PSGCKMYA

SEQ ID NO: 295771 - protein, 8 aa, Influenza virus
TGCKMYAL

SEQ ID NO: 295772 - protein, 8 aa, Influenza virus
LMSTPLGS

SEQ ID NO: 295773 - protein, 8 aa, Influenza virus
MSTPLGSP

SEQ ID NO: 295774 - protein, 8 aa, Influenza virus
TPLGTPPT

SEQ ID NO: 295775 - protein, 8 aa, Influenza virus
PLGTPPTV

SEQ ID NO: 295776 - protein, 8 aa, Influenza virus
LGTPPTVS

SEQ ID NO: 295777 - protein, 8 aa, Influenza virus
GTPPTVSN

SEQ ID NO: 295778 - protein, 8 aa, Influenza virus
TPPTVSNS

SEQ ID NO: 295779 - protein, 8 aa, Influenza virus
PPTVSNSD

SEQ ID NO: 295780 - protein, 8 aa, Influenza virus
PTVSNSDF

SEQ ID NO: 295781 - protein, 8 aa, Influenza virus
VSNSDFIC

SEQ ID NO: 295782 - protein, 8 aa, Influenza virus
SNSDFICV

SEQ ID NO: 295783 - protein, 8 aa, Influenza virus
NSDFICVG

SEQ ID NO: 295784 - protein, 8 aa, Influenza virus
SDFICVGW

SEQ ID NO: 295785 - protein, 8 aa, Influenza virus
DFICVGWS

SEQ ID NO: 295786 - protein, 8 aa, Influenza virus
FMCVGWSS

SEQ ID NO: 295787 - protein, 8 aa, Influenza virus
MCVGWSST

SEQ ID NO: 295788 - protein, 8 aa, Influenza virus
STTCHDGI

SEQ ID NO: 295789 - protein, 8 aa, Influenza virus
TTCHDGIG

SEQ ID NO: 295790 - protein, 8 aa, Influenza virus
TCHDGIGR

SEQ ID NO: 295791 - protein, 8 aa, Influenza virus
IGRMTICI

SEQ ID NO: 295792 - protein, 8 aa, Influenza virus
MIICIQGN

SEQ ID NO: 295793 - protein, 8 aa, Influenza virus
IICIQGNN

SEQ ID NO: 295794 - protein, 8 aa, Influenza virus
ICIQGNND

SEQ ID NO: 295795 - protein, 8 aa, Influenza virus
CIQGNNDN

SEQ ID NO: 295796 - protein, 8 aa, Influenza virus
IQGNNDNA

SEQ ID NO: 295797 - protein, 8 aa, Influenza virus
QGNNKNAT

SEQ ID NO: 295798 - protein, 8 aa, Influenza virus
GNNKNATA

SEQ ID NO: 295799 - protein, 8 aa, Influenza virus
NNKNATAT

SEQ ID NO: 295800 - protein, 8 aa, Influenza virus
NKNATATV

SEQ ID NO: 295801 - protein, 8 aa, Influenza virus
KNATATVY

SEQ ID NO: 295802 - protein, 8 aa, Influenza virus
TATVYYER

SEQ ID NO: 295803 - protein, 8 aa, Influenza virus
ATVYYNGR

SEQ ID NO: 295804 - protein, 8 aa, Influenza virus
TVYYNGRL

SEQ ID NO: 295805 - protein, 8 aa, Influenza virus
VYYNGRLT

SEQ ID NO: 295806 - protein, 8 aa, Influenza virus
YYNRRPTT

SEQ ID NO: 295807 - protein, 8 aa, Influenza virus
YERRLTTT

SEQ ID NO: 295808 - protein, 8 aa, Influenza virus
ERRLTTTI

SEQ ID NO: 295809 - protein, 8 aa, Influenza virus
TTIKPWAR

SEQ ID NO: 295810 - protein, 8 aa, Influenza virus
TIKPWARN

SEQ ID NO: 295811 - protein, 8 aa, Influenza virus
IKPWARNI

SEQ ID NO: 295812 - protein, 8 aa, Influenza virus
KPWARNIL

SEQ ID NO: 295813 - protein, 8 aa, Influenza virus
PWARNILR

SEQ ID NO: 295814 - protein, 8 aa, Influenza virus
WAGKILRT

SEQ ID NO: 295815 - protein, 8 aa, Influenza virus
AGKILRTQ

SEQ ID NO: 295816 - protein, 8 aa, Influenza virus
GKILRTQE

SEQ ID NO: 295817 - protein, 8 aa, Influenza virus
HNGTCAVV

SEQ ID NO: 295818 - protein, 8 aa, Influenza virus
NGTCAVVM

SEQ ID NO: 295819 - protein, 8 aa, Influenza virus
GTCAVVMT

SEQ ID NO: 295820 - protein, 8 aa, Influenza virus
TCAVVMTD

SEQ ID NO: 295821 - protein, 8 aa, Influenza virus
CAVVMTDG

SEQ ID NO: 295822 - protein, 8 aa, Influenza virus
AVVMTDGS

SEQ ID NO: 295823 - protein, 8 aa, Influenza virus
VIMTDGPA

SEQ ID NO: 295824 - protein, 8 aa, Influenza virus
IMTDGPAN

SEQ ID NO: 295825 - protein, 8 aa, Influenza virus
MTDGSANS

SEQ ID NO: 295826 - protein, 8 aa, Influenza virus
TDGSASGQ

SEQ ID NO: 295827 - protein, 8 aa, Influenza virus
DGPASSQA

SEQ ID NO: 295828 - protein, 8 aa, Influenza virus
GPANSQAY

SEQ ID NO: 295829 - protein, 8 aa, Influenza virus
PANSQAYT

SEQ ID NO: 295830 - protein, 8 aa, Influenza virus
ANSQAYTK

SEQ ID NO: 295831 - protein, 8 aa, Influenza virus
SSQAYTKI

SEQ ID NO: 295832 - protein, 8 aa, Influenza virus
QAYTKVMY

SEQ ID NO: 295833 - protein, 8 aa, Influenza virus
AYTKVMYF

SEQ ID NO: 295834 - protein, 8 aa, Influenza virus
YTKVMYFH

SEQ ID NO: 295835 - protein, 8 aa, Influenza virus
TKILYFHK

SEQ ID NO: 295836 - protein, 8 aa, Influenza virus
KIMYFHKG

SEQ ID NO: 295837 - protein, 8 aa, Influenza virus
VMYFHKGL

SEQ ID NO: 295838 - protein, 8 aa, Influenza virus
MYFHKGLV

SEQ ID NO: 295839 - protein, 8 aa, Influenza virus
YFHKGIVI

SEQ ID NO: 295840 - protein, 8 aa, Influenza virus
FHKGIVIK

SEQ ID NO: 295841 - protein, 8 aa, Influenza virus
HKGIVIKE

SEQ ID NO: 295842 - protein, 8 aa, Influenza virus
KGIVIKEE

SEQ ID NO: 295843 - protein, 8 aa, Influenza virus
KEEALQGS

SEQ ID NO: 295844 - protein, 8 aa, Influenza virus
EEVLKGSA

SEQ ID NO: 295845 - protein, 8 aa, Influenza virus
EVLKGSAR

SEQ ID NO: 295846 - protein, 8 aa, Influenza virus
TLKGSARH

SEQ ID NO: 295847 - protein, 8 aa, Influenza virus
LQGSARHI

SEQ ID NO: 295848 - protein, 8 aa, Influenza virus
QGSARHIE

SEQ ID NO: 295849 - protein, 8 aa, Influenza virus
ARHIEECP

SEQ ID NO: 295850 - protein, 8 aa, Influenza virus
RHVEECSC

SEQ ID NO: 295851 - protein, 8 aa, Influenza virus
ECSCYGHS

SEQ ID NO: 295852 - protein, 8 aa, Influenza virus
CSCYGHNQ

SEQ ID NO: 295853 - protein, 8 aa, Influenza virus
SCYGHNQK

SEQ ID NO: 295854 - protein, 8 aa, Influenza virus
CYGHNQKI

SEQ ID NO: 295855 - protein, 8 aa, Influenza virus
YGHNQKIT

SEQ ID NO: 295856 - protein, 8 aa, Influenza virus
GHNQKITC

SEQ ID NO: 295857 - protein, 8 aa, Influenza virus
QKITCVCR

SEQ ID NO: 295858 - protein, 8 aa, Influenza virus
KVTCICRD

SEQ ID NO: 295859 - protein, 8 aa, Influenza virus
VTCICRDN

SEQ ID NO: 295860 - protein, 8 aa, Influenza virus
GANRPIIE

SEQ ID NO: 295861 - protein, 8 aa, Influenza virus
ANRPIIEI

SEQ ID NO: 295862 - protein, 8 aa, Influenza virus
NRPIIEID

SEQ ID NO: 295863 - protein, 8 aa, Influenza virus
RPIIEIDM

SEQ ID NO: 295864 - protein, 8 aa, Influenza virus
VMEHTSQY

SEQ ID NO: 295865 - protein, 8 aa, Influenza virus
MKHTSQYL

SEQ ID NO: 295866 - protein, 8 aa, Influenza virus
KHTSQYLC

SEQ ID NO: 295867 - protein, 8 aa, Influenza virus
SQYLCTGI

SEQ ID NO: 295868 - protein, 8 aa, Influenza virus
QYLCTGIL

SEQ ID NO: 295869 - protein, 8 aa, Influenza virus
YLCTGILT

SEQ ID NO: 295870 - protein, 8 aa, Influenza virus
LCTGILTD

SEQ ID NO: 295871 - protein, 8 aa, Influenza virus
DTSKPSDK

SEQ ID NO: 295872 - protein, 8 aa, Influenza virus
KGFGFLDG

SEQ ID NO: 295873 - protein, 8 aa, Influenza virus
SNTWLGRT

SEQ ID NO: 295874 - protein, 8 aa, Influenza virus
LGRTFSPR

SEQ ID NO: 295875 - protein, 8 aa, Influenza virus
GRTISPHS

SEQ ID NO: 295876 - protein, 8 aa, Influenza virus
GTISPRSR

SEQ ID NO: 295877 - protein, 8 aa, Influenza virus
MLKVPNAG

SEQ ID NO: 295878 - protein, 8 aa, Influenza virus
LKVPNAGT

SEQ ID NO: 295879 - protein, 8 aa, Influenza virus
KVPNAGTD

SEQ ID NO: 295880 - protein, 8 aa, Influenza virus
VPNAGTDP

SEQ ID NO: 295881 - protein, 8 aa, Influenza virus
PNAETDPS

SEQ ID NO: 295882 - protein, 8 aa, Influenza virus
NAETDPSS

SEQ ID NO: 295883 - protein, 8 aa, Influenza virus
IAERQEIV

SEQ ID NO: 295884 - protein, 8 aa, Influenza virus
TGRQEIVD

SEQ ID NO: 295885 - protein, 8 aa, Influenza virus
ERQEVVDN

SEQ ID NO: 295886 - protein, 8 aa, Influenza virus
RQEVVDNN

SEQ ID NO: 295887 - protein, 8 aa, Influenza virus
NSDWSGYS

SEQ ID NO: 295888 - protein, 8 aa, Influenza virus
NNLSGYSG

SEQ ID NO: 295889 - protein, 8 aa, Influenza virus
DWSGYSGS

SEQ ID NO: 295890 - protein, 8 aa, Influenza virus
SFIDYWND

SEQ ID NO: 295891 - protein, 8 aa, Influenza virus
SVCYNPCF

SEQ ID NO: 295892 - protein, 8 aa, Influenza virus
ACYNPCFY

SEQ ID NO: 295893 - protein, 8 aa, Influenza virus
IALCGSPF

SEQ ID NO: 295894 - protein, 8 aa, Influenza virus
ALCGSPVP

SEQ ID NO: 295895 - protein, 8 aa, Influenza virus
LCGSPVPV

SEQ ID NO: 295896 - protein, 8 aa, Influenza virus
CGSPVPVG

SEQ ID NO: 295897 - protein, 8 aa, Influenza virus
GSPVPVGS

SEQ ID NO: 295898 - protein, 8 aa, Influenza virus
SPVPVGSG

SEQ ID NO: 295899 - protein, 8 aa, Influenza virus
PVPVGSGS

SEQ ID NO: 295900 - protein, 8 aa, Influenza virus
VPVGSGSF

SEQ ID NO: 295901 - protein, 8 aa, Influenza virus
GSFPNGAQ

SEQ ID NO: 295902 - protein, 8 aa, Influenza virus
SFPNGAQI

SEQ ID NO: 295903 - protein, 8 aa, Influenza virus
FPDGAKIQ

SEQ ID NO: 295904 - protein, 8 aa, Influenza virus
PNGAQIQY

SEQ ID NO: 295905 - protein, 8 aa, Influenza virus
DGAKIQYF

SEQ ID NO: 295906 - protein, 8 aa, Influenza virus
RADEICIG

SEQ ID NO: 295907 - protein, 8 aa, Influenza virus
DEICIGHL

SEQ ID NO: 295908 - protein, 8 aa, Influenza virus
EICIGHLS

SEQ ID NO: 295909 - protein, 8 aa, Influenza virus
YMSNNSTE

SEQ ID NO: 295910 - protein, 8 aa, Influenza virus
LSNNSTER

SEQ ID NO: 295911 - protein, 8 aa, Influenza virus
SNNSTERV

SEQ ID NO: 295912 - protein, 8 aa, Influenza virus
NNSTDKVN

SEQ ID NO: 295913 - protein, 8 aa, Influenza virus
NSTDKVNT

SEQ ID NO: 295914 - protein, 8 aa, Influenza virus
STDKVNTI

SEQ ID NO: 295915 - protein, 8 aa, Influenza virus
TDKVNTII

SEQ ID NO: 295916 - protein, 8 aa, Influenza virus
DKVNTIIE

SEQ ID NO: 295917 - protein, 8 aa, Influenza virus
KVNTIIEN

SEQ ID NO: 295918 - protein, 8 aa, Influenza virus
VNTIIENN

SEQ ID NO: 295919 - protein, 8 aa, Influenza virus
NTIIENNV

SEQ ID NO: 295920 - protein, 8 aa, Influenza virus
ESNVTVTN

SEQ ID NO: 295921 - protein, 8 aa, Influenza virus
SNVTVTNS

SEQ ID NO: 295922 - protein, 8 aa, Influenza virus
NVTVTNSV

SEQ ID NO: 295923 - protein, 8 aa, Influenza virus
VTVTNSVE

SEQ ID NO: 295924 - protein, 8 aa, Influenza virus
SSIELVEN

SEQ ID NO: 295925 - protein, 8 aa, Influenza virus
KHTGSFCS

SEQ ID NO: 295926 - protein, 8 aa, Influenza virus
HTGTFCSI

SEQ ID NO: 295927 - protein, 8 aa, Influenza virus
TGTFCSIN

SEQ ID NO: 295928 - protein, 8 aa, Influenza virus
GSFCSLDG

SEQ ID NO: 295929 - protein, 8 aa, Influenza virus
SFCSLDGK

SEQ ID NO: 295930 - protein, 8 aa, Influenza virus
FCSINGKA

SEQ ID NO: 295931 - protein, 8 aa, Influenza virus
CSINGKAP

SEQ ID NO: 295932 - protein, 8 aa, Influenza virus
SINGKAPI

SEQ ID NO: 295933 - protein, 8 aa, Influenza virus
INGKAPIS

SEQ ID NO: 295934 - protein, 8 aa, Influenza virus
NGKAPISL

SEQ ID NO: 295935 - protein, 8 aa, Influenza virus
GRAPISLG

SEQ ID NO: 295936 - protein, 8 aa, Influenza virus
KEPISLGD

SEQ ID NO: 295937 - protein, 8 aa, Influenza virus
EPISLGDC

SEQ ID NO: 295938 - protein, 8 aa, Influenza virus
DCSFTGWI

SEQ ID NO: 295939 - protein, 8 aa, Influenza virus
LGNPRCDD

SEQ ID NO: 295940 - protein, 8 aa, Influenza virus
GNPRCDDL

SEQ ID NO: 295941 - protein, 8 aa, Influenza virus
NPRCDDLI

SEQ ID NO: 295942 - protein, 8 aa, Influenza virus
PRCDDLIG

SEQ ID NO: 295943 - protein, 8 aa, Influenza virus
RCDDLIGK

SEQ ID NO: 295944 - protein, 8 aa, Influenza virus
CDNLIGKT

SEQ ID NO: 295945 - protein, 8 aa, Influenza virus
DNLIGKTS

SEQ ID NO: 295946 - protein, 8 aa, Influenza virus
NLIGKTSW

SEQ ID NO: 295947 - protein, 8 aa, Influenza virus
WSYIVEKS

SEQ ID NO: 295948 - protein, 8 aa, Influenza virus
SYIVEKSN

SEQ ID NO: 295949 - protein, 8 aa, Influenza virus
YIVEKLNP

SEQ ID NO: 295950 - protein, 8 aa, Influenza virus
NPVNGICY

SEQ ID NO: 295951 - protein, 8 aa, Influenza virus
PVNGICYP

SEQ ID NO: 295952 - protein, 8 aa, Influenza virus
VNGICYPG

SEQ ID NO: 295953 - protein, 8 aa, Influenza virus
NGICYPGI

SEQ ID NO: 295954 - protein, 8 aa, Influenza virus
GICYPGIL

SEQ ID NO: 295955 - protein, 8 aa, Influenza virus
ICYPGSLD

SEQ ID NO: 295956 - protein, 8 aa, Influenza virus
EEELRLTF

SEQ ID NO: 295957 - protein, 8 aa, Influenza virus
AFFRNMVW

SEQ ID NO: 295958 - protein, 8 aa, Influenza virus
FFRNMIWL

SEQ ID NO: 295959 - protein, 8 aa, Influenza virus
FRNMIWLI

SEQ ID NO: 295960 - protein, 8 aa, Influenza virus
MVWLVHQS

SEQ ID NO: 295961 - protein, 8 aa, Influenza virus
WLIHQSET

SEQ ID NO: 295962 - protein, 8 aa, Influenza virus
LVHQSGTY

SEQ ID NO: 295963 - protein, 8 aa, Influenza virus
VHQSGTYP

SEQ ID NO: 295964 - protein, 8 aa, Influenza virus
HQSETYPV

SEQ ID NO: 295965 - protein, 8 aa, Influenza virus
QSETYPVI

SEQ ID NO: 295966 - protein, 8 aa, Influenza virus
RTFKNTKG

SEQ ID NO: 295967 - protein, 8 aa, Influenza virus
FNNTKGGD

SEQ ID NO: 295968 - protein, 8 aa, Influenza virus
KNTKGRDV

SEQ ID NO: 295969 - protein, 8 aa, Influenza virus
NIKGRDVL

SEQ ID NO: 295970 - protein, 8 aa, Influenza virus
NLYKKDSS

SEQ ID NO: 295971 - protein, 8 aa, Influenza virus
LYKKDISY

SEQ ID NO: 295972 - protein, 8 aa, Influenza virus
YKKDNSYV

SEQ ID NO: 295973 - protein, 8 aa, Influenza virus
GRMTFYWA

SEQ ID NO: 295974 - protein, 8 aa, Influenza virus
RMTFYWTM

SEQ ID NO: 295975 - protein, 8 aa, Influenza virus
MTFYWTMV

SEQ ID NO: 295976 - protein, 8 aa, Influenza virus
MTFESNGA

SEQ ID NO: 295977 - protein, 8 aa, Influenza virus
IFESNGAF

SEQ ID NO: 295978 - protein, 8 aa, Influenza virus
FESDGAFL

SEQ ID NO: 295979 - protein, 8 aa, Influenza virus
ESDGAFLA

SEQ ID NO: 295980 - protein, 8 aa, Influenza virus
SDGAFLAP

SEQ ID NO: 295981 - protein, 8 aa, Influenza virus
DGAFLAPR

SEQ ID NO: 295982 - protein, 8 aa, Influenza virus
GVFLAPRY

SEQ ID NO: 295983 - protein, 8 aa, Influenza virus
AFLAPGYA

SEQ ID NO: 295984 - protein, 8 aa, Influenza virus
FLAPRYAL

SEQ ID NO: 295985 - protein, 8 aa, Influenza virus
LAPRYALE

SEQ ID NO: 295986 - protein, 8 aa, Influenza virus
APRYALEL

SEQ ID NO: 295987 - protein, 8 aa, Influenza virus
PRYALELV

SEQ ID NO: 295988 - protein, 8 aa, Influenza virus
RYAFELVF

SEQ ID NO: 295989 - protein, 8 aa, Influenza virus
GSGKLFRS

SEQ ID NO: 295990 - protein, 8 aa, Influenza virus
GKLFKSEL

SEQ ID NO: 295991 - protein, 8 aa, Influenza virus
CSTRCQSE

SEQ ID NO: 295992 - protein, 8 aa, Influenza virus
KCQTEVGG

SEQ ID NO: 295993 - protein, 8 aa, Influenza virus
CQTEVGGI

SEQ ID NO: 295994 - protein, 8 aa, Influenza virus
QTEVGGIN

SEQ ID NO: 295995 - protein, 8 aa, Influenza virus
TEVGGINT

SEQ ID NO: 295996 - protein, 8 aa, Influenza virus
EIGWINTN

SEQ ID NO: 295997 - protein, 8 aa, Influenza virus
VGGINTNK

SEQ ID NO: 295998 - protein, 8 aa, Influenza virus
GWINTNRS

SEQ ID NO: 295999 - protein, 8 aa, Influenza virus
SFQNVHRN

SEQ ID NO: 296000 - protein, 8 aa, Influenza virus
LHNVHRNT

SEQ ID NO: 296001 - protein, 8 aa, Influenza virus
HNVHRSTI

SEQ ID NO: 296002 - protein, 8 aa, Influenza virus
NVHRNAIG

SEQ ID NO: 296003 - protein, 8 aa, Influenza virus
VHRNTFGD

SEQ ID NO: 296004 - protein, 8 aa, Influenza virus
HRNTFGDC

SEQ ID NO: 296005 - protein, 8 aa, Influenza virus
RSTIGDCP

SEQ ID NO: 296006 - protein, 8 aa, Influenza virus
STIGDCPK

SEQ ID NO: 296007 - protein, 8 aa, Influenza virus
AIGDCPKY

SEQ ID NO: 296008 - protein, 8 aa, Influenza virus
IGNCPKYV

SEQ ID NO: 296009 - protein, 8 aa, Influenza virus
DCPKYVNI

SEQ ID NO: 296010 - protein, 8 aa, Influenza virus
CPKYMNVK

SEQ ID NO: 296011 - protein, 8 aa, Influenza virus
PKYMNVKS

SEQ ID NO: 296012 - protein, 8 aa, Influenza virus
KYMNVKSL

SEQ ID NO: 296013 - protein, 8 aa, Influenza virus
YVNVRSLK

SEQ ID NO: 296014 - protein, 8 aa, Influenza virus
VNVRSLKL

SEQ ID NO: 296015 - protein, 8 aa, Influenza virus
NIKSLKLA

SEQ ID NO: 296016 - protein, 8 aa, Influenza virus
VKSLKLAS

SEQ ID NO: 296017 - protein, 8 aa, Influenza virus
KSLKLASG

SEQ ID NO: 296018 - protein, 8 aa, Influenza virus
SLKLASGL

SEQ ID NO: 296019 - protein, 8 aa, Influenza virus
LKLASGLR

SEQ ID NO: 296020 - protein, 8 aa, Influenza virus
KLASGLRN

SEQ ID NO: 296021 - protein, 8 aa, Influenza virus
LATGPRNV

SEQ ID NO: 296022 - protein, 8 aa, Influenza virus
ATGPRNVP

SEQ ID NO: 296023 - protein, 8 aa, Influenza virus
TGPRNVPA

SEQ ID NO: 296024 - protein, 8 aa, Influenza virus
GPRNVPAI

SEQ ID NO: 296025 - protein, 8 aa, Influenza virus
PRNVPAIA

SEQ ID NO: 296026 - protein, 8 aa, Influenza virus
ARGLFGAI

SEQ ID NO: 296027 - protein, 8 aa, Influenza virus
RNDEGTGI

SEQ ID NO: 296028 - protein, 8 aa, Influenza virus
NDEGTGIA

SEQ ID NO: 296029 - protein, 8 aa, Influenza virus
ADKESTQT

SEQ ID NO: 296030 - protein, 8 aa, Influenza virus
DKESTQTA

SEQ ID NO: 296031 - protein, 8 aa, Influenza virus
NNIVDWMN

SEQ ID NO: 296032 - protein, 8 aa, Influenza virus
IEEGINQL

SEQ ID NO: 296033 - protein, 8 aa, Influenza virus
EKRINQLS

SEQ ID NO: 296034 - protein, 8 aa, Influenza virus
INIWSYNA

SEQ ID NO: 296035 - protein, 8 aa, Influenza virus
DIWSYNAR

SEQ ID NO: 296036 - protein, 8 aa, Influenza virus
LWSYNAQL

SEQ ID NO: 296037 - protein, 8 aa, Influenza virus
YNARLLVL

SEQ ID NO: 296038 - protein, 8 aa, Influenza virus
NAKLLVLL

SEQ ID NO: 296039 - protein, 8 aa, Influenza virus
ARLLVLLE

SEQ ID NO: 296040 - protein, 8 aa, Influenza virus
KLLVLLEN

SEQ ID NO: 296041 - protein, 8 aa, Influenza virus
LHDSNVKN

SEQ ID NO: 296042 - protein, 8 aa, Influenza virus
HDSNVTNL

SEQ ID NO: 296043 - protein, 8 aa, Influenza virus
DSNVKNLH

SEQ ID NO: 296044 - protein, 8 aa, Influenza virus
SNVKNLHE

SEQ ID NO: 296045 - protein, 8 aa, Influenza virus
NVRSLHEK

SEQ ID NO: 296046 - protein, 8 aa, Influenza virus
NLHEKIRR

SEQ ID NO: 296047 - protein, 8 aa, Influenza virus
LHEKVRRI

SEQ ID NO: 296048 - protein, 8 aa, Influenza virus
HEKVRRIL

SEQ ID NO: 296049 - protein, 8 aa, Influenza virus
LKGNAKDE

SEQ ID NO: 296050 - protein, 8 aa, Influenza virus
KGNAKDEG

SEQ ID NO: 296051 - protein, 8 aa, Influenza virus
NNAKDEGN

SEQ ID NO: 296052 - protein, 8 aa, Influenza virus
FTFYHRCD

SEQ ID NO: 296053 - protein, 8 aa, Influenza virus
TFYHKCNN

SEQ ID NO: 296054 - protein, 8 aa, Influenza virus
FYHKCDDE

SEQ ID NO: 296055 - protein, 8 aa, Influenza virus
YHKCDDEC

SEQ ID NO: 296056 - protein, 8 aa, Influenza virus
HKCDDECI

SEQ ID NO: 296057 - protein, 8 aa, Influenza virus
KCDDECIE

SEQ ID NO: 296058 - protein, 8 aa, Influenza virus
NKCIERVR

SEQ ID NO: 296059 - protein, 8 aa, Influenza virus
KCIERVRN

SEQ ID NO: 296060 - protein, 8 aa, Influenza virus
CIEKIRNG

SEQ ID NO: 296061 - protein, 8 aa, Influenza virus
IEKIRNGT

SEQ ID NO: 296062 - protein, 8 aa, Influenza virus
EKIRNGTY

SEQ ID NO: 296063 - protein, 8 aa, Influenza virus
KIRNGTYD

SEQ ID NO: 296064 - protein, 8 aa, Influenza virus
YDHKDFEE

SEQ ID NO: 296065 - protein, 8 aa, Influenza virus
DHKDFEEE

SEQ ID NO: 296066 - protein, 8 aa, Influenza virus
HKEFKEES

SEQ ID NO: 296067 - protein, 8 aa, Influenza virus
KEFEKESK

SEQ ID NO: 296068 - protein, 8 aa, Influenza virus
EESRLNRQ

SEQ ID NO: 296069 - protein, 8 aa, Influenza virus
ESRLNRQE

SEQ ID NO: 296070 - protein, 8 aa, Influenza virus
SRLNRQEI

SEQ ID NO: 296071 - protein, 8 aa, Influenza virus
RLNRQEIE

SEQ ID NO: 296072 - protein, 8 aa, Influenza virus
LNRQEIGG

SEQ ID NO: 296073 - protein, 8 aa, Influenza virus
NRQEVEGV

SEQ ID NO: 296074 - protein, 8 aa, Influenza virus
RQEIGGVK

SEQ ID NO: 296075 - protein, 8 aa, Influenza virus
QEIGGVKL

SEQ ID NO: 296076 - protein, 8 aa, Influenza virus
EIEGVRLD

SEQ ID NO: 296077 - protein, 8 aa, Influenza virus
SNVYKILS

SEQ ID NO: 296078 - protein, 8 aa, Influenza virus
SSLILAAI

SEQ ID NO: 296079 - protein, 8 aa, Influenza virus
SLILAAII

SEQ ID NO: 296080 - protein, 8 aa, Influenza virus
LILAAIIM

SEQ ID NO: 296081 - protein, 8 aa, Influenza virus
ILAAIIMG

SEQ ID NO: 296082 - protein, 8 aa, Influenza virus
LAAIIMGL

SEQ ID NO: 296083 - protein, 8 aa, Influenza virus
WACNNGSC

SEQ ID NO: 296084 - protein, 8 aa, Influenza virus
ACNNGSCR

SEQ ID NO: 296085 - protein, 8 aa, Influenza virus
CGNGSCRC

SEQ ID NO: 296086 - protein, 8 aa, Influenza virus
GNGSCRCT

SEQ ID NO: 296087 - protein, 8 aa, Influenza virus
MEKFITLS

SEQ ID NO: 296088 - protein, 8 aa, Influenza virus
EKFITLST

SEQ ID NO: 296089 - protein, 8 aa, Influenza virus
VAYDKICI

SEQ ID NO: 296090 - protein, 8 aa, Influenza virus
TETVNTLS

SEQ ID NO: 296091 - protein, 8 aa, Influenza virus
ETVNTLSE

SEQ ID NO: 296092 - protein, 8 aa, Influenza virus
TVNTLTEQ

SEQ ID NO: 296093 - protein, 8 aa, Influenza virus
VNTLTEQN

SEQ ID NO: 296094 - protein, 8 aa, Influenza virus
NTLTEQNV

SEQ ID NO: 296095 - protein, 8 aa, Influenza virus
TLTEQNVP

SEQ ID NO: 296096 - protein, 8 aa, Influenza virus
LTEQNVPV

SEQ ID NO: 296097 - protein, 8 aa, Influenza virus
TEQNVPVT

SEQ ID NO: 296098 - protein, 8 aa, Influenza virus
VEELVHRG

SEQ ID NO: 296099 - protein, 8 aa, Influenza virus
EELVHGGV

SEQ ID NO: 296100 - protein, 8 aa, Influenza virus
ELVHGGVD

SEQ ID NO: 296101 - protein, 8 aa, Influenza virus
LVHGGVDP

SEQ ID NO: 296102 - protein, 8 aa, Influenza virus
TKLGSPLV

SEQ ID NO: 296103 - protein, 8 aa, Influenza virus
KLGSPLVL

SEQ ID NO: 296104 - protein, 8 aa, Influenza virus
DDCSLKGL

SEQ ID NO: 296105 - protein, 8 aa, Influenza virus
DCSLEGLV

SEQ ID NO: 296106 - protein, 8 aa, Influenza virus
CSLKGLIL

SEQ ID NO: 296107 - protein, 8 aa, Influenza virus
SLEGLVLG

SEQ ID NO: 296108 - protein, 8 aa, Influenza virus
LKGLILGN

SEQ ID NO: 296109 - protein, 8 aa, Influenza virus
EGLILSNP

SEQ ID NO: 296110 - protein, 8 aa, Influenza virus
GLILSNPK

SEQ ID NO: 296111 - protein, 8 aa, Influenza virus
LILSNPKC

SEQ ID NO: 296112 - protein, 8 aa, Influenza virus
VLGNPKCD

SEQ ID NO: 296113 - protein, 8 aa, Influenza virus
LSNPKCDL

SEQ ID NO: 296114 - protein, 8 aa, Influenza virus
SNPKCDLY

SEQ ID NO: 296115 - protein, 8 aa, Influenza virus
PKCDLYLS

SEQ ID NO: 296116 - protein, 8 aa, Influenza virus
KCDLYLSG

SEQ ID NO: 296117 - protein, 8 aa, Influenza virus
CDLYLSGR

SEQ ID NO: 296118 - protein, 8 aa, Influenza virus
DLYLSGRE

SEQ ID NO: 296119 - protein, 8 aa, Influenza virus
LYLSGREW

SEQ ID NO: 296120 - protein, 8 aa, Influenza virus
IVERPKEI

SEQ ID NO: 296121 - protein, 8 aa, Influenza virus
VERPKEIE

SEQ ID NO: 296122 - protein, 8 aa, Influenza virus
ERPKEIEG

SEQ ID NO: 296123 - protein, 8 aa, Influenza virus
RTKEMEGI

SEQ ID NO: 296124 - protein, 8 aa, Influenza virus
TKEMEGIC

SEQ ID NO: 296125 - protein, 8 aa, Influenza virus
KEIEGICY

SEQ ID NO: 296126 - protein, 8 aa, Influenza virus
EIEGICYP

SEQ ID NO: 296127 - protein, 8 aa, Influenza virus
IEGICYPG

SEQ ID NO: 296128 - protein, 8 aa, Influenza virus
GICYPGSV

SEQ ID NO: 296129 - protein, 8 aa, Influenza virus
VCYPGSIK

SEQ ID NO: 296130 - protein, 8 aa, Influenza virus
CYPGSVEN

SEQ ID NO: 296131 - protein, 8 aa, Influenza virus
YPGSIKNQ

SEQ ID NO: 296132 - protein, 8 aa, Influenza virus
PGSIKNQE

SEQ ID NO: 296133 - protein, 8 aa, Influenza virus
GSIKNQEE

SEQ ID NO: 296134 - protein, 8 aa, Influenza virus
SIKNQEEL

SEQ ID NO: 296135 - protein, 8 aa, Influenza virus
IENQEELK

SEQ ID NO: 296136 - protein, 8 aa, Influenza virus
ENQEELKS

SEQ ID NO: 296137 - protein, 8 aa, Influenza virus
NQEELKSL

SEQ ID NO: 296138 - protein, 8 aa, Influenza virus
QEELKSLF

SEQ ID NO: 296139 - protein, 8 aa, Influenza virus
EELKSLFS

SEQ ID NO: 296140 - protein, 8 aa, Influenza virus
ELKSLFSS

SEQ ID NO: 296141 - protein, 8 aa, Influenza virus
LKSLFSSI

SEQ ID NO: 296142 - protein, 8 aa, Influenza virus
KSLFSSIK

SEQ ID NO: 296143 - protein, 8 aa, Influenza virus
SLFSSIKR

SEQ ID NO: 296144 - protein, 8 aa, Influenza virus
RVKMFDFI

SEQ ID NO: 296145 - protein, 8 aa, Influenza virus
VKMFDFIK

SEQ ID NO: 296146 - protein, 8 aa, Influenza virus
KMFDFIKW

SEQ ID NO: 296147 - protein, 8 aa, Influenza virus
MFDFIKWN

SEQ ID NO: 296148 - protein, 8 aa, Influenza virus
FDFIKWNV

SEQ ID NO: 296149 - protein, 8 aa, Influenza virus
DFIKWNVT

SEQ ID NO: 296150 - protein, 8 aa, Influenza virus
FIKWNVTY

SEQ ID NO: 296151 - protein, 8 aa, Influenza virus
IKWNVTYT

SEQ ID NO: 296152 - protein, 8 aa, Influenza virus
WNVTHTGT

SEQ ID NO: 296153 - protein, 8 aa, Influenza virus
NVTHTGTS

SEQ ID NO: 296154 - protein, 8 aa, Influenza virus
VTYTGISK

SEQ ID NO: 296155 - protein, 8 aa, Influenza virus
TYTGISKA

SEQ ID NO: 296156 - protein, 8 aa, Influenza virus
YTGISKAC

SEQ ID NO: 296157 - protein, 8 aa, Influenza virus
TGISKACN

SEQ ID NO: 296158 - protein, 8 aa, Influenza virus
SRACNNTS

SEQ ID NO: 296159 - protein, 8 aa, Influenza virus
RACNNTSN

SEQ ID NO: 296160 - protein, 8 aa, Influenza virus
ACNSISNQ

SEQ ID NO: 296161 - protein, 8 aa, Influenza virus
TSNRGSFY

SEQ ID NO: 296162 - protein, 8 aa, Influenza virus
SNQDSFYR

SEQ ID NO: 296163 - protein, 8 aa, Influenza virus
NQGSFYRN

SEQ ID NO: 296164 - protein, 8 aa, Influenza virus
QGSFYRNM

SEQ ID NO: 296165 - protein, 8 aa, Influenza virus
GSFYRNMR

SEQ ID NO: 296166 - protein, 8 aa, Influenza virus
SFYRSIRW

SEQ ID NO: 296167 - protein, 8 aa, Influenza virus
FYRNMRWL

SEQ ID NO: 296168 - protein, 8 aa, Influenza virus
YRSIRWLT

SEQ ID NO: 296169 - protein, 8 aa, Influenza virus
RSIRWLTL

SEQ ID NO: 296170 - protein, 8 aa, Influenza virus
SIRWLTLK

SEQ ID NO: 296171 - protein, 8 aa, Influenza virus
MRWLTLKL

SEQ ID NO: 296172 - protein, 8 aa, Influenza virus
RWLTLKLG

SEQ ID NO: 296173 - protein, 8 aa, Influenza virus
WLTLKLGQ

SEQ ID NO: 296174 - protein, 8 aa, Influenza virus
LTLKLGQF

SEQ ID NO: 296175 - protein, 8 aa, Influenza virus
TLKLGQFP

SEQ ID NO: 296176 - protein, 8 aa, Influenza virus
LKLGQFPV

SEQ ID NO: 296177 - protein, 8 aa, Influenza virus
KLGQFPVQ

SEQ ID NO: 296178 - protein, 8 aa, Influenza virus
LGQFPVQT

SEQ ID NO: 296179 - protein, 8 aa, Influenza virus
YKNTGDSD

SEQ ID NO: 296180 - protein, 8 aa, Influenza virus
KNTRDSNI

SEQ ID NO: 296181 - protein, 8 aa, Influenza virus
FIWAIHHP

SEQ ID NO: 296182 - protein, 8 aa, Influenza virus
IWAIHHPP

SEQ ID NO: 296183 - protein, 8 aa, Influenza virus
IHHPPTTD

SEQ ID NO: 296184 - protein, 8 aa, Influenza virus
HHPPTTDE

SEQ ID NO: 296185 - protein, 8 aa, Influenza virus
HPPTTDEQ

SEQ ID NO: 296186 - protein, 8 aa, Influenza virus
PPTSDEQI

SEQ ID NO: 296187 - protein, 8 aa, Influenza virus
EINRIFRP

SEQ ID NO: 296188 - protein, 8 aa, Influenza virus
INRIFRPN

SEQ ID NO: 296189 - protein, 8 aa, Influenza virus
NRIFRPNI

SEQ ID NO: 296190 - protein, 8 aa, Influenza virus
RIFRPNIG

SEQ ID NO: 296191 - protein, 8 aa, Influenza virus
IFRPNIGP

SEQ ID NO: 296192 - protein, 8 aa, Influenza virus
NIGPRPLI

SEQ ID NO: 296193 - protein, 8 aa, Influenza virus
IGPRPLVM

SEQ ID NO: 296194 - protein, 8 aa, Influenza virus
GPRPLVRE

SEQ ID NO: 296195 - protein, 8 aa, Influenza virus
PRPLVREQ

SEQ ID NO: 296196 - protein, 8 aa, Influenza virus
RPLVREQQ

SEQ ID NO: 296197 - protein, 8 aa, Influenza virus
PLVREQQG

SEQ ID NO: 296198 - protein, 8 aa, Influenza virus
LVREQQGR

SEQ ID NO: 296199 - protein, 8 aa, Influenza virus
IRGQQGRM

SEQ ID NO: 296200 - protein, 8 aa, Influenza virus
MGQQGRMD

SEQ ID NO: 296201 - protein, 8 aa, Influenza virus
QTVKIKTN

SEQ ID NO: 296202 - protein, 8 aa, Influenza virus
TVKIQTSG

SEQ ID NO: 296203 - protein, 8 aa, Influenza virus
VKIQTSGN

SEQ ID NO: 296204 - protein, 8 aa, Influenza virus
KIQTSGNL

SEQ ID NO: 296205 - protein, 8 aa, Influenza virus
IQTSGNLI

SEQ ID NO: 296206 - protein, 8 aa, Influenza virus
KTNGNLIA

SEQ ID NO: 296207 - protein, 8 aa, Influenza virus
APEYGHLT

SEQ ID NO: 296208 - protein, 8 aa, Influenza virus
PEYGYLIT

SEQ ID NO: 296209 - protein, 8 aa, Influenza virus
EYGYLITG

SEQ ID NO: 296210 - protein, 8 aa, Influenza virus
YGHLTTGK

SEQ ID NO: 296211 - protein, 8 aa, Influenza virus
GHLTTGKS

SEQ ID NO: 296212 - protein, 8 aa, Influenza virus
YLITGKSH

SEQ ID NO: 296213 - protein, 8 aa, Influenza virus
LTTGKSHG

SEQ ID NO: 296214 - protein, 8 aa, Influenza virus
TTGKSHGR

SEQ ID NO: 296215 - protein, 8 aa, Influenza virus
HGRVLKNN

SEQ ID NO: 296216 - protein, 8 aa, Influenza virus
GRVLKNNL

SEQ ID NO: 296217 - protein, 8 aa, Influenza virus
RVLKNNLP

SEQ ID NO: 296218 - protein, 8 aa, Influenza virus
LKNDLPVG

SEQ ID NO: 296219 - protein, 8 aa, Influenza virus
TKCQLNEG

SEQ ID NO: 296220 - protein, 8 aa, Influenza virus
GCQLNEGV

SEQ ID NO: 296221 - protein, 8 aa, Influenza virus
CQLNEGVI

SEQ ID NO: 296222 - protein, 8 aa, Influenza virus
QLNEGIMN

SEQ ID NO: 296223 - protein, 8 aa, Influenza virus
LNEGIMNT

SEQ ID NO: 296224 - protein, 8 aa, Influenza virus
NEGIMNTS

SEQ ID NO: 296225 - protein, 8 aa, Influenza virus
EGVINTSK

SEQ ID NO: 296226 - protein, 8 aa, Influenza virus
GIMNTSKP

SEQ ID NO: 296227 - protein, 8 aa, Influenza virus
VINTSKPF

SEQ ID NO: 296228 - protein, 8 aa, Influenza virus
MNTSKPLQ

SEQ ID NO: 296229 - protein, 8 aa, Influenza virus
TSKPLQNT

SEQ ID NO: 296230 - protein, 8 aa, Influenza virus
SKPLQNTS

SEQ ID NO: 296231 - protein, 8 aa, Influenza virus
KPLQNTSK

SEQ ID NO: 296232 - protein, 8 aa, Influenza virus
PFQNICKP

SEQ ID NO: 296233 - protein, 8 aa, Influenza virus
FQNTSRHY

SEQ ID NO: 296234 - protein, 8 aa, Influenza virus
QNTSRHYI

SEQ ID NO: 296235 - protein, 8 aa, Influenza virus
NICKPYIG

SEQ ID NO: 296236 - protein, 8 aa, Influenza virus
TSRHYIGK

SEQ ID NO: 296237 - protein, 8 aa, Influenza virus
CKPYIGKC

SEQ ID NO: 296238 - protein, 8 aa, Influenza virus
RHYIGKCP

SEQ ID NO: 296239 - protein, 8 aa, Influenza virus
PYIGKCPK

SEQ ID NO: 296240 - protein, 8 aa, Influenza virus
GKCPKYIS

SEQ ID NO: 296241 - protein, 8 aa, Influenza virus
KCPKYISS

SEQ ID NO: 296242 - protein, 8 aa, Influenza virus
CPRYIPSG

SEQ ID NO: 296243 - protein, 8 aa, Influenza virus
PRYIPSGS

SEQ ID NO: 296244 - protein, 8 aa, Influenza virus
RYIPSGSL

SEQ ID NO: 296245 - protein, 8 aa, Influenza virus
YISSGSLK

SEQ ID NO: 296246 - protein, 8 aa, Influenza virus
ISSGSLKL

SEQ ID NO: 296247 - protein, 8 aa, Influenza virus
PSRSLKLA

SEQ ID NO: 296248 - protein, 8 aa, Influenza virus
SRSLKLAI

SEQ ID NO: 296249 - protein, 8 aa, Influenza virus
RSLKLAIG

SEQ ID NO: 296250 - protein, 8 aa, Influenza virus
GLRNVPQI

SEQ ID NO: 296251 - protein, 8 aa, Influenza virus
PRNVPQAQ

SEQ ID NO: 296252 - protein, 8 aa, Influenza virus
RNVPQAQN

SEQ ID NO: 296253 - protein, 8 aa, Influenza virus
NVPQAQNR

SEQ ID NO: 296254 - protein, 8 aa, Influenza virus
VPQAQNRG

SEQ ID NO: 296255 - protein, 8 aa, Influenza virus
PQAQNRGL

SEQ ID NO: 296256 - protein, 8 aa, Influenza virus
QAQNRGLF

SEQ ID NO: 296257 - protein, 8 aa, Influenza virus
AQNRGLFG

SEQ ID NO: 296258 - protein, 8 aa, Influenza virus
NRGLFGAK

SEQ ID NO: 296259 - protein, 8 aa, Influenza virus
IAGFIEGR

SEQ ID NO: 296260 - protein, 8 aa, Influenza virus
QHQNAEGI

SEQ ID NO: 296261 - protein, 8 aa, Influenza virus
HQNAEGIG

SEQ ID NO: 296262 - protein, 8 aa, Influenza virus
QNSEGTGI

SEQ ID NO: 296263 - protein, 8 aa, Influenza virus
NSEGTGIA

SEQ ID NO: 296264 - protein, 8 aa, Influenza virus
SEGTGIAA

SEQ ID NO: 296265 - protein, 8 aa, Influenza virus
EGIGIAAD

SEQ ID NO: 296266 - protein, 8 aa, Influenza virus
GTGIVADR

SEQ ID NO: 296267 - protein, 8 aa, Influenza virus
TGIAADRG

SEQ ID NO: 296268 - protein, 8 aa, Influenza virus
GIAADRGS

SEQ ID NO: 296269 - protein, 8 aa, Influenza virus
IAADRGST

SEQ ID NO: 296270 - protein, 8 aa, Influenza virus
VADRDSTQ

SEQ ID NO: 296271 - protein, 8 aa, Influenza virus
ADRDSTQM

SEQ ID NO: 296272 - protein, 8 aa, Influenza virus
DRDSTQMA

SEQ ID NO: 296273 - protein, 8 aa, Influenza virus
RDSTQMAI

SEQ ID NO: 296274 - protein, 8 aa, Influenza virus
DSTQMAID

SEQ ID NO: 296275 - protein, 8 aa, Influenza virus
STQMAIDN

SEQ ID NO: 296276 - protein, 8 aa, Influenza virus
TQMAIDNM

SEQ ID NO: 296277 - protein, 8 aa, Influenza virus
QMAIDNMQ

SEQ ID NO: 296278 - protein, 8 aa, Influenza virus
MAIDNMQN

SEQ ID NO: 296279 - protein, 8 aa, Influenza virus
AIDIMQNK

SEQ ID NO: 296280 - protein, 8 aa, Influenza virus
IDNMQNRL

SEQ ID NO: 296281 - protein, 8 aa, Influenza virus
DNMQNRLN

SEQ ID NO: 296282 - protein, 8 aa, Influenza virus
NMQNRLNN

SEQ ID NO: 296283 - protein, 8 aa, Influenza virus
NVIDKMYK

SEQ ID NO: 296284 - protein, 8 aa, Influenza virus
VIDKMYKQ

SEQ ID NO: 296285 - protein, 8 aa, Influenza virus
IDKMYKQF

SEQ ID NO: 296286 - protein, 8 aa, Influenza virus
EFSEVETR

SEQ ID NO: 296287 - protein, 8 aa, Influenza virus
FSEVETRI

SEQ ID NO: 296288 - protein, 8 aa, Influenza virus
SEVETRIN

SEQ ID NO: 296289 - protein, 8 aa, Influenza virus
VESRINTI

SEQ ID NO: 296290 - protein, 8 aa, Influenza virus
GSRINMIN

SEQ ID NO: 296291 - protein, 8 aa, Influenza virus
IRINMINS

SEQ ID NO: 296292 - protein, 8 aa, Influenza virus
RINTINSK

SEQ ID NO: 296293 - protein, 8 aa, Influenza virus
INTINSKI

SEQ ID NO: 296294 - protein, 8 aa, Influenza virus
NMINSKIN

SEQ ID NO: 296295 - protein, 8 aa, Influenza virus
MINSKIND

SEQ ID NO: 296296 - protein, 8 aa, Influenza virus
INSKIEDQ

SEQ ID NO: 296297 - protein, 8 aa, Influenza virus
NSQIDDQI

SEQ ID NO: 296298 - protein, 8 aa, Influenza virus
IEDQITDI

SEQ ID NO: 296299 - protein, 8 aa, Influenza virus
NDQITDIW

SEQ ID NO: 296300 - protein, 8 aa, Influenza virus
DQIIDIWA

SEQ ID NO: 296301 - protein, 8 aa, Influenza virus
QIIDIWAY

SEQ ID NO: 296302 - protein, 8 aa, Influenza virus
IIDIWAYN

SEQ ID NO: 296303 - protein, 8 aa, Influenza virus
VRNLHERI

SEQ ID NO: 296304 - protein, 8 aa, Influenza virus
RNLHDRVK

SEQ ID NO: 296305 - protein, 8 aa, Influenza virus
NLHDRVKR

SEQ ID NO: 296306 - protein, 8 aa, Influenza virus
RRVLKENA

SEQ ID NO: 296307 - protein, 8 aa, Influenza virus
RVLKENAI

SEQ ID NO: 296308 - protein, 8 aa, Influenza virus
VLKENAID

SEQ ID NO: 296309 - protein, 8 aa, Influenza virus
ENAVDTGD

SEQ ID NO: 296310 - protein, 8 aa, Influenza virus
NAIDAGDG

SEQ ID NO: 296311 - protein, 8 aa, Influenza virus
AIDAGDGC

SEQ ID NO: 296312 - protein, 8 aa, Influenza virus
LDTGDGCF

SEQ ID NO: 296313 - protein, 8 aa, Influenza virus
DNGDGCFE

SEQ ID NO: 296314 - protein, 8 aa, Influenza virus
NGDGCFEI

SEQ ID NO: 296315 - protein, 8 aa, Influenza virus
FEILHRCN

SEQ ID NO: 296316 - protein, 8 aa, Influenza virus
EILHRCDD

SEQ ID NO: 296317 - protein, 8 aa, Influenza virus
TIRTGTYN

SEQ ID NO: 296318 - protein, 8 aa, Influenza virus
IRTGTYNH

SEQ ID NO: 296319 - protein, 8 aa, Influenza virus
KNGTYNHQ

SEQ ID NO: 296320 - protein, 8 aa, Influenza virus
GTYNHQDY

SEQ ID NO: 296321 - protein, 8 aa, Influenza virus
TYNHQDYE

SEQ ID NO: 296322 - protein, 8 aa, Influenza virus
YEEESRIE

SEQ ID NO: 296323 - protein, 8 aa, Influenza virus
EEESRIER

SEQ ID NO: 296324 - protein, 8 aa, Influenza virus
DESRIERQ

SEQ ID NO: 296325 - protein, 8 aa, Influenza virus
ESRIERQK

SEQ ID NO: 296326 - protein, 8 aa, Influenza virus
SRIERQKI

SEQ ID NO: 296327 - protein, 8 aa, Influenza virus
ERQKVNGV

SEQ ID NO: 296328 - protein, 8 aa, Influenza virus
RQKVNGVK

SEQ ID NO: 296329 - protein, 8 aa, Influenza virus
QRINGVKL

SEQ ID NO: 296330 - protein, 8 aa, Influenza virus
KVNGVKLE

SEQ ID NO: 296331 - protein, 8 aa, Influenza virus
ISGVKLEE

SEQ ID NO: 296332 - protein, 8 aa, Influenza virus
ADKICVGY

SEQ ID NO: 296333 - protein, 8 aa, Influenza virus
DRICIGYL

SEQ ID NO: 296334 - protein, 8 aa, Influenza virus
RICIGYLS

SEQ ID NO: 296335 - protein, 8 aa, Influenza virus
YLSTNSSD

SEQ ID NO: 296336 - protein, 8 aa, Influenza virus
LSTNSTEK

SEQ ID NO: 296337 - protein, 8 aa, Influenza virus
STNSTEKV

SEQ ID NO: 296338 - protein, 8 aa, Influenza virus
TNSTEKVD

SEQ ID NO: 296339 - protein, 8 aa, Influenza virus
NSTEKVDT

SEQ ID NO: 296340 - protein, 8 aa, Influenza virus
STEKVDTL

SEQ ID NO: 296341 - protein, 8 aa, Influenza virus
TEKVDTLL

SEQ ID NO: 296342 - protein, 8 aa, Influenza virus
DKVDTLLE

SEQ ID NO: 296343 - protein, 8 aa, Influenza virus
KVDTLLES

SEQ ID NO: 296344 - protein, 8 aa, Influenza virus
VDTLLENN

SEQ ID NO: 296345 - protein, 8 aa, Influenza virus
DTLLENNV

SEQ ID NO: 296346 - protein, 8 aa, Influenza virus
TLLENNVP

SEQ ID NO: 296347 - protein, 8 aa, Influenza virus
LLENNVPV

SEQ ID NO: 296348 - protein, 8 aa, Influenza virus
LENNVPVT

SEQ ID NO: 296349 - protein, 8 aa, Influenza virus
ENNVPVTS

SEQ ID NO: 296350 - protein, 8 aa, Influenza virus
NNVPVTSS

SEQ ID NO: 296351 - protein, 8 aa, Influenza virus
VPVTSTID

SEQ ID NO: 296352 - protein, 8 aa, Influenza virus
PVTSTIDL

SEQ ID NO: 296353 - protein, 8 aa, Influenza virus
VTSSIDLI

SEQ ID NO: 296354 - protein, 8 aa, Influenza virus
TSSIDLIE

SEQ ID NO: 296355 - protein, 8 aa, Influenza virus
SSIDLIET

SEQ ID NO: 296356 - protein, 8 aa, Influenza virus
DLVETSHT

SEQ ID NO: 296357 - protein, 8 aa, Influenza virus
LVETSHTG

SEQ ID NO: 296358 - protein, 8 aa, Influenza virus
VETSHTGT

SEQ ID NO: 296359 - protein, 8 aa, Influenza virus
ETTHTGTY

SEQ ID NO: 296360 - protein, 8 aa, Influenza virus
TTHTGTYC

SEQ ID NO: 296361 - protein, 8 aa, Influenza virus
THTGTYCS

SEQ ID NO: 296362 - protein, 8 aa, Influenza virus
TGTYCSLG

SEQ ID NO: 296363 - protein, 8 aa, Influenza virus
GTYCSLGG

SEQ ID NO: 296364 - protein, 8 aa, Influenza virus
PVHLGDCN

SEQ ID NO: 296365 - protein, 8 aa, Influenza virus
VHLGDCNF

SEQ ID NO: 296366 - protein, 8 aa, Influenza virus
HLGDCNFE

SEQ ID NO: 296367 - protein, 8 aa, Influenza virus
LGDCNFEG

SEQ ID NO: 296368 - protein, 8 aa, Influenza virus
GDCNFEGW

SEQ ID NO: 296369 - protein, 8 aa, Influenza virus
DCNFEGWI

SEQ ID NO: 296370 - protein, 8 aa, Influenza virus
CNFEGWIV

SEQ ID NO: 296371 - protein, 8 aa, Influenza virus
NFEGWIVG

SEQ ID NO: 296372 - protein, 8 aa, Influenza virus
GWIGGNPA

SEQ ID NO: 296373 - protein, 8 aa, Influenza virus
WIGGNPAC

SEQ ID NO: 296374 - protein, 8 aa, Influenza virus
GVREWSYL

SEQ ID NO: 296375 - protein, 8 aa, Influenza virus
TREWSYLI

SEQ ID NO: 296376 - protein, 8 aa, Influenza virus
SYLIEDPA

SEQ ID NO: 296377 - protein, 8 aa, Influenza virus
YLIEDPTA

SEQ ID NO: 296378 - protein, 8 aa, Influenza virus
LIEDPAAP

SEQ ID NO: 296379 - protein, 8 aa, Influenza virus
IEDPAAPH

SEQ ID NO: 296380 - protein, 8 aa, Influenza virus
EDPTAPHG

SEQ ID NO: 296381 - protein, 8 aa, Influenza virus
DPTAPHGL

SEQ ID NO: 296382 - protein, 8 aa, Influenza virus
PTAPHGLC

SEQ ID NO: 296383 - protein, 8 aa, Influenza virus
TAPHGLCY

SEQ ID NO: 296384 - protein, 8 aa, Influenza virus
IKSFSRTQ

SEQ ID NO: 296385 - protein, 8 aa, Influenza virus
KSFSRTQL

SEQ ID NO: 296386 - protein, 8 aa, Influenza virus
FSRTQLIA

SEQ ID NO: 296387 - protein, 8 aa, Influenza virus
SRTQLIAP

SEQ ID NO: 296388 - protein, 8 aa, Influenza virus
LIPPASWG

SEQ ID NO: 296389 - protein, 8 aa, Influenza virus
SWGEVNDG

SEQ ID NO: 296390 - protein, 8 aa, Influenza virus
TGTNSFYR

SEQ ID NO: 296391 - protein, 8 aa, Influenza virus
GFYRNLVW

SEQ ID NO: 296392 - protein, 8 aa, Influenza virus
FYRNLVWL

SEQ ID NO: 296393 - protein, 8 aa, Influenza virus
YRNLVWFI

SEQ ID NO: 296394 - protein, 8 aa, Influenza virus
RTYNNTTG

SEQ ID NO: 296395 - protein, 8 aa, Influenza virus
VYNNTTGR

SEQ ID NO: 296396 - protein, 8 aa, Influenza virus
TGRDVLVI

SEQ ID NO: 296397 - protein, 8 aa, Influenza virus
GRDVLVIW

SEQ ID NO: 296398 - protein, 8 aa, Influenza virus
RDVLVIWG

SEQ ID NO: 296399 - protein, 8 aa, Influenza virus
DVLVIWGI

SEQ ID NO: 296400 - protein, 8 aa, Influenza virus
VLVIWGIH

SEQ ID NO: 296401 - protein, 8 aa, Influenza virus
LVIWGIHH

SEQ ID NO: 296402 - protein, 8 aa, Influenza virus
VIWGIHHP

SEQ ID NO: 296403 - protein, 8 aa, Influenza virus
WGIHHPIS

SEQ ID NO: 296404 - protein, 8 aa, Influenza virus
DPYTLVTT

SEQ ID NO: 296405 - protein, 8 aa, Influenza virus
PYTLVSTG

SEQ ID NO: 296406 - protein, 8 aa, Influenza virus
YTLVSTGS

SEQ ID NO: 296407 - protein, 8 aa, Influenza virus
TLVSTGSW

SEQ ID NO: 296408 - protein, 8 aa, Influenza virus
LVSTGSWS

SEQ ID NO: 296409 - protein, 8 aa, Influenza virus
GTRPGYNG

SEQ ID NO: 296410 - protein, 8 aa, Influenza virus
TRPGYNGQ

SEQ ID NO: 296411 - protein, 8 aa, Influenza virus
RPRYNGQR

SEQ ID NO: 296412 - protein, 8 aa, Influenza virus
PRYNGQRS

SEQ ID NO: 296413 - protein, 8 aa, Influenza virus
RYNGQRSW

SEQ ID NO: 296414 - protein, 8 aa, Influenza virus
YNGQKSWT

SEQ ID NO: 296415 - protein, 8 aa, Influenza virus
NGQKSWTK

SEQ ID NO: 296416 - protein, 8 aa, Influenza virus
GQKSWTKI

SEQ ID NO: 296417 - protein, 8 aa, Influenza virus
QKSWTKIY

SEQ ID NO: 296418 - protein, 8 aa, Influenza virus
KSWTKIYW

SEQ ID NO: 296419 - protein, 8 aa, Influenza virus
SWMKIYWV

SEQ ID NO: 296420 - protein, 8 aa, Influenza virus
WMKIYWVL

SEQ ID NO: 296421 - protein, 8 aa, Influenza virus
VSFESNGG

SEQ ID NO: 296422 - protein, 8 aa, Influenza virus
TFESNGGF

SEQ ID NO: 296423 - protein, 8 aa, Influenza virus
NGGFLAPR

SEQ ID NO: 296424 - protein, 8 aa, Influenza virus
GGFLAPRY

SEQ ID NO: 296425 - protein, 8 aa, Influenza virus
GFLAPRYG

SEQ ID NO: 296426 - protein, 8 aa, Influenza virus
FLAPRYGY

SEQ ID NO: 296427 - protein, 8 aa, Influenza virus
KGRIFQSH

SEQ ID NO: 296428 - protein, 8 aa, Influenza virus
GRIFQSHI

SEQ ID NO: 296429 - protein, 8 aa, Influenza virus
RIFQSHIR

SEQ ID NO: 296430 - protein, 8 aa, Influenza virus
RCNTRCQT

SEQ ID NO: 296431 - protein, 8 aa, Influenza virus
VGGIDTNK

SEQ ID NO: 296432 - protein, 8 aa, Influenza virus
GGIDTNKT

SEQ ID NO: 296433 - protein, 8 aa, Influenza virus
GIDTNKTF

SEQ ID NO: 296434 - protein, 8 aa, Influenza virus
IDTNKTFQ

SEQ ID NO: 296435 - protein, 8 aa, Influenza virus
DTNKTFQN

SEQ ID NO: 296436 - protein, 8 aa, Influenza virus
NKTFQNID

SEQ ID NO: 296437 - protein, 8 aa, Influenza virus
KTFQNIDK

SEQ ID NO: 296438 - protein, 8 aa, Influenza virus
TFQNIDRN

SEQ ID NO: 296439 - protein, 8 aa, Influenza virus
FQNIDRNA

SEQ ID NO: 296440 - protein, 8 aa, Influenza virus
QNIDRNAL

SEQ ID NO: 296441 - protein, 8 aa, Influenza virus
NIDRNALG

SEQ ID NO: 296442 - protein, 8 aa, Influenza virus
IERNALGN

SEQ ID NO: 296443 - protein, 8 aa, Influenza virus
ERNALGNC

SEQ ID NO: 296444 - protein, 8 aa, Influenza virus
RNALGNCP

SEQ ID NO: 296445 - protein, 8 aa, Influenza virus
NALGECPK

SEQ ID NO: 296446 - protein, 8 aa, Influenza virus
ALGECPKY

SEQ ID NO: 296447 - protein, 8 aa, Influenza virus
LGECPKYI

SEQ ID NO: 296448 - protein, 8 aa, Influenza virus
GECPKYIK

SEQ ID NO: 296449 - protein, 8 aa, Influenza virus
ECPKYIKS

SEQ ID NO: 296450 - protein, 8 aa, Influenza virus
LATGLKNV

SEQ ID NO: 296451 - protein, 8 aa, Influenza virus
ATGLKNVP

SEQ ID NO: 296452 - protein, 8 aa, Influenza virus
TGLRNIPA

SEQ ID NO: 296453 - protein, 8 aa, Influenza virus
RAVDGTIA

SEQ ID NO: 296454 - protein, 8 aa, Influenza virus
GLLGAIAG

SEQ ID NO: 296455 - protein, 8 aa, Influenza virus
FFGAIAGF

SEQ ID NO: 296456 - protein, 8 aa, Influenza virus
DGTIAGFI

SEQ ID NO: 296457 - protein, 8 aa, Influenza virus
QHQNEQGM

SEQ ID NO: 296458 - protein, 8 aa, Influenza virus
HQNEQGMG

SEQ ID NO: 296459 - protein, 8 aa, Influenza virus
QNEQGVGI

SEQ ID NO: 296460 - protein, 8 aa, Influenza virus
NEQGVGIA

SEQ ID NO: 296461 - protein, 8 aa, Influenza virus
EQGVGIAA

SEQ ID NO: 296462 - protein, 8 aa, Influenza virus
QGVGIAAD

SEQ ID NO: 296463 - protein, 8 aa, Influenza virus
GVGIAADK

SEQ ID NO: 296464 - protein, 8 aa, Influenza virus
VGIAADKE

SEQ ID NO: 296465 - protein, 8 aa, Influenza virus
GIAAEKES

SEQ ID NO: 296466 - protein, 8 aa, Influenza virus
IAAEKEST

SEQ ID NO: 296467 - protein, 8 aa, Influenza virus
GEFNQVEN

SEQ ID NO: 296468 - protein, 8 aa, Influenza virus
EFNQVENR

SEQ ID NO: 296469 - protein, 8 aa, Influenza virus
FNQVENRI

SEQ ID NO: 296470 - protein, 8 aa, Influenza virus
NQVENRIN

SEQ ID NO: 296471 - protein, 8 aa, Influenza virus
QVENRINM

SEQ ID NO: 296472 - protein, 8 aa, Influenza virus
VENRINML

SEQ ID NO: 296473 - protein, 8 aa, Influenza virus
ENRINMLA

SEQ ID NO: 296474 - protein, 8 aa, Influenza virus
NRINMLAD

SEQ ID NO: 296475 - protein, 8 aa, Influenza virus
DIWSYNAR

SEQ ID NO: 296476 - protein, 8 aa, Influenza virus
IWSYNARL

SEQ ID NO: 296477 - protein, 8 aa, Influenza virus
ENDKTLNM

SEQ ID NO: 296478 - protein, 8 aa, Influenza virus
NDKTLDLH

SEQ ID NO: 296479 - protein, 8 aa, Influenza virus
DKTLNMHD

SEQ ID NO: 296480 - protein, 8 aa, Influenza virus
KTLDLHDA

SEQ ID NO: 296481 - protein, 8 aa, Influenza virus
TLDLHDAN

SEQ ID NO: 296482 - protein, 8 aa, Influenza virus
LNMHDANV

SEQ ID NO: 296483 - protein, 8 aa, Influenza virus
NMHDANVR

SEQ ID NO: 296484 - protein, 8 aa, Influenza virus
LHDANVRN

SEQ ID NO: 296485 - protein, 8 aa, Influenza virus
ANVKNLHE

SEQ ID NO: 296486 - protein, 8 aa, Influenza virus
NVKNLHEQ

SEQ ID NO: 296487 - protein, 8 aa, Influenza virus
VKNLHEQV

SEQ ID NO: 296488 - protein, 8 aa, Influenza virus
KNLHEQVR

SEQ ID NO: 296489 - protein, 8 aa, Influenza virus
NLHDQIRR

SEQ ID NO: 296490 - protein, 8 aa, Influenza virus
NAINEGNG

SEQ ID NO: 296491 - protein, 8 aa, Influenza virus
AINEGNGC

SEQ ID NO: 296492 - protein, 8 aa, Influenza virus
INEGNGCF

SEQ ID NO: 296493 - protein, 8 aa, Influenza virus
LLHKCNNT

SEQ ID NO: 296494 - protein, 8 aa, Influenza virus
LHKCNNTC

SEQ ID NO: 296495 - protein, 8 aa, Influenza virus
HKCNNTCM

SEQ ID NO: 296496 - protein, 8 aa, Influenza virus
KCNDSCMD

SEQ ID NO: 296497 - protein, 8 aa, Influenza virus
CNDSCMDT

SEQ ID NO: 296498 - protein, 8 aa, Influenza virus
NNTCMETI

SEQ ID NO: 296499 - protein, 8 aa, Influenza virus
DSCMDTIR

SEQ ID NO: 296500 - protein, 8 aa, Influenza virus
TCMETIRN

SEQ ID NO: 296501 - protein, 8 aa, Influenza virus
RNGTYNHA

SEQ ID NO: 296502 - protein, 8 aa, Influenza virus
KYEEESKL

SEQ ID NO: 296503 - protein, 8 aa, Influenza virus
KLKRQEID

SEQ ID NO: 296504 - protein, 8 aa, Influenza virus
LKRQEIDG

SEQ ID NO: 296505 - protein, 8 aa, Influenza virus
KRQEIDGI

SEQ ID NO: 296506 - protein, 8 aa, Influenza virus
RQEIDGIK

SEQ ID NO: 296507 - protein, 8 aa, Influenza virus
QEIDGIKL

SEQ ID NO: 296508 - protein, 8 aa, Influenza virus
EIDGIKLK

SEQ ID NO: 296509 - protein, 8 aa, Influenza virus
IDGIKLKS

SEQ ID NO: 296510 - protein, 8 aa, Influenza virus
GIRLKSDD

SEQ ID NO: 296511 - protein, 8 aa, Influenza virus
LKSDDNVY

SEQ ID NO: 296512 - protein, 8 aa, Influenza virus
SDDNVYKA

SEQ ID NO: 296513 - protein, 8 aa, Influenza virus
DDNVYKAL

SEQ ID NO: 296514 - protein, 8 aa, Influenza virus
DGVYKALS

SEQ ID NO: 296515 - protein, 8 aa, Influenza virus
GVYKALSI

SEQ ID NO: 296516 - protein, 8 aa, Influenza virus
CIASSIVM

SEQ ID NO: 296517 - protein, 8 aa, Influenza virus
IASSIVMV

SEQ ID NO: 296518 - protein, 8 aa, Influenza virus
ASSIVMVG

SEQ ID NO: 296519 - protein, 8 aa, Influenza virus
SSIVMVGL

SEQ ID NO: 296520 - protein, 8 aa, Influenza virus
SIVMVGLI

SEQ ID NO: 296521 - protein, 8 aa, Influenza virus
IVMVGLIL

SEQ ID NO: 296522 - protein, 8 aa, Influenza virus
VMVGLILA

SEQ ID NO: 296523 - protein, 8 aa, Influenza virus
MVGLILAF

SEQ ID NO: 296524 - protein, 8 aa, Influenza virus
VGPILSFI

SEQ ID NO: 296525 - protein, 8 aa, Influenza virus
GPILSFIM

SEQ ID NO: 296526 - protein, 8 aa, Influenza virus
LILTFIMW

SEQ ID NO: 296527 - protein, 8 aa, Influenza virus
ILAFIMWT

SEQ ID NO: 296528 - protein, 8 aa, Influenza virus
LAFIMWTC

SEQ ID NO: 296529 - protein, 8 aa, Influenza virus
FIMWTCNS

SEQ ID NO: 296530 - protein, 8 aa, Influenza virus
IMWTCNSG

SEQ ID NO: 296531 - protein, 8 aa, Influenza virus
MWTCNSGN

SEQ ID NO: 296532 - protein, 8 aa, Influenza virus
WTCNSGNC

SEQ ID NO: 296533 - protein, 8 aa, Influenza virus
TCNSGNCR

SEQ ID NO: 296534 - protein, 8 aa, Influenza virus
CSNGSCRF

SEQ ID NO: 296535 - protein, 8 aa, Influenza virus
SNGSCRFN

SEQ ID NO: 296536 - protein, 8 aa, Influenza virus
MKWLSSSG

SEQ ID NO: 296537 - protein, 8 aa, Influenza virus
KWLSSSGN

SEQ ID NO: 296538 - protein, 8 aa, Influenza virus
WLSSSGNN

SEQ ID NO: 296539 - protein, 8 aa, Influenza virus
LLSSKDNQ

SEQ ID NO: 296540 - protein, 8 aa, Influenza virus
SSSGNNQV

SEQ ID NO: 296541 - protein, 8 aa, Influenza virus
SSKDNQVF

SEQ ID NO: 296542 - protein, 8 aa, Influenza virus
SKDNQVFP

SEQ ID NO: 296543 - protein, 8 aa, Influenza virus
GNNQVFPQ

SEQ ID NO: 296544 - protein, 8 aa, Influenza virus
DNQVFPQL

SEQ ID NO: 296545 - protein, 8 aa, Influenza virus
NVPEKIRV

SEQ ID NO: 296546 - protein, 8 aa, Influenza virus
VPEKIRVK

SEQ ID NO: 296547 - protein, 8 aa, Influenza virus
PEKIRVKR

SEQ ID NO: 296548 - protein, 8 aa, Influenza virus
EKIRVKRR

SEQ ID NO: 296549 - protein, 8 aa, Influenza virus
KIRVKRRP

SEQ ID NO: 296550 - protein, 8 aa, Influenza virus
IRVKRRPV

SEQ ID NO: 296551 - protein, 8 aa, Influenza virus
RVKRRPVA

SEQ ID NO: 296552 - protein, 8 aa, Influenza virus
GRYSIADK

SEQ ID NO: 296553 - protein, 8 aa, Influenza virus
RYSIADKI

SEQ ID NO: 296554 - protein, 8 aa, Influenza virus
YSIADKIC

SEQ ID NO: 296555 - protein, 8 aa, Influenza virus
SIADKICI

SEQ ID NO: 296556 - protein, 8 aa, Influenza virus
IADKICIG

SEQ ID NO: 296557 - protein, 8 aa, Influenza virus
GYLSNNAT

SEQ ID NO: 296558 - protein, 8 aa, Influenza virus
YLSNNATD

SEQ ID NO: 296559 - protein, 8 aa, Influenza virus
LSNNSTDT

SEQ ID NO: 296560 - protein, 8 aa, Influenza virus
SNNSTDTV

SEQ ID NO: 296561 - protein, 8 aa, Influenza virus
NNSTDTVD

SEQ ID NO: 296562 - protein, 8 aa, Influenza virus
NSTDTVDT

SEQ ID NO: 296563 - protein, 8 aa, Influenza virus
STDTVDTL

SEQ ID NO: 296564 - protein, 8 aa, Influenza virus
TDKVDTLT

SEQ ID NO: 296565 - protein, 8 aa, Influenza virus
DKIDTLTE

SEQ ID NO: 296566 - protein, 8 aa, Influenza virus
KIDTLTET

SEQ ID NO: 296567 - protein, 8 aa, Influenza virus
VDTLTETG

SEQ ID NO: 296568 - protein, 8 aa, Influenza virus
SLNGVSPV

SEQ ID NO: 296569 - protein, 8 aa, Influenza virus
LNGVSPVH

SEQ ID NO: 296570 - protein, 8 aa, Influenza virus
NGVSPVHL

SEQ ID NO: 296571 - protein, 8 aa, Influenza virus
GVSPVHLG

SEQ ID NO: 296572 - protein, 8 aa, Influenza virus
VSPVHLGD

SEQ ID NO: 296573 - protein, 8 aa, Influenza virus
DPNAPNKF

SEQ ID NO: 296574 - protein, 8 aa, Influenza virus
PNAPNKFC

SEQ ID NO: 296575 - protein, 8 aa, Influenza virus
NAPNKLCY

SEQ ID NO: 296576 - protein, 8 aa, Influenza virus
APNKLCYP

SEQ ID NO: 296577 - protein, 8 aa, Influenza virus
PNKLCYPG

SEQ ID NO: 296578 - protein, 8 aa, Influenza virus
NKLCYPGE

SEQ ID NO: 296579 - protein, 8 aa, Influenza virus
KLCFPGEV

SEQ ID NO: 296580 - protein, 8 aa, Influenza virus
LCFPGEVD

SEQ ID NO: 296581 - protein, 8 aa, Influenza virus
CFPGEVDN

SEQ ID NO: 296582 - protein, 8 aa, Influenza virus
FPGEVDNN

SEQ ID NO: 296583 - protein, 8 aa, Influenza virus
FSRTELIP

SEQ ID NO: 296584 - protein, 8 aa, Influenza virus
SRTELIPP

SEQ ID NO: 296585 - protein, 8 aa, Influenza virus
RTELINPS

SEQ ID NO: 296586 - protein, 8 aa, Influenza virus
TELIPPSK

SEQ ID NO: 296587 - protein, 8 aa, Influenza virus
ELINPSKW

SEQ ID NO: 296588 - protein, 8 aa, Influenza virus
LINPSKWG

SEQ ID NO: 296589 - protein, 8 aa, Influenza virus
PSKWGDVL

SEQ ID NO: 296590 - protein, 8 aa, Influenza virus
SKWGDVLD

SEQ ID NO: 296591 - protein, 8 aa, Influenza virus
KWGDVLDG

SEQ ID NO: 296592 - protein, 8 aa, Influenza virus
WGDVLDGV

SEQ ID NO: 296593 - protein, 8 aa, Influenza virus
GDVLDGVT

SEQ ID NO: 296594 - protein, 8 aa, Influenza virus
DVLDGVTA

SEQ ID NO: 296595 - protein, 8 aa, Influenza virus
ILDGVTAS

SEQ ID NO: 296596 - protein, 8 aa, Influenza virus
DGVTASCR

SEQ ID NO: 296597 - protein, 8 aa, Influenza virus
GVTASCRD

SEQ ID NO: 296598 - protein, 8 aa, Influenza virus
VTASCLDK

SEQ ID NO: 296599 - protein, 8 aa, Influenza virus
TASCLDKG

SEQ ID NO: 296600 - protein, 8 aa, Influenza virus
ASCLDKGA

SEQ ID NO: 296601 - protein, 8 aa, Influenza virus
GADSFYRN

SEQ ID NO: 296602 - protein, 8 aa, Influenza virus
AKSFYRNL

SEQ ID NO: 296603 - protein, 8 aa, Influenza virus
SSFYRNLI

SEQ ID NO: 296604 - protein, 8 aa, Influenza virus
FYRNLVWI

SEQ ID NO: 296605 - protein, 8 aa, Influenza virus
YRNLVWIV

SEQ ID NO: 296606 - protein, 8 aa, Influenza virus
RNLVWIVK

SEQ ID NO: 296607 - protein, 8 aa, Influenza virus
IKGDYNNT

SEQ ID NO: 296608 - protein, 8 aa, Influenza virus
RGDYNNTT

SEQ ID NO: 296609 - protein, 8 aa, Influenza virus
IHHPDSET

SEQ ID NO: 296610 - protein, 8 aa, Influenza virus
HHPDTEAT

SEQ ID NO: 296611 - protein, 8 aa, Influenza virus
HPDSETTA

SEQ ID NO: 296612 - protein, 8 aa, Influenza virus
ANKLYVNK

SEQ ID NO: 296613 - protein, 8 aa, Influenza virus
NKLYVNKN

SEQ ID NO: 296614 - protein, 8 aa, Influenza virus
NLYASKNP

SEQ ID NO: 296615 - protein, 8 aa, Influenza virus
EIGTRIGE

SEQ ID NO: 296616 - protein, 8 aa, Influenza virus
KLYWHLMH

SEQ ID NO: 296617 - protein, 8 aa, Influenza virus
LYWHLMHP

SEQ ID NO: 296618 - protein, 8 aa, Influenza virus
YWHLMSPG

SEQ ID NO: 296619 - protein, 8 aa, Influenza virus
WHLMSPGE

SEQ ID NO: 296620 - protein, 8 aa, Influenza virus
HLMSPGER

SEQ ID NO: 296621 - protein, 8 aa, Influenza virus
LMSPGERI

SEQ ID NO: 296622 - protein, 8 aa, Influenza virus
PGERTTFE

SEQ ID NO: 296623 - protein, 8 aa, Influenza virus
GERTTFES

SEQ ID NO: 296624 - protein, 8 aa, Influenza virus
ERITFESS

SEQ ID NO: 296625 - protein, 8 aa, Influenza virus
RITFESSG

SEQ ID NO: 296626 - protein, 8 aa, Influenza virus
ITFESSGG

SEQ ID NO: 296627 - protein, 8 aa, Influenza virus
TFESSGGL

SEQ ID NO: 296628 - protein, 8 aa, Influenza virus
FESSGGLL

SEQ ID NO: 296629 - protein, 8 aa, Influenza virus
ESSGGLLA

SEQ ID NO: 296630 - protein, 8 aa, Influenza virus
SSGGLLAP

SEQ ID NO: 296631 - protein, 8 aa, Influenza virus
SGGLLAPR

SEQ ID NO: 296632 - protein, 8 aa, Influenza virus
TGRIFQSR

SEQ ID NO: 296633 - protein, 8 aa, Influenza virus
GRIFQSRI

SEQ ID NO: 296634 - protein, 8 aa, Influenza virus
RIFQSRIR

SEQ ID NO: 296635 - protein, 8 aa, Influenza virus
IFQSGIRM

SEQ ID NO: 296636 - protein, 8 aa, Influenza virus
FQSGIRMA

SEQ ID NO: 296637 - protein, 8 aa, Influenza virus
RMARCNTK

SEQ ID NO: 296638 - protein, 8 aa, Influenza virus
MARCNTKC

SEQ ID NO: 296639 - protein, 8 aa, Influenza virus
GKCNTKCQ

SEQ ID NO: 296640 - protein, 8 aa, Influenza virus
NTKCQTSL

SEQ ID NO: 296641 - protein, 8 aa, Influenza virus
TKCQTSVG

SEQ ID NO: 296642 - protein, 8 aa, Influenza virus
KCQTSLGG

SEQ ID NO: 296643 - protein, 8 aa, Influenza virus
CQTSLGGI

SEQ ID NO: 296644 - protein, 8 aa, Influenza virus
GGIDTNKT

SEQ ID NO: 296645 - protein, 8 aa, Influenza virus
GIDTNKTF

SEQ ID NO: 296646 - protein, 8 aa, Influenza virus
IDTNKTFQ

SEQ ID NO: 296647 - protein, 8 aa, Influenza virus
KTFQNIEK

SEQ ID NO: 296648 - protein, 8 aa, Influenza virus
TFQNIEKN

SEQ ID NO: 296649 - protein, 8 aa, Influenza virus
FQNIEKNA

SEQ ID NO: 296650 - protein, 8 aa, Influenza virus
QNIEKNAL

SEQ ID NO: 296651 - protein, 8 aa, Influenza virus
NIEKNALG

SEQ ID NO: 296652 - protein, 8 aa, Influenza virus
IEKNALGD

SEQ ID NO: 296653 - protein, 8 aa, Influenza virus
EKNALGDC

SEQ ID NO: 296654 - protein, 8 aa, Influenza virus
KNALGDCP

SEQ ID NO: 296655 - protein, 8 aa, Influenza virus
GLRNVPSV

SEQ ID NO: 296656 - protein, 8 aa, Influenza virus
VERGLFGA

SEQ ID NO: 296657 - protein, 8 aa, Influenza virus
TGIAADKV

SEQ ID NO: 296658 - protein, 8 aa, Influenza virus
GIAADKVS

SEQ ID NO: 296659 - protein, 8 aa, Influenza virus
IAADKVST

SEQ ID NO: 296660 - protein, 8 aa, Influenza virus
AADKVSTQ

SEQ ID NO: 296661 - protein, 8 aa, Influenza virus
ADKVSTQK

SEQ ID NO: 296662 - protein, 8 aa, Influenza virus
DKVSTQKA

SEQ ID NO: 296663 - protein, 8 aa, Influenza virus
KVSTQKAI

SEQ ID NO: 296664 - protein, 8 aa, Influenza virus
TSTQKAIN

SEQ ID NO: 296665 - protein, 8 aa, Influenza virus
STQKALNE

SEQ ID NO: 296666 - protein, 8 aa, Influenza virus
TQKALNEI

SEQ ID NO: 296667 - protein, 8 aa, Influenza virus
QKALNEIT

SEQ ID NO: 296668 - protein, 8 aa, Influenza virus
KALNEITT

SEQ ID NO: 296669 - protein, 8 aa, Influenza virus
ALNEITTK

SEQ ID NO: 296670 - protein, 8 aa, Influenza virus
LNEITTKI

SEQ ID NO: 296671 - protein, 8 aa, Influenza virus
RINMLADW

SEQ ID NO: 296672 - protein, 8 aa, Influenza virus
INMLADWV

SEQ ID NO: 296673 - protein, 8 aa, Influenza virus
NMLADWVD

SEQ ID NO: 296674 - protein, 8 aa, Influenza virus
MLADWVDD

SEQ ID NO: 296675 - protein, 8 aa, Influenza virus
LADWVDDA

SEQ ID NO: 296676 - protein, 8 aa, Influenza virus
LLVLLEND

SEQ ID NO: 296677 - protein, 8 aa, Influenza virus
LVLLENDR

SEQ ID NO: 296678 - protein, 8 aa, Influenza virus
VLLENDRT

SEQ ID NO: 296679 - protein, 8 aa, Influenza virus
LLENDRTL

SEQ ID NO: 296680 - protein, 8 aa, Influenza virus
LENDRTLD

SEQ ID NO: 296681 - protein, 8 aa, Influenza virus
ENGRTLGL

SEQ ID NO: 296682 - protein, 8 aa, Influenza virus
NGRTLGLH

SEQ ID NO: 296683 - protein, 8 aa, Influenza virus
GRTLGLHD

SEQ ID NO: 296684 - protein, 8 aa, Influenza virus
GLHDANVR

SEQ ID NO: 296685 - protein, 8 aa, Influenza virus
ANVKNLHE

SEQ ID NO: 296686 - protein, 8 aa, Influenza virus
NVKNLHEQ

SEQ ID NO: 296687 - protein, 8 aa, Influenza virus
VRNLHDQI

SEQ ID NO: 296688 - protein, 8 aa, Influenza virus
RNLHDQIK

SEQ ID NO: 296689 - protein, 8 aa, Influenza virus
NLHEQIKR

SEQ ID NO: 296690 - protein, 8 aa, Influenza virus
LKDNAIDE

SEQ ID NO: 296691 - protein, 8 aa, Influenza virus
KSNAIDEG

SEQ ID NO: 296692 - protein, 8 aa, Influenza virus
DNAIDEGD

SEQ ID NO: 296693 - protein, 8 aa, Influenza virus
EGDGCFSL

SEQ ID NO: 296694 - protein, 8 aa, Influenza virus
GDGCFSLL

SEQ ID NO: 296695 - protein, 8 aa, Influenza virus
DGCFSLLH

SEQ ID NO: 296696 - protein, 8 aa, Influenza virus
GCFSLLHK

SEQ ID NO: 296697 - protein, 8 aa, Influenza virus
CFSLLHKC

SEQ ID NO: 296698 - protein, 8 aa, Influenza virus
FSLLHKCN

SEQ ID NO: 296699 - protein, 8 aa, Influenza virus
SLLHKCND

SEQ ID NO: 296700 - protein, 8 aa, Influenza virus
FFHKCNDS

SEQ ID NO: 296701 - protein, 8 aa, Influenza virus
REESQLKK

SEQ ID NO: 296702 - protein, 8 aa, Influenza virus
KLKSEDNV

SEQ ID NO: 296703 - protein, 8 aa, Influenza virus
LKSEDNVY

SEQ ID NO: 296704 - protein, 8 aa, Influenza virus
KSEDNVYK

SEQ ID NO: 296705 - protein, 8 aa, Influenza virus
TEDNIYKI

SEQ ID NO: 296706 - protein, 8 aa, Influenza virus
EDNIYKIL

SEQ ID NO: 296707 - protein, 8 aa, Influenza virus
DNIYKILS

SEQ ID NO: 296708 - protein, 8 aa, Influenza virus
NVYKVLAI

SEQ ID NO: 296709 - protein, 8 aa, Influenza virus
VYKVLAIY

SEQ ID NO: 296710 - protein, 8 aa, Influenza virus
YKVLAIYS

SEQ ID NO: 296711 - protein, 8 aa, Influenza virus
KVLAIYSC

SEQ ID NO: 296712 - protein, 8 aa, Influenza virus
VLAIYSCI

SEQ ID NO: 296713 - protein, 8 aa, Influenza virus
YSCIASSV

SEQ ID NO: 296714 - protein, 8 aa, Influenza virus
SCIASSVV

SEQ ID NO: 296715 - protein, 8 aa, Influenza virus
CIASSIVM

SEQ ID NO: 296716 - protein, 8 aa, Influenza virus
IASSIVLV

SEQ ID NO: 296717 - protein, 8 aa, Influenza virus
ASSIVLVG

SEQ ID NO: 296718 - protein, 8 aa, Influenza virus
SSIVMVGL

SEQ ID NO: 296719 - protein, 8 aa, Influenza virus
SIVMVGLI

SEQ ID NO: 296720 - protein, 8 aa, Influenza virus
IVMVGLIL

SEQ ID NO: 296721 - protein, 8 aa, Influenza virus
FILWACSS

SEQ ID NO: 296722 - protein, 8 aa, Influenza virus
ILWACSSG

SEQ ID NO: 296723 - protein, 8 aa, Influenza virus
LWACSSGN

SEQ ID NO: 296724 - protein, 8 aa, Influenza virus
WACSNGNC

SEQ ID NO: 296725 - protein, 8 aa, Influenza virus
ACSNGNCR

SEQ ID NO: 296726 - protein, 8 aa, Influenza virus
CSNGNCRF

SEQ ID NO: 296727 - protein, 8 aa, Influenza virus
SNGNCRFN

SEQ ID NO: 296728 - protein, 8 aa, Influenza virus
NGNCRFNV

SEQ ID NO: 296729 - protein, 8 aa, Influenza virus
GNCRFSVC

SEQ ID NO: 296730 - protein, 8 aa, Influenza virus
NCRFSVCI

SEQ ID NO: 296731 - protein, 8 aa, Influenza virus
QPNDGQVL

SEQ ID NO: 296732 - protein, 8 aa, Influenza virus
TKMEAILV

SEQ ID NO: 296733 - protein, 8 aa, Influenza virus
GFIENGWE

SEQ ID NO: 296734 - protein, 8 aa, Influenza virus
FIENGWEG

SEQ ID NO: 296735 - protein, 8 aa, Influenza virus
IENGWEGM

SEQ ID NO: 296736 - protein, 8 aa, Influenza virus
EGGWPGLI

SEQ ID NO: 296737 - protein, 8 aa, Influenza virus
GGWPGLIN

SEQ ID NO: 296738 - protein, 8 aa, Influenza virus
GWPGLING

SEQ ID NO: 296739 - protein, 8 aa, Influenza virus
WPGLINGW

SEQ ID NO: 296740 - protein, 8 aa, Influenza virus
PGLINGWY

SEQ ID NO: 296741 - protein, 8 aa, Influenza virus
GLINGWYG

SEQ ID NO: 296742 - protein, 8 aa, Influenza virus
LINGWYGF

SEQ ID NO: 296743 - protein, 8 aa, Influenza virus
INGWYGFQ

SEQ ID NO: 296744 - protein, 8 aa, Influenza virus
DGWYGFRH

SEQ ID NO: 296745 - protein, 8 aa, Influenza virus
GWYGFQHR

SEQ ID NO: 296746 - protein, 8 aa, Influenza virus
WYGFQHRN

SEQ ID NO: 296747 - protein, 8 aa, Influenza virus
QGTGQAAD

SEQ ID NO: 296748 - protein, 8 aa, Influenza virus
WSYNAQLL

SEQ ID NO: 296749 - protein, 8 aa, Influenza virus
YNAELLIL

SEQ ID NO: 296750 - protein, 8 aa, Influenza virus
NAELLILL

SEQ ID NO: 296751 - protein, 8 aa, Influenza virus
AELLILLE

SEQ ID NO: 296752 - protein, 8 aa, Influenza virus
ELLILLEN

SEQ ID NO: 296753 - protein, 8 aa, Influenza virus
LLILLENE

SEQ ID NO: 296754 - protein, 8 aa, Influenza virus
LLENEKTL

SEQ ID NO: 296755 - protein, 8 aa, Influenza virus
LENEKTLD

SEQ ID NO: 296756 - protein, 8 aa, Influenza virus
GNGCFTFY

SEQ ID NO: 296757 - protein, 8 aa, Influenza virus
NGCFTFYH

SEQ ID NO: 296758 - protein, 8 aa, Influenza virus
ILWFSFGA

SEQ ID NO: 296759 - protein, 8 aa, Influenza virus
LWFSFGAS

SEQ ID NO: 296760 - protein, 8 aa, Influenza virus
WFSFGASC

SEQ ID NO: 296761 - protein, 8 aa, Influenza virus
CTISLVKT

SEQ ID NO: 296762 - protein, 8 aa, Influenza virus
TISLVKTT

SEQ ID NO: 296763 - protein, 8 aa, Influenza virus
ICIDFRDM

SEQ ID NO: 296764 - protein, 8 aa, Influenza virus
CIDFRDMR

SEQ ID NO: 296765 - protein, 8 aa, Influenza virus
ILDQNFRN

SEQ ID NO: 296766 - protein, 8 aa, Influenza virus
ATKMEAIL

SEQ ID NO: 296767 - protein, 8 aa, Influenza virus
TKMKAIIV

SEQ ID NO: 296768 - protein, 8 aa, Influenza virus
KMKAIIVV

SEQ ID NO: 296769 - protein, 8 aa, Influenza virus
ADTICVGY

SEQ ID NO: 296770 - protein, 8 aa, Influenza virus
DTICVGYH

SEQ ID NO: 296771 - protein, 8 aa, Influenza virus
TICVGYHA

SEQ ID NO: 296772 - protein, 8 aa, Influenza virus
ICVGYHAN

SEQ ID NO: 296773 - protein, 8 aa, Influenza virus
TDTVDTLL

SEQ ID NO: 296774 - protein, 8 aa, Influenza virus
DTVDTLLE

SEQ ID NO: 296775 - protein, 8 aa, Influenza virus
TVDTVLER

SEQ ID NO: 296776 - protein, 8 aa, Influenza virus
VDTVLERN

SEQ ID NO: 296777 - protein, 8 aa, Influenza virus
DTVLERNV

SEQ ID NO: 296778 - protein, 8 aa, Influenza virus
TVLERNVT

SEQ ID NO: 296779 - protein, 8 aa, Influenza virus
VLERNVTV

SEQ ID NO: 296780 - protein, 8 aa, Influenza virus
TVTHSVDL

SEQ ID NO: 296781 - protein, 8 aa, Influenza virus
IAGWLLGN

SEQ ID NO: 296782 - protein, 8 aa, Influenza virus
GWILGNPK

SEQ ID NO: 296783 - protein, 8 aa, Influenza virus
WILGNPKC

SEQ ID NO: 296784 - protein, 8 aa, Influenza virus
LGNPECDL

SEQ ID NO: 296785 - protein, 8 aa, Influenza virus
SWSYIIET

SEQ ID NO: 296786 - protein, 8 aa, Influenza virus
DYEELKEQ

SEQ ID NO: 296787 - protein, 8 aa, Influenza virus
ELREQLST

SEQ ID NO: 296788 - protein, 8 aa, Influenza virus
LREQLSTV

SEQ ID NO: 296789 - protein, 8 aa, Influenza virus
REQLSTVS

SEQ ID NO: 296790 - protein, 8 aa, Influenza virus
EHLSSVSS

SEQ ID NO: 296791 - protein, 8 aa, Influenza virus
HLSSVSSF

SEQ ID NO: 296792 - protein, 8 aa, Influenza virus
LSSVSSFK

SEQ ID NO: 296793 - protein, 8 aa, Influenza virus
STVSSFER

SEQ ID NO: 296794 - protein, 8 aa, Influenza virus
TVSSFERF

SEQ ID NO: 296795 - protein, 8 aa, Influenza virus
VSSFKRFE

SEQ ID NO: 296796 - protein, 8 aa, Influenza virus
SSFERFEM

SEQ ID NO: 296797 - protein, 8 aa, Influenza virus
SFERFEMF

SEQ ID NO: 296798 - protein, 8 aa, Influenza virus
FERFEMFP

SEQ ID NO: 296799 - protein, 8 aa, Influenza virus
ERFEMFPK

SEQ ID NO: 296800 - protein, 8 aa, Influenza virus
SFYRNLIW

SEQ ID NO: 296801 - protein, 8 aa, Influenza virus
FYRNLIWL

SEQ ID NO: 296802 - protein, 8 aa, Influenza virus
VLVIWGVH

SEQ ID NO: 296803 - protein, 8 aa, Influenza virus
LVIWGVHH

SEQ ID NO: 296804 - protein, 8 aa, Influenza virus
VIWGVHHP

SEQ ID NO: 296805 - protein, 8 aa, Influenza virus
GRMNYHWT

SEQ ID NO: 296806 - protein, 8 aa, Influenza virus
RMNYHWTL

SEQ ID NO: 296807 - protein, 8 aa, Influenza virus
PGDTITFE

SEQ ID NO: 296808 - protein, 8 aa, Influenza virus
GDTITFEA

SEQ ID NO: 296809 - protein, 8 aa, Influenza virus
DTITFEAT

SEQ ID NO: 296810 - protein, 8 aa, Influenza virus
TITFEATG

SEQ ID NO: 296811 - protein, 8 aa, Influenza virus
IIFEATGN

SEQ ID NO: 296812 - protein, 8 aa, Influenza virus
IFEATGNL

SEQ ID NO: 296813 - protein, 8 aa, Influenza virus
FEATGNLI

SEQ ID NO: 296814 - protein, 8 aa, Influenza virus
EATGNLIA

SEQ ID NO: 296815 - protein, 8 aa, Influenza virus
ATGNLIAP

SEQ ID NO: 296816 - protein, 8 aa, Influenza virus
GALNSSLP

SEQ ID NO: 296817 - protein, 8 aa, Influenza virus
NTSLPFHN

SEQ ID NO: 296818 - protein, 8 aa, Influenza virus
SLPFHNIH

SEQ ID NO: 296819 - protein, 8 aa, Influenza virus
LPFHNIHP

SEQ ID NO: 296820 - protein, 8 aa, Influenza virus
NIHPVTIG

SEQ ID NO: 296821 - protein, 8 aa, Influenza virus
HPITIGEC

SEQ ID NO: 296822 - protein, 8 aa, Influenza virus
PITIGECP

SEQ ID NO: 296823 - protein, 8 aa, Influenza virus
ITIGECPK

SEQ ID NO: 296824 - protein, 8 aa, Influenza virus
GECPKYVK

SEQ ID NO: 296825 - protein, 8 aa, Influenza virus
ECPKYVKS

SEQ ID NO: 296826 - protein, 8 aa, Influenza virus
CPKYVRST

SEQ ID NO: 296827 - protein, 8 aa, Influenza virus
KLRMATGL

SEQ ID NO: 296828 - protein, 8 aa, Influenza virus
LRMATGLR

SEQ ID NO: 296829 - protein, 8 aa, Influenza virus
RMATGLRN

SEQ ID NO: 296830 - protein, 8 aa, Influenza virus
MATGLRNI

SEQ ID NO: 296831 - protein, 8 aa, Influenza virus
ATGLRNIP

SEQ ID NO: 296832 - protein, 8 aa, Influenza virus
RNIPSVQS

SEQ ID NO: 296833 - protein, 8 aa, Influenza virus
NIPSVQSR

SEQ ID NO: 296834 - protein, 8 aa, Influenza virus
IPSVQSRG

SEQ ID NO: 296835 - protein, 8 aa, Influenza virus
QNAQGSGY

SEQ ID NO: 296836 - protein, 8 aa, Influenza virus
GSGYAADR

SEQ ID NO: 296837 - protein, 8 aa, Influenza virus
SGYAADRK

SEQ ID NO: 296838 - protein, 8 aa, Influenza virus
GYAADRKS

SEQ ID NO: 296839 - protein, 8 aa, Influenza virus
YAADRKST

SEQ ID NO: 296840 - protein, 8 aa, Influenza virus
AADRKSTQ

SEQ ID NO: 296841 - protein, 8 aa, Influenza virus
KSTQIAID

SEQ ID NO: 296842 - protein, 8 aa, Influenza virus
DKITNKVN

SEQ ID NO: 296843 - protein, 8 aa, Influenza virus
KITNKVNS

SEQ ID NO: 296844 - protein, 8 aa, Influenza virus
ITNKVNSI

SEQ ID NO: 296845 - protein, 8 aa, Influenza virus
TNKVNSII

SEQ ID NO: 296846 - protein, 8 aa, Influenza virus
NKVNSVVE

SEQ ID NO: 296847 - protein, 8 aa, Influenza virus
KVNSVVEK

SEQ ID NO: 296848 - protein, 8 aa, Influenza virus
VNSVVEKM

SEQ ID NO: 296849 - protein, 8 aa, Influenza virus
SIIEKMNT

SEQ ID NO: 296850 - protein, 8 aa, Influenza virus
IIEKMNTQ

SEQ ID NO: 296851 - protein, 8 aa, Influenza virus
KMNIQFTA

SEQ ID NO: 296852 - protein, 8 aa, Influenza virus
MNIQFTAV

SEQ ID NO: 296853 - protein, 8 aa, Influenza virus
NIQFTAVG

SEQ ID NO: 296854 - protein, 8 aa, Influenza virus
IQFTAVGK

SEQ ID NO: 296855 - protein, 8 aa, Influenza virus
TSVGKEFN

SEQ ID NO: 296856 - protein, 8 aa, Influenza virus
LEKRMENL

SEQ ID NO: 296857 - protein, 8 aa, Influenza virus
EKRMENLN

SEQ ID NO: 296858 - protein, 8 aa, Influenza virus
RIENLNRK

SEQ ID NO: 296859 - protein, 8 aa, Influenza virus
IENLNKKI

SEQ ID NO: 296860 - protein, 8 aa, Influenza virus
ENLNRKVD

SEQ ID NO: 296861 - protein, 8 aa, Influenza virus
NLNRKVDD

SEQ ID NO: 296862 - protein, 8 aa, Influenza virus
LNRKVDDG

SEQ ID NO: 296863 - protein, 8 aa, Influenza virus
NKKVDDGL

SEQ ID NO: 296864 - protein, 8 aa, Influenza virus
KKIDDGFL

SEQ ID NO: 296865 - protein, 8 aa, Influenza virus
KIDDGFLD

SEQ ID NO: 296866 - protein, 8 aa, Influenza virus
DDGFLDVW

SEQ ID NO: 296867 - protein, 8 aa, Influenza virus
DGFLDVWT

SEQ ID NO: 296868 - protein, 8 aa, Influenza virus
GFLDVWTY

SEQ ID NO: 296869 - protein, 8 aa, Influenza virus
FLDVWTYN

SEQ ID NO: 296870 - protein, 8 aa, Influenza virus
LDVWTYNA

SEQ ID NO: 296871 - protein, 8 aa, Influenza virus
RTLDFHDL

SEQ ID NO: 296872 - protein, 8 aa, Influenza virus
QLNNNAKE

SEQ ID NO: 296873 - protein, 8 aa, Influenza virus
NNAKEVGN

SEQ ID NO: 296874 - protein, 8 aa, Influenza virus
NAKEVGNG

SEQ ID NO: 296875 - protein, 8 aa, Influenza virus
AKEVGNGC

SEQ ID NO: 296876 - protein, 8 aa, Influenza virus
KEVGNGCF

SEQ ID NO: 296877 - protein, 8 aa, Influenza virus
EVGNGCFE

SEQ ID NO: 296878 - protein, 8 aa, Influenza virus
VGNGCFEF

SEQ ID NO: 296879 - protein, 8 aa, Influenza virus
EFYHKCDD

SEQ ID NO: 296880 - protein, 8 aa, Influenza virus
CMESIKNG

SEQ ID NO: 296881 - protein, 8 aa, Influenza virus
MESIKNGT

SEQ ID NO: 296882 - protein, 8 aa, Influenza virus
SVRNGTYD

SEQ ID NO: 296883 - protein, 8 aa, Influenza virus
VRNGTYDY

SEQ ID NO: 296884 - protein, 8 aa, Influenza virus
RNGTYDYP

SEQ ID NO: 296885 - protein, 8 aa, Influenza virus
YDYPKYSK

SEQ ID NO: 296886 - protein, 8 aa, Influenza virus
DYPKYSKE

SEQ ID NO: 296887 - protein, 8 aa, Influenza virus
YPKYSKES

SEQ ID NO: 296888 - protein, 8 aa, Influenza virus
PKYSEESR

SEQ ID NO: 296889 - protein, 8 aa, Influenza virus
KYSEESRL

SEQ ID NO: 296890 - protein, 8 aa, Influenza virus
INGVKLES

SEQ ID NO: 296891 - protein, 8 aa, Influenza virus
IHQILAIY

SEQ ID NO: 296892 - protein, 8 aa, Influenza virus
YSTVASSS

SEQ ID NO: 296893 - protein, 8 aa, Influenza virus
STVASSSV

SEQ ID NO: 296894 - protein, 8 aa, Influenza virus
TVASSSVL

SEQ ID NO: 296895 - protein, 8 aa, Influenza virus
ASSSVLLV

SEQ ID NO: 296896 - protein, 8 aa, Influenza virus
SSSVLLVS

SEQ ID NO: 296897 - protein, 8 aa, Influenza virus
SSVLLVSL

SEQ ID NO: 296898 - protein, 8 aa, Influenza virus
SVLLVSLG

SEQ ID NO: 296899 - protein, 8 aa, Influenza virus
VLIVSLGA

SEQ ID NO: 296900 - protein, 8 aa, Influenza virus
LIVSLGAI

SEQ ID NO: 296901 - protein, 8 aa, Influenza virus
IVSLGAIS

SEQ ID NO: 296902 - protein, 8 aa, Influenza virus
VSFWMCSN

SEQ ID NO: 296903 - protein, 8 aa, Influenza virus
CSGHSCRI

SEQ ID NO: 296904 - protein, 8 aa, Influenza virus
SGHSCRIC

SEQ ID NO: 296905 - protein, 8 aa, Influenza virus
NGSLRCRI

SEQ ID NO: 296906 - protein, 8 aa, Influenza virus
GSLRCRIC

SEQ ID NO: 296907 - protein, 8 aa, Influenza virus
SLRCRICI

SEQ ID NO: 296908 - protein, 8 aa, Influenza virus
CRICIDFR

SEQ ID NO: 296909 - protein, 8 aa, Influenza virus
RICILDQN

SEQ ID NO: 296910 - protein, 8 aa, Influenza virus
GWAIHTKD

SEQ ID NO: 296911 - protein, 8 aa, Influenza virus
WAIHTKDN

SEQ ID NO: 296912 - protein, 8 aa, Influenza virus
AIYSKDNG

SEQ ID NO: 296913 - protein, 8 aa, Influenza virus
YSKDNSVR

SEQ ID NO: 296914 - protein, 8 aa, Influenza virus
SKDNSVRI

SEQ ID NO: 296915 - protein, 8 aa, Influenza virus
KDNGIRIG

SEQ ID NO: 296916 - protein, 8 aa, Influenza virus
DNGIRIGS

SEQ ID NO: 296917 - protein, 8 aa, Influenza virus
NGIRIGSK

SEQ ID NO: 296918 - protein, 8 aa, Influenza virus
GIRIGSKG

SEQ ID NO: 296919 - protein, 8 aa, Influenza virus
SKGDIFVM

SEQ ID NO: 296920 - protein, 8 aa, Influenza virus
KGDIFVMR

SEQ ID NO: 296921 - protein, 8 aa, Influenza virus
GDIFVMRE

SEQ ID NO: 296922 - protein, 8 aa, Influenza virus
DIFVMREP

SEQ ID NO: 296923 - protein, 8 aa, Influenza virus
IFVMREPF

SEQ ID NO: 296924 - protein, 8 aa, Influenza virus
EPFISCSQ

SEQ ID NO: 296925 - protein, 8 aa, Influenza virus
PFISCSQL

SEQ ID NO: 296926 - protein, 8 aa, Influenza virus
FISCSQLE

SEQ ID NO: 296927 - protein, 8 aa, Influenza virus
ISCSQLEC

SEQ ID NO: 296928 - protein, 8 aa, Influenza virus
SCSHLECK

SEQ ID NO: 296929 - protein, 8 aa, Influenza virus
HLECKTFF

SEQ ID NO: 296930 - protein, 8 aa, Influenza virus
DRHSNGTV

SEQ ID NO: 296931 - protein, 8 aa, Influenza virus
RHSNGTVK

SEQ ID NO: 296932 - protein, 8 aa, Influenza virus
HSNGTAKD

SEQ ID NO: 296933 - protein, 8 aa, Influenza virus
SNGTAKDR

SEQ ID NO: 296934 - protein, 8 aa, Influenza virus
NGTAKDRS

SEQ ID NO: 296935 - protein, 8 aa, Influenza virus
GTAKDRSP

SEQ ID NO: 296936 - protein, 8 aa, Influenza virus
KDRSPHRT

SEQ ID NO: 296937 - protein, 8 aa, Influenza virus
DRSPHRTL

SEQ ID NO: 296938 - protein, 8 aa, Influenza virus
HRTLMSCP

SEQ ID NO: 296939 - protein, 8 aa, Influenza virus
RTLMSCPV

SEQ ID NO: 296940 - protein, 8 aa, Influenza virus
TLMSCPVG

SEQ ID NO: 296941 - protein, 8 aa, Influenza virus
LMSCPVGE

SEQ ID NO: 296942 - protein, 8 aa, Influenza virus
MSCPIGEA

SEQ ID NO: 296943 - protein, 8 aa, Influenza virus
SCPIGEAP

SEQ ID NO: 296944 - protein, 8 aa, Influenza virus
CPIGEAPS

SEQ ID NO: 296945 - protein, 8 aa, Influenza virus
PIGEAPSP

SEQ ID NO: 296946 - protein, 8 aa, Influenza virus
IGEAPSPY

SEQ ID NO: 296947 - protein, 8 aa, Influenza virus
APSPYNSR

SEQ ID NO: 296948 - protein, 8 aa, Influenza virus
ASACHDGT

SEQ ID NO: 296949 - protein, 8 aa, Influenza virus
SWLTIGIS

SEQ ID NO: 296950 - protein, 8 aa, Influenza virus
KYNGIITE

SEQ ID NO: 296951 - protein, 8 aa, Influenza virus
YNGIITET

SEQ ID NO: 296952 - protein, 8 aa, Influenza virus
GIITETIK

SEQ ID NO: 296953 - protein, 8 aa, Influenza virus
IITETIKS

SEQ ID NO: 296954 - protein, 8 aa, Influenza virus
ITETIKSW

SEQ ID NO: 296955 - protein, 8 aa, Influenza virus
RILRTQES

SEQ ID NO: 296956 - protein, 8 aa, Influenza virus
QESECVCV

SEQ ID NO: 296957 - protein, 8 aa, Influenza virus
ESECVCVN

SEQ ID NO: 296958 - protein, 8 aa, Influenza virus
SECVCVNG

SEQ ID NO: 296959 - protein, 8 aa, Influenza virus
ECVCVNGS

SEQ ID NO: 296960 - protein, 8 aa, Influenza virus
CVCVNGSC

SEQ ID NO: 296961 - protein, 8 aa, Influenza virus
CINGSCFT

SEQ ID NO: 296962 - protein, 8 aa, Influenza virus
NGSCFTVL

SEQ ID NO: 296963 - protein, 8 aa, Influenza virus
GSCFTVLT

SEQ ID NO: 296964 - protein, 8 aa, Influenza virus
SCFTVLTD

SEQ ID NO: 296965 - protein, 8 aa, Influenza virus
CFTVLTDG

SEQ ID NO: 296966 - protein, 8 aa, Influenza virus
FTVLTDGP

SEQ ID NO: 296967 - protein, 8 aa, Influenza virus
TVLTDGPS

SEQ ID NO: 296968 - protein, 8 aa, Influenza virus
APNFYYEE

SEQ ID NO: 296969 - protein, 8 aa, Influenza virus
PNFYYEEC

SEQ ID NO: 296970 - protein, 8 aa, Influenza virus
NFYYEECS

SEQ ID NO: 296971 - protein, 8 aa, Influenza virus
FYYEECSC

SEQ ID NO: 296972 - protein, 8 aa, Influenza virus
ECSCYPDA

SEQ ID NO: 296973 - protein, 8 aa, Influenza virus
VVCVCRDN

SEQ ID NO: 296974 - protein, 8 aa, Influenza virus
VCVCRDNW

SEQ ID NO: 296975 - protein, 8 aa, Influenza virus
ASNRPWIS

SEQ ID NO: 296976 - protein, 8 aa, Influenza virus
RPWISFDQ

SEQ ID NO: 296977 - protein, 8 aa, Influenza virus
PWVSFNQD

SEQ ID NO: 296978 - protein, 8 aa, Influenza virus
WVSFNQDL

SEQ ID NO: 296979 - protein, 8 aa, Influenza virus
YQVGYICS

SEQ ID NO: 296980 - protein, 8 aa, Influenza virus
QVGYICSG

SEQ ID NO: 296981 - protein, 8 aa, Influenza virus
MGYICSGI

SEQ ID NO: 296982 - protein, 8 aa, Influenza virus
VFGDNPRS

SEQ ID NO: 296983 - protein, 8 aa, Influenza virus
GDNPRPED

SEQ ID NO: 296984 - protein, 8 aa, Influenza virus
GAYGVKGF

SEQ ID NO: 296985 - protein, 8 aa, Influenza virus
AYGVKGFS

SEQ ID NO: 296986 - protein, 8 aa, Influenza virus
DGVKGFSY

SEQ ID NO: 296987 - protein, 8 aa, Influenza virus
GVKGFSFR

SEQ ID NO: 296988 - protein, 8 aa, Influenza virus
VKGFSFRY

SEQ ID NO: 296989 - protein, 8 aa, Influenza virus
KGFSFRYG

SEQ ID NO: 296990 - protein, 8 aa, Influenza virus
GFSFRYGN

SEQ ID NO: 296991 - protein, 8 aa, Influenza virus
FSFRYGNG

SEQ ID NO: 296992 - protein, 8 aa, Influenza virus
SFRYGNGV

SEQ ID NO: 296993 - protein, 8 aa, Influenza virus
FRYGNGVW

SEQ ID NO: 296994 - protein, 8 aa, Influenza virus
KYDNGVWI

SEQ ID NO: 296995 - protein, 8 aa, Influenza virus
YGNGVWMG

SEQ ID NO: 296996 - protein, 8 aa, Influenza virus
GNGVWMGR

SEQ ID NO: 296997 - protein, 8 aa, Influenza virus
WIGRTKST

SEQ ID NO: 296998 - protein, 8 aa, Influenza virus
FEMVWDPN

SEQ ID NO: 296999 - protein, 8 aa, Influenza virus
NDWSGYSG

SEQ ID NO: 297000 - protein, 8 aa, Influenza virus
HPELTGLN

SEQ ID NO: 297001 - protein, 8 aa, Influenza virus
PELTGLNC

SEQ ID NO: 297002 - protein, 8 aa, Influenza virus
ELTGMNCI

SEQ ID NO: 297003 - protein, 8 aa, Influenza virus
NCIRPCFW

SEQ ID NO: 297004 - protein, 8 aa, Influenza virus
CIKPCFWV

SEQ ID NO: 297005 - protein, 8 aa, Influenza virus
IKPCFWVE

SEQ ID NO: 297006 - protein, 8 aa, Influenza virus
WVELIRGQ

SEQ ID NO: 297007 - protein, 8 aa, Influenza virus
VELIRGQP

SEQ ID NO: 297008 - protein, 8 aa, Influenza virus
TIWTSASS

SEQ ID NO: 297009 - protein, 8 aa, Influenza virus
IWTSGSII

SEQ ID NO: 297010 - protein, 8 aa, Influenza virus
WTSGSIIS

SEQ ID NO: 297011 - protein, 8 aa, Influenza virus
TSGSIISF

SEQ ID NO: 297012 - protein, 8 aa, Influenza virus
IISFCGVN

SEQ ID NO: 297013 - protein, 8 aa, Influenza virus
ISFCGVNG

SEQ ID NO: 297014 - protein, 8 aa, Influenza virus
SWSWPDGA

SEQ ID NO: 297015 - protein, 8 aa, Influenza virus
WSWPDGAK

SEQ ID NO: 297016 - protein, 8 aa, Influenza virus
SWPDGAKL

SEQ ID NO: 297017 - protein, 8 aa, Influenza virus
WPDGAKLP

SEQ ID NO: 297018 - protein, 8 aa, Influenza virus
PDGAKLPF

SEQ ID NO: 297019 - protein, 8 aa, Influenza virus
DGAKLPFT

SEQ ID NO: 297020 - protein, 8 aa, Influenza virus
GAKLPFTI

SEQ ID NO: 297021 - protein, 8 aa, Influenza virus
DTICVGYH

SEQ ID NO: 297022 - protein, 8 aa, Influenza virus
TICVGYHA

SEQ ID NO: 297023 - protein, 8 aa, Influenza virus
ICVGYHAN

SEQ ID NO: 297024 - protein, 8 aa, Influenza virus
ANNSTDTI

SEQ ID NO: 297025 - protein, 8 aa, Influenza virus
NNSTDTID

SEQ ID NO: 297026 - protein, 8 aa, Influenza virus
NSTDTIDT

SEQ ID NO: 297027 - protein, 8 aa, Influenza virus
EKNITVTH

SEQ ID NO: 297028 - protein, 8 aa, Influenza virus
KKLTVTHS

SEQ ID NO: 297029 - protein, 8 aa, Influenza virus
NVTVTHSI

SEQ ID NO: 297030 - protein, 8 aa, Influenza virus
VTVTHSIN

SEQ ID NO: 297031 - protein, 8 aa, Influenza virus
HNGKLCSL

SEQ ID NO: 297032 - protein, 8 aa, Influenza virus
IAGWILGN

SEQ ID NO: 297033 - protein, 8 aa, Influenza virus
AGWVLGNP

SEQ ID NO: 297034 - protein, 8 aa, Influenza virus
GWILGNPK

SEQ ID NO: 297035 - protein, 8 aa, Influenza virus
WILGNPKC

SEQ ID NO: 297036 - protein, 8 aa, Influenza virus
NYEELREH

SEQ ID NO: 297037 - protein, 8 aa, Influenza virus
YEELKEQL

SEQ ID NO: 297038 - protein, 8 aa, Influenza virus
EELREQLN

SEQ ID NO: 297039 - protein, 8 aa, Influenza virus
GRMDYYWT

SEQ ID NO: 297040 - protein, 8 aa, Influenza virus
HPFQNIHP

SEQ ID NO: 297041 - protein, 8 aa, Influenza virus
PFQNVHPI

SEQ ID NO: 297042 - protein, 8 aa, Influenza virus
FQNVHPIT

SEQ ID NO: 297043 - protein, 8 aa, Influenza virus
QNVHPITI

SEQ ID NO: 297044 - protein, 8 aa, Influenza virus
NVHPITIG

SEQ ID NO: 297045 - protein, 8 aa, Influenza virus
HPATIGEC

SEQ ID NO: 297046 - protein, 8 aa, Influenza virus
PATIGECP

SEQ ID NO: 297047 - protein, 8 aa, Influenza virus
ATIGECPK

SEQ ID NO: 297048 - protein, 8 aa, Influenza virus
GKCPKYVK

SEQ ID NO: 297049 - protein, 8 aa, Influenza virus
KCPKYVKS

SEQ ID NO: 297050 - protein, 8 aa, Influenza virus
LKMATGLR

SEQ ID NO: 297051 - protein, 8 aa, Influenza virus
KMATGLRN

SEQ ID NO: 297052 - protein, 8 aa, Influenza virus
TGLRNTPS

SEQ ID NO: 297053 - protein, 8 aa, Influenza virus
GLRNTPSI

SEQ ID NO: 297054 - protein, 8 aa, Influenza virus
PSVQSRGL

SEQ ID NO: 297055 - protein, 8 aa, Influenza virus
SIQTRGLF

SEQ ID NO: 297056 - protein, 8 aa, Influenza virus
IQSKGLFG

SEQ ID NO: 297057 - protein, 8 aa, Influenza virus
HSRGLFGA

SEQ ID NO: 297058 - protein, 8 aa, Influenza virus
SKGLFGAI

SEQ ID NO: 297059 - protein, 8 aa, Influenza virus
GGWTGMVN

SEQ ID NO: 297060 - protein, 8 aa, Influenza virus
GWTGMVNG

SEQ ID NO: 297061 - protein, 8 aa, Influenza virus
WTGMVNGW

SEQ ID NO: 297062 - protein, 8 aa, Influenza virus
TGMVNGWY

SEQ ID NO: 297063 - protein, 8 aa, Influenza virus
GMVNGWYG

SEQ ID NO: 297064 - protein, 8 aa, Influenza virus
MVNGWYGY

SEQ ID NO: 297065 - protein, 8 aa, Influenza virus
NDQGSGYA

SEQ ID NO: 297066 - protein, 8 aa, Influenza virus
DQGSGYAA

SEQ ID NO: 297067 - protein, 8 aa, Influenza virus
QGYGYAAD

SEQ ID NO: 297068 - protein, 8 aa, Influenza virus
SNKVNSVI

SEQ ID NO: 297069 - protein, 8 aa, Influenza virus
ESLNNKVD

SEQ ID NO: 297070 - protein, 8 aa, Influenza virus
SLNNKVDD

SEQ ID NO: 297071 - protein, 8 aa, Influenza virus
LNKKIDDG

SEQ ID NO: 297072 - protein, 8 aa, Influenza virus
NNKVDDGF

SEQ ID NO: 297073 - protein, 8 aa, Influenza virus
KIDDGFLD

SEQ ID NO: 297074 - protein, 8 aa, Influenza virus
DLWTYNAE

SEQ ID NO: 297075 - protein, 8 aa, Influenza virus
LWTYNAEL

SEQ ID NO: 297076 - protein, 8 aa, Influenza virus
ENERTLDL

SEQ ID NO: 297077 - protein, 8 aa, Influenza virus
NERTLDLH

SEQ ID NO: 297078 - protein, 8 aa, Influenza virus
ERTLDLHD

SEQ ID NO: 297079 - protein, 8 aa, Influenza virus
RTLDLHDS

SEQ ID NO: 297080 - protein, 8 aa, Influenza virus
TLDLHDSN

SEQ ID NO: 297081 - protein, 8 aa, Influenza virus
LDLHDSNV

SEQ ID NO: 297082 - protein, 8 aa, Influenza virus
QLKNNAQE

SEQ ID NO: 297083 - protein, 8 aa, Influenza virus
NNAKETGN

SEQ ID NO: 297084 - protein, 8 aa, Influenza virus
KVKEIGNG

SEQ ID NO: 297085 - protein, 8 aa, Influenza virus
AKETGNGC

SEQ ID NO: 297086 - protein, 8 aa, Influenza virus
REIGNGCF

SEQ ID NO: 297087 - protein, 8 aa, Influenza virus
FEFYHRCD

SEQ ID NO: 297088 - protein, 8 aa, Influenza virus
EFYHKCND

SEQ ID NO: 297089 - protein, 8 aa, Influenza virus
CMESVRNG

SEQ ID NO: 297090 - protein, 8 aa, Influenza virus
MESVRNGT

SEQ ID NO: 297091 - protein, 8 aa, Influenza virus
ESVRNGTY

SEQ ID NO: 297092 - protein, 8 aa, Influenza virus
SVKNGTYN

SEQ ID NO: 297093 - protein, 8 aa, Influenza virus
VKNGTYNY

SEQ ID NO: 297094 - protein, 8 aa, Influenza virus
YNILAIYS

SEQ ID NO: 297095 - protein, 8 aa, Influenza virus
NILAIYST

SEQ ID NO: 297096 - protein, 8 aa, Influenza virus
ILAVYSTV

SEQ ID NO: 297097 - protein, 8 aa, Influenza virus
GFWMCSNG

SEQ ID NO: 297098 - protein, 8 aa, Influenza virus
CPNGSLQC

SEQ ID NO: 297099 - protein, 8 aa, Influenza virus
SNGSLHGR

SEQ ID NO: 297100 - protein, 8 aa, Influenza virus
NGSLQCRV

SEQ ID NO: 297101 - protein, 8 aa, Influenza virus
GSLQCRVC

SEQ ID NO: 297102 - protein, 8 aa, Influenza virus
SLQCRVCI

SEQ ID NO: 297103 - protein, 8 aa, Influenza virus
YRDWSKPQ

SEQ ID NO: 297104 - protein, 8 aa, Influenza virus
RDWSKPQC

SEQ ID NO: 297105 - protein, 8 aa, Influenza virus
VTGFAPFS

SEQ ID NO: 297106 - protein, 8 aa, Influenza virus
TGFASFSK

SEQ ID NO: 297107 - protein, 8 aa, Influenza virus
IRLSASGD

SEQ ID NO: 297108 - protein, 8 aa, Influenza virus
RLSASGDV

SEQ ID NO: 297109 - protein, 8 aa, Influenza virus
VSAGGDIW

SEQ ID NO: 297110 - protein, 8 aa, Influenza virus
SAGGDIWI

SEQ ID NO: 297111 - protein, 8 aa, Influenza virus
AGGDIWIT

SEQ ID NO: 297112 - protein, 8 aa, Influenza virus
GGDIWITR

SEQ ID NO: 297113 - protein, 8 aa, Influenza virus
GDIWITRE

SEQ ID NO: 297114 - protein, 8 aa, Influenza virus
DIWITREP

SEQ ID NO: 297115 - protein, 8 aa, Influenza virus
IWITREPY

SEQ ID NO: 297116 - protein, 8 aa, Influenza virus
REPYVSCS

SEQ ID NO: 297117 - protein, 8 aa, Influenza virus
LGQGTTLK

SEQ ID NO: 297118 - protein, 8 aa, Influenza virus
GQGTTLKN

SEQ ID NO: 297119 - protein, 8 aa, Influenza virus
DRIPHRTL

SEQ ID NO: 297120 - protein, 8 aa, Influenza virus
RIPHRTLL

SEQ ID NO: 297121 - protein, 8 aa, Influenza virus
IPHRTLLM

SEQ ID NO: 297122 - protein, 8 aa, Influenza virus
SYRTLLMN

SEQ ID NO: 297123 - protein, 8 aa, Influenza virus
HRTLLMSE

SEQ ID NO: 297124 - protein, 8 aa, Influenza virus
NELGVPFY

SEQ ID NO: 297125 - protein, 8 aa, Influenza virus
ELGVPFYL

SEQ ID NO: 297126 - protein, 8 aa, Influenza virus
LGVPFYLG

SEQ ID NO: 297127 - protein, 8 aa, Influenza virus
GVPFYLGT

SEQ ID NO: 297128 - protein, 8 aa, Influenza virus
IPFHLGTK

SEQ ID NO: 297129 - protein, 8 aa, Influenza virus
PFYLGTRQ

SEQ ID NO: 297130 - protein, 8 aa, Influenza virus
FYLGTRQV

SEQ ID NO: 297131 - protein, 8 aa, Influenza virus
YLGTKQVC

SEQ ID NO: 297132 - protein, 8 aa, Influenza virus
LGTRQVCM

SEQ ID NO: 297133 - protein, 8 aa, Influenza virus
GTRQVCMA

SEQ ID NO: 297134 - protein, 8 aa, Influenza virus
TRQVCMAW

SEQ ID NO: 297135 - protein, 8 aa, Influenza virus
RQVCMAWS

SEQ ID NO: 297136 - protein, 8 aa, Influenza virus
SSSCHDGR

SEQ ID NO: 297137 - protein, 8 aa, Influenza virus
SSCHDGRA

SEQ ID NO: 297138 - protein, 8 aa, Influenza virus
SCHDGRAW

SEQ ID NO: 297139 - protein, 8 aa, Influenza virus
CHDGRAWL

SEQ ID NO: 297140 - protein, 8 aa, Influenza virus
HDGRAWLH

SEQ ID NO: 297141 - protein, 8 aa, Influenza virus
DGKSWLHV

SEQ ID NO: 297142 - protein, 8 aa, Influenza virus
GKSWLHVC

SEQ ID NO: 297143 - protein, 8 aa, Influenza virus
SWLHVCVT

SEQ ID NO: 297144 - protein, 8 aa, Influenza virus
NATASVIY

SEQ ID NO: 297145 - protein, 8 aa, Influenza virus
RILRTQES

SEQ ID NO: 297146 - protein, 8 aa, Influenza virus
RTHESECV

SEQ ID NO: 297147 - protein, 8 aa, Influenza virus
THESECVC

SEQ ID NO: 297148 - protein, 8 aa, Influenza virus
QESECVCV

SEQ ID NO: 297149 - protein, 8 aa, Influenza virus
ESECICIN

SEQ ID NO: 297150 - protein, 8 aa, Influenza virus
ICTVVMTD

SEQ ID NO: 297151 - protein, 8 aa, Influenza virus
CTVIMTDG

SEQ ID NO: 297152 - protein, 8 aa, Influenza virus
TVIMTDGS

SEQ ID NO: 297153 - protein, 8 aa, Influenza virus
IMIDGSAS

SEQ ID NO: 297154 - protein, 8 aa, Influenza virus
MTDGSGSG

SEQ ID NO: 297155 - protein, 8 aa, Influenza virus
GGAQHVEE

SEQ ID NO: 297156 - protein, 8 aa, Influenza virus
GAQHVEEC

SEQ ID NO: 297157 - protein, 8 aa, Influenza virus
ECSCYPRS

SEQ ID NO: 297158 - protein, 8 aa, Influenza virus
CSCYPRSP

SEQ ID NO: 297159 - protein, 8 aa, Influenza virus
CVCRDNWR

SEQ ID NO: 297160 - protein, 8 aa, Influenza virus
VCRDNWRG

SEQ ID NO: 297161 - protein, 8 aa, Influenza virus
WRGSNRPI

SEQ ID NO: 297162 - protein, 8 aa, Influenza virus
KGSNRPII

SEQ ID NO: 297163 - protein, 8 aa, Influenza virus
GSNRPIID

SEQ ID NO: 297164 - protein, 8 aa, Influenza virus
SNRPIIDI

SEQ ID NO: 297165 - protein, 8 aa, Influenza virus
SSYICSGL

SEQ ID NO: 297166 - protein, 8 aa, Influenza virus
SYICSGLV

SEQ ID NO: 297167 - protein, 8 aa, Influenza virus
YICSGLVG

SEQ ID NO: 297168 - protein, 8 aa, Influenza virus
ICSGLVGD

SEQ ID NO: 297169 - protein, 8 aa, Influenza virus
GNPGVKGW

SEQ ID NO: 297170 - protein, 8 aa, Influenza virus
NPGVKGWA

SEQ ID NO: 297171 - protein, 8 aa, Influenza virus
VKGWAFDY

SEQ ID NO: 297172 - protein, 8 aa, Influenza virus
DIWMGRTI

SEQ ID NO: 297173 - protein, 8 aa, Influenza virus
SRSGYETF

SEQ ID NO: 297174 - protein, 8 aa, Influenza virus
RSGYETFR

SEQ ID NO: 297175 - protein, 8 aa, Influenza virus
SGYETFRV

SEQ ID NO: 297176 - protein, 8 aa, Influenza virus
GYETFKVV

SEQ ID NO: 297177 - protein, 8 aa, Influenza virus
RSGYSGVF

SEQ ID NO: 297178 - protein, 8 aa, Influenza virus
GYSGIFSI

SEQ ID NO: 297179 - protein, 8 aa, Influenza virus
YSGIFSIE

SEQ ID NO: 297180 - protein, 8 aa, Influenza virus
RCINRCFY

SEQ ID NO: 297181 - protein, 8 aa, Influenza virus
VELIRGRN

SEQ ID NO: 297182 - protein, 8 aa, Influenza virus
VGWTSNSI

SEQ ID NO: 297183 - protein, 8 aa, Influenza virus
GWTSNSIV

SEQ ID NO: 297184 - protein, 8 aa, Influenza virus
NSVVVFCG

SEQ ID NO: 297185 - protein, 8 aa, Influenza virus
SIVEFCGT

SEQ ID NO: 297186 - protein, 8 aa, Influenza virus
IVVFCGTP

SEQ ID NO: 297187 - protein, 8 aa, Influenza virus
VVFCGASG

SEQ ID NO: 297188 - protein, 8 aa, Influenza virus
AFCGTSGT

SEQ ID NO: 297189 - protein, 8 aa, Influenza virus
FCSTSGTY

SEQ ID NO: 297190 - protein, 8 aa, Influenza virus
CGASGTYG

SEQ ID NO: 297191 - protein, 8 aa, Influenza virus
ASGTYGTG

SEQ ID NO: 297192 - protein, 8 aa, Influenza virus
GTYGSGSW

SEQ ID NO: 297193 - protein, 8 aa, Influenza virus
TYGSGSWP

SEQ ID NO: 297194 - protein, 8 aa, Influenza virus
YGSGSWPD

SEQ ID NO: 297195 - protein, 8 aa, Influenza virus
GSGSWPDG

SEQ ID NO: 297196 - protein, 8 aa, Influenza virus
SGSWPDGA

SEQ ID NO: 297197 - protein, 8 aa, Influenza virus
GTWPDGAD

SEQ ID NO: 297198 - protein, 8 aa, Influenza virus
TWPDGADI

SEQ ID NO: 297199 - protein, 8 aa, Influenza virus
MDNKTKKM

SEQ ID NO: 297200 - protein, 8 aa, Influenza virus
DKQTKTMT

SEQ ID NO: 297201 - protein, 8 aa, Influenza virus
KQTKTMTI

SEQ ID NO: 297202 - protein, 8 aa, Influenza virus
KTKKMTIT

SEQ ID NO: 297203 - protein, 8 aa, Influenza virus
GDRICIGY

SEQ ID NO: 297204 - protein, 8 aa, Influenza virus
DRICIGYH

SEQ ID NO: 297205 - protein, 8 aa, Influenza virus
QICVGYHS

SEQ ID NO: 297206 - protein, 8 aa, Influenza virus
ICVGYHSN

SEQ ID NO: 297207 - protein, 8 aa, Influenza virus
CVGYHSNN

SEQ ID NO: 297208 - protein, 8 aa, Influenza virus
VGYHSNNS

SEQ ID NO: 297209 - protein, 8 aa, Influenza virus
HANNSTET

SEQ ID NO: 297210 - protein, 8 aa, Influenza virus
NNSTERVD

SEQ ID NO: 297211 - protein, 8 aa, Influenza virus
NSTERVDT

SEQ ID NO: 297212 - protein, 8 aa, Influenza virus
IDTILEKN

SEQ ID NO: 297213 - protein, 8 aa, Influenza virus
DTILEKNV

SEQ ID NO: 297214 - protein, 8 aa, Influenza virus
TILEKNVT

SEQ ID NO: 297215 - protein, 8 aa, Influenza virus
ILEKNVTV

SEQ ID NO: 297216 - protein, 8 aa, Influenza virus
LEKNVTVT

SEQ ID NO: 297217 - protein, 8 aa, Influenza virus
EKNVTVTH

SEQ ID NO: 297218 - protein, 8 aa, Influenza virus
KNVTVTHA

SEQ ID NO: 297219 - protein, 8 aa, Influenza virus
VTVTHAKN

SEQ ID NO: 297220 - protein, 8 aa, Influenza virus
TVTHAKNI

SEQ ID NO: 297221 - protein, 8 aa, Influenza virus
VTHAKNIL

SEQ ID NO: 297222 - protein, 8 aa, Influenza virus
THAKNILE

SEQ ID NO: 297223 - protein, 8 aa, Influenza virus
HAKNILEK

SEQ ID NO: 297224 - protein, 8 aa, Influenza virus
DILEKVHN

SEQ ID NO: 297225 - protein, 8 aa, Influenza virus
ILERTHNG

SEQ ID NO: 297226 - protein, 8 aa, Influenza virus
LERTHNGK

SEQ ID NO: 297227 - protein, 8 aa, Influenza virus
ERTHNGKL

SEQ ID NO: 297228 - protein, 8 aa, Influenza virus
RTHNGKLC

SEQ ID NO: 297229 - protein, 8 aa, Influenza virus
VHNGKLCR

SEQ ID NO: 297230 - protein, 8 aa, Influenza virus
NGKLCRLR

SEQ ID NO: 297231 - protein, 8 aa, Influenza virus
GKLCRLRG

SEQ ID NO: 297232 - protein, 8 aa, Influenza virus
LRGIPPLE

SEQ ID NO: 297233 - protein, 8 aa, Influenza virus
RGIPPLEL

SEQ ID NO: 297234 - protein, 8 aa, Influenza virus
GIPPLVLG

SEQ ID NO: 297235 - protein, 8 aa, Influenza virus
IPPLVLGD

SEQ ID NO: 297236 - protein, 8 aa, Influenza virus
PPLVLGDC

SEQ ID NO: 297237 - protein, 8 aa, Influenza virus
PLVLGDCS

SEQ ID NO: 297238 - protein, 8 aa, Influenza virus
LVLGDCSI

SEQ ID NO: 297239 - protein, 8 aa, Influenza virus
VLGDCSIA

SEQ ID NO: 297240 - protein, 8 aa, Influenza virus
LGNPECDL

SEQ ID NO: 297241 - protein, 8 aa, Influenza virus
GNPECDLL

SEQ ID NO: 297242 - protein, 8 aa, Influenza virus
NPECDLLL

SEQ ID NO: 297243 - protein, 8 aa, Influenza virus
VPEWSYII

SEQ ID NO: 297244 - protein, 8 aa, Influenza virus
PEWSYIIE

SEQ ID NO: 297245 - protein, 8 aa, Influenza virus
EWSYIVER

SEQ ID NO: 297246 - protein, 8 aa, Influenza virus
WSYIVERE

SEQ ID NO: 297247 - protein, 8 aa, Influenza virus
LCYPGSLN

SEQ ID NO: 297248 - protein, 8 aa, Influenza virus
FNNYEELK

SEQ ID NO: 297249 - protein, 8 aa, Influenza virus
NNYEELKH

SEQ ID NO: 297250 - protein, 8 aa, Influenza virus
HFEKVRIL

SEQ ID NO: 297251 - protein, 8 aa, Influenza virus
PSFFRNMI

SEQ ID NO: 297252 - protein, 8 aa, Influenza virus
GSYNNTNG

SEQ ID NO: 297253 - protein, 8 aa, Influenza virus
SYNNTSGK

SEQ ID NO: 297254 - protein, 8 aa, Influenza virus
YNNTSGKQ

SEQ ID NO: 297255 - protein, 8 aa, Influenza virus
NNTSGEQI

SEQ ID NO: 297256 - protein, 8 aa, Influenza virus
NTSGEQIL

SEQ ID NO: 297257 - protein, 8 aa, Influenza virus
TSILNKRS

SEQ ID NO: 297258 - protein, 8 aa, Influenza virus
GLGGRMEF

SEQ ID NO: 297259 - protein, 8 aa, Influenza virus
RRMEFSWT

SEQ ID NO: 297260 - protein, 8 aa, Influenza virus
RMEFFWTL

SEQ ID NO: 297261 - protein, 8 aa, Influenza virus
MEFFWTLL

SEQ ID NO: 297262 - protein, 8 aa, Influenza virus
INFESNGN

SEQ ID NO: 297263 - protein, 8 aa, Influenza virus
NFESNGNL

SEQ ID NO: 297264 - protein, 8 aa, Influenza virus
FESNGNLI

SEQ ID NO: 297265 - protein, 8 aa, Influenza virus
ESNGNLIA

SEQ ID NO: 297266 - protein, 8 aa, Influenza virus
SNGNLIAP

SEQ ID NO: 297267 - protein, 8 aa, Influenza virus
NGNLIAPE

SEQ ID NO: 297268 - protein, 8 aa, Influenza virus
IAPEYGFR

SEQ ID NO: 297269 - protein, 8 aa, Influenza virus
FKISKRGN

SEQ ID NO: 297270 - protein, 8 aa, Influenza virus
RISKRGSS

SEQ ID NO: 297271 - protein, 8 aa, Influenza virus
ISKRGNSG

SEQ ID NO: 297272 - protein, 8 aa, Influenza virus
SKRGNSGI

SEQ ID NO: 297273 - protein, 8 aa, Influenza virus
KRGSSGIV

SEQ ID NO: 297274 - protein, 8 aa, Influenza virus
RGNSGIMK

SEQ ID NO: 297275 - protein, 8 aa, Influenza virus
GSSGIVKT

SEQ ID NO: 297276 - protein, 8 aa, Influenza virus
CETQCQTP

SEQ ID NO: 297277 - protein, 8 aa, Influenza virus
ETQCQTPL

SEQ ID NO: 297278 - protein, 8 aa, Influenza virus
TQCQTPLG

SEQ ID NO: 297279 - protein, 8 aa, Influenza virus
QCQTPLGA

SEQ ID NO: 297280 - protein, 8 aa, Influenza virus
CQSPLGAI

SEQ ID NO: 297281 - protein, 8 aa, Influenza virus
QSPLGAIN

SEQ ID NO: 297282 - protein, 8 aa, Influenza virus
SPLGAINT

SEQ ID NO: 297283 - protein, 8 aa, Influenza virus
FHNIHPLA

SEQ ID NO: 297284 - protein, 8 aa, Influenza virus
HNIHPLAI

SEQ ID NO: 297285 - protein, 8 aa, Influenza virus
NIHPLAIG

SEQ ID NO: 297286 - protein, 8 aa, Influenza virus
IHPLAIGE

SEQ ID NO: 297287 - protein, 8 aa, Influenza virus
GECPKYVR

SEQ ID NO: 297288 - protein, 8 aa, Influenza virus
ECPKYVRS

SEQ ID NO: 297289 - protein, 8 aa, Influenza virus
LILATGLR

SEQ ID NO: 297290 - protein, 8 aa, Influenza virus
VLAAGLRN

SEQ ID NO: 297291 - protein, 8 aa, Influenza virus
PQIEPRGL

SEQ ID NO: 297292 - protein, 8 aa, Influenza virus
QMESRGLF

SEQ ID NO: 297293 - protein, 8 aa, Influenza virus
IEPRGLFG

SEQ ID NO: 297294 - protein, 8 aa, Influenza virus
EARGLFGA

SEQ ID NO: 297295 - protein, 8 aa, Influenza virus
ARGLFGAI

SEQ ID NO: 297296 - protein, 8 aa, Influenza virus
SGYAADKA

SEQ ID NO: 297297 - protein, 8 aa, Influenza virus
ADKASTQK

SEQ ID NO: 297298 - protein, 8 aa, Influenza virus
DKASTQKA

SEQ ID NO: 297299 - protein, 8 aa, Influenza virus
NSVIEKIN

SEQ ID NO: 297300 - protein, 8 aa, Influenza virus
SVIEKINT

SEQ ID NO: 297301 - protein, 8 aa, Influenza virus
IIEKMNTQ

SEQ ID NO: 297302 - protein, 8 aa, Influenza virus
IEKMNIQF

SEQ ID NO: 297303 - protein, 8 aa, Influenza virus
EKINTQFE

SEQ ID NO: 297304 - protein, 8 aa, Influenza virus
VGKEFNSL

SEQ ID NO: 297305 - protein, 8 aa, Influenza virus
GKEFNSLE

SEQ ID NO: 297306 - protein, 8 aa, Influenza virus
SLERRLEN

SEQ ID NO: 297307 - protein, 8 aa, Influenza virus
EKRLGNLN

SEQ ID NO: 297308 - protein, 8 aa, Influenza virus
KRLGNLNK

SEQ ID NO: 297309 - protein, 8 aa, Influenza virus
RLENLSKR

SEQ ID NO: 297310 - protein, 8 aa, Influenza virus
LGNLNKKM

SEQ ID NO: 297311 - protein, 8 aa, Influenza virus
GNLNKKME

SEQ ID NO: 297312 - protein, 8 aa, Influenza virus
NLNKRMED

SEQ ID NO: 297313 - protein, 8 aa, Influenza virus
LSKRMEDG

SEQ ID NO: 297314 - protein, 8 aa, Influenza virus
DKKMEDGF

SEQ ID NO: 297315 - protein, 8 aa, Influenza virus
KKVEDGFL

SEQ ID NO: 297316 - protein, 8 aa, Influenza virus
VWTYNAEV

SEQ ID NO: 297317 - protein, 8 aa, Influenza virus
WTYNAEVL

SEQ ID NO: 297318 - protein, 8 aa, Influenza virus
TYNVELLV

SEQ ID NO: 297319 - protein, 8 aa, Influenza virus
YNAEVLVL

SEQ ID NO: 297320 - protein, 8 aa, Influenza virus
NVELLVLM

SEQ ID NO: 297321 - protein, 8 aa, Influenza virus
AEVLVLME

SEQ ID NO: 297322 - protein, 8 aa, Influenza virus
MENERTLE

SEQ ID NO: 297323 - protein, 8 aa, Influenza virus
ENEMTLDF

SEQ ID NO: 297324 - protein, 8 aa, Influenza virus
NEMTLDFH

SEQ ID NO: 297325 - protein, 8 aa, Influenza virus
EMTLDFHD

SEQ ID NO: 297326 - protein, 8 aa, Influenza virus
MTLDFHDS

SEQ ID NO: 297327 - protein, 8 aa, Influenza virus
TLEFHDSN

SEQ ID NO: 297328 - protein, 8 aa, Influenza virus
LGFHDSNV

SEQ ID NO: 297329 - protein, 8 aa, Influenza virus
DYHDSNVK

SEQ ID NO: 297330 - protein, 8 aa, Influenza virus
FHDSNVKS

SEQ ID NO: 297331 - protein, 8 aa, Influenza virus
HDSNVKSL

SEQ ID NO: 297332 - protein, 8 aa, Influenza virus
DSNVKSLY

SEQ ID NO: 297333 - protein, 8 aa, Influenza virus
SNVKSLYD

SEQ ID NO: 297334 - protein, 8 aa, Influenza virus
NLYNKVRM

SEQ ID NO: 297335 - protein, 8 aa, Influenza virus
LYEKVRMQ

SEQ ID NO: 297336 - protein, 8 aa, Influenza virus
YDRVRMQL

SEQ ID NO: 297337 - protein, 8 aa, Influenza virus
DRVRMQLR

SEQ ID NO: 297338 - protein, 8 aa, Influenza virus
RVRMQLRD

SEQ ID NO: 297339 - protein, 8 aa, Influenza virus
RMQLKDNA

SEQ ID NO: 297340 - protein, 8 aa, Influenza virus
MQLKDNAK

SEQ ID NO: 297341 - protein, 8 aa, Influenza virus
QLKDNAKE

SEQ ID NO: 297342 - protein, 8 aa, Influenza virus
LRDNAKEL

SEQ ID NO: 297343 - protein, 8 aa, Influenza virus
RDNAKELG

SEQ ID NO: 297344 - protein, 8 aa, Influenza virus
DNAKELGN

SEQ ID NO: 297345 - protein, 8 aa, Influenza virus
NAKELGNG

SEQ ID NO: 297346 - protein, 8 aa, Influenza virus
AKELGNGC

SEQ ID NO: 297347 - protein, 8 aa, Influenza virus
KEVGNGCF

SEQ ID NO: 297348 - protein, 8 aa, Influenza virus
ETGNGCFE

SEQ ID NO: 297349 - protein, 8 aa, Influenza virus
TGNGCFEF

SEQ ID NO: 297350 - protein, 8 aa, Influenza virus
EFYHKCND

SEQ ID NO: 297351 - protein, 8 aa, Influenza virus
FYHKCNDE

SEQ ID NO: 297352 - protein, 8 aa, Influenza virus
YHKCNDEC

SEQ ID NO: 297353 - protein, 8 aa, Influenza virus
HKCNDECM

SEQ ID NO: 297354 - protein, 8 aa, Influenza virus
KCDNECMD

SEQ ID NO: 297355 - protein, 8 aa, Influenza virus
CDNECMDS

SEQ ID NO: 297356 - protein, 8 aa, Influenza virus
SVRNGTYN

SEQ ID NO: 297357 - protein, 8 aa, Influenza virus
VRNGTYNY

SEQ ID NO: 297358 - protein, 8 aa, Influenza virus
NGTYNYPK

SEQ ID NO: 297359 - protein, 8 aa, Influenza virus
GTYNYPKY

SEQ ID NO: 297360 - protein, 8 aa, Influenza virus
TYNYPKYE

SEQ ID NO: 297361 - protein, 8 aa, Influenza virus
YNYPKYEE

SEQ ID NO: 297362 - protein, 8 aa, Influenza virus
NYPKYEEE

SEQ ID NO: 297363 - protein, 8 aa, Influenza virus
PKYEEESR

SEQ ID NO: 297364 - protein, 8 aa, Influenza virus
YEEESRLN

SEQ ID NO: 297365 - protein, 8 aa, Influenza virus
EEESRLNR

SEQ ID NO: 297366 - protein, 8 aa, Influenza virus
EESKLNRT

SEQ ID NO: 297367 - protein, 8 aa, Influenza virus
ESKLNRTE

SEQ ID NO: 297368 - protein, 8 aa, Influenza virus
SKLNRTEI

SEQ ID NO: 297369 - protein, 8 aa, Influenza virus
KLNRTEIK

SEQ ID NO: 297370 - protein, 8 aa, Influenza virus
LNRTEIKG

SEQ ID NO: 297371 - protein, 8 aa, Influenza virus
SEIKGVKL

SEQ ID NO: 297372 - protein, 8 aa, Influenza virus
EIKGVELS

SEQ ID NO: 297373 - protein, 8 aa, Influenza virus
MGAYQILA

SEQ ID NO: 297374 - protein, 8 aa, Influenza virus
GVYQILVI

SEQ ID NO: 297375 - protein, 8 aa, Influenza virus
VYQILVIY

SEQ ID NO: 297376 - protein, 8 aa, Influenza virus
SLSLAIMV

SEQ ID NO: 297377 - protein, 8 aa, Influenza virus
LSLAIMVA

SEQ ID NO: 297378 - protein, 8 aa, Influenza virus
SLAIMVAG

SEQ ID NO: 297379 - protein, 8 aa, Influenza virus
LAIMVAGI

SEQ ID NO: 297380 - protein, 8 aa, Influenza virus
AIMVAGIS

SEQ ID NO: 297381 - protein, 8 aa, Influenza virus
AGISIWMC

SEQ ID NO: 297382 - protein, 8 aa, Influenza virus
GISIWMCS

SEQ ID NO: 297383 - protein, 8 aa, Influenza virus
ISIWMCSN

SEQ ID NO: 297384 - protein, 8 aa, Influenza virus
SIWMCSNG

SEQ ID NO: 297385 - protein, 8 aa, Influenza virus
IWMCSNGS

SEQ ID NO: 297386 - protein, 8 aa, Influenza virus
VRGDQICV

SEQ ID NO: 297387 - protein, 8 aa, Influenza virus
RGDQICVG

SEQ ID NO: 297388 - protein, 8 aa, Influenza virus
GDRICIGY

SEQ ID NO: 297389 - protein, 8 aa, Influenza virus
DRICIGYH

SEQ ID NO: 297390 - protein, 8 aa, Influenza virus
QICVGYHS

SEQ ID NO: 297391 - protein, 8 aa, Influenza virus
ICVGYHSN

SEQ ID NO: 297392 - protein, 8 aa, Influenza virus
CVGYHSNN

SEQ ID NO: 297393 - protein, 8 aa, Influenza virus
VGYHSNNS

SEQ ID NO: 297394 - protein, 8 aa, Influenza virus
HANNSTET

SEQ ID NO: 297395 - protein, 8 aa, Influenza virus
NNSTEKAD

SEQ ID NO: 297396 - protein, 8 aa, Influenza virus
NSTEMVDT

SEQ ID NO: 297397 - protein, 8 aa, Influenza virus
KIDTILER

SEQ ID NO: 297398 - protein, 8 aa, Influenza virus
IDTILERN

SEQ ID NO: 297399 - protein, 8 aa, Influenza virus
VTVTHAKN

SEQ ID NO: 297400 - protein, 8 aa, Influenza virus
TVTHAKNI

SEQ ID NO: 297401 - protein, 8 aa, Influenza virus
VTHAKNIL

SEQ ID NO: 297402 - protein, 8 aa, Influenza virus
THAKNILE

SEQ ID NO: 297403 - protein, 8 aa, Influenza virus
HAKNILEK

SEQ ID NO: 297404 - protein, 8 aa, Influenza virus
AKNILEKT

SEQ ID NO: 297405 - protein, 8 aa, Influenza virus
KNILEKTH

SEQ ID NO: 297406 - protein, 8 aa, Influenza virus
DILEKAHN

SEQ ID NO: 297407 - protein, 8 aa, Influenza virus
LEKAHNGK

SEQ ID NO: 297408 - protein, 8 aa, Influenza virus
EKTHNGRL

SEQ ID NO: 297409 - protein, 8 aa, Influenza virus
KTHNGRLC

SEQ ID NO: 297410 - protein, 8 aa, Influenza virus
AHNGKLCR

SEQ ID NO: 297411 - protein, 8 aa, Influenza virus
NGKLCRLR

SEQ ID NO: 297412 - protein, 8 aa, Influenza virus
GKLCRLRG

SEQ ID NO: 297413 - protein, 8 aa, Influenza virus
KLCRLRGI

SEQ ID NO: 297414 - protein, 8 aa, Influenza virus
LCRLRGIP

SEQ ID NO: 297415 - protein, 8 aa, Influenza virus
CRLRGIPP

SEQ ID NO: 297416 - protein, 8 aa, Influenza virus
RLRGIPPL

SEQ ID NO: 297417 - protein, 8 aa, Influenza virus
LRGIPPLE

SEQ ID NO: 297418 - protein, 8 aa, Influenza virus
RGIPPLEL

SEQ ID NO: 297419 - protein, 8 aa, Influenza virus
PECDRLLT

SEQ ID NO: 297420 - protein, 8 aa, Influenza virus
LTVPEWSY

SEQ ID NO: 297421 - protein, 8 aa, Influenza virus
TVPEWSYI

SEQ ID NO: 297422 - protein, 8 aa, Influenza virus
VPEWSYII

SEQ ID NO: 297423 - protein, 8 aa, Influenza virus
PEWSYIIE

SEQ ID NO: 297424 - protein, 8 aa, Influenza virus
EWSYIVEK

SEQ ID NO: 297425 - protein, 8 aa, Influenza virus
WSYIVEKE

SEQ ID NO: 297426 - protein, 8 aa, Influenza virus
SYIVERET

SEQ ID NO: 297427 - protein, 8 aa, Influenza virus
YIVERETP

SEQ ID NO: 297428 - protein, 8 aa, Influenza virus
YSLCYPGS

SEQ ID NO: 297429 - protein, 8 aa, Influenza virus
SLCYPGSL

SEQ ID NO: 297430 - protein, 8 aa, Influenza virus
LCYPGNFN

SEQ ID NO: 297431 - protein, 8 aa, Influenza virus
CYPGSLND

SEQ ID NO: 297432 - protein, 8 aa, Influenza virus
YPGNFNDY

SEQ ID NO: 297433 - protein, 8 aa, Influenza virus
PGNFNDYE

SEQ ID NO: 297434 - protein, 8 aa, Influenza virus
GSLNDYEE

SEQ ID NO: 297435 - protein, 8 aa, Influenza virus
NFNDYEEL

SEQ ID NO: 297436 - protein, 8 aa, Influenza virus
LNDYEELK

SEQ ID NO: 297437 - protein, 8 aa, Influenza virus
NDYEELKL

SEQ ID NO: 297438 - protein, 8 aa, Influenza virus
DYEELKHF

SEQ ID NO: 297439 - protein, 8 aa, Influenza virus
YEELKHFL

SEQ ID NO: 297440 - protein, 8 aa, Influenza virus
SVRHFEKV

SEQ ID NO: 297441 - protein, 8 aa, Influenza virus
VKHFEKVR

SEQ ID NO: 297442 - protein, 8 aa, Influenza virus
KHFEKVRI

SEQ ID NO: 297443 - protein, 8 aa, Influenza virus
HFEKIKIL

SEQ ID NO: 297444 - protein, 8 aa, Influenza virus
FEKVKILA

SEQ ID NO: 297445 - protein, 8 aa, Influenza virus
EKVRILPK

SEQ ID NO: 297446 - protein, 8 aa, Influenza virus
KVRILPKD

SEQ ID NO: 297447 - protein, 8 aa, Influenza virus
PSFFRNMI

SEQ ID NO: 297448 - protein, 8 aa, Influenza virus
VAKRSYNN

SEQ ID NO: 297449 - protein, 8 aa, Influenza virus
ARGSYNNT

SEQ ID NO: 297450 - protein, 8 aa, Influenza virus
QGSYNNTS

SEQ ID NO: 297451 - protein, 8 aa, Influenza virus
GSYNNTNG

SEQ ID NO: 297452 - protein, 8 aa, Influenza virus
NNTSGEQV

SEQ ID NO: 297453 - protein, 8 aa, Influenza virus
NTSGKQML

SEQ ID NO: 297454 - protein, 8 aa, Influenza virus
TNGEQILI

SEQ ID NO: 297455 - protein, 8 aa, Influenza virus
NGEQILII

SEQ ID NO: 297456 - protein, 8 aa, Influenza virus
GEQILIIW

SEQ ID NO: 297457 - protein, 8 aa, Influenza virus
EQILIIWG

SEQ ID NO: 297458 - protein, 8 aa, Influenza virus
LVIWGIHH

SEQ ID NO: 297459 - protein, 8 aa, Influenza virus
VIWGIHHP

SEQ ID NO: 297460 - protein, 8 aa, Influenza virus
IWGVHHPI

SEQ ID NO: 297461 - protein, 8 aa, Influenza virus
WGVHHPID

SEQ ID NO: 297462 - protein, 8 aa, Influenza virus
GVHHPIDE

SEQ ID NO: 297463 - protein, 8 aa, Influenza virus
LYQEVGTY

SEQ ID NO: 297464 - protein, 8 aa, Influenza virus
YQEVGTYV

SEQ ID NO: 297465 - protein, 8 aa, Influenza virus
QEVGTYVS

SEQ ID NO: 297466 - protein, 8 aa, Influenza virus
TSKLNKRS

SEQ ID NO: 297467 - protein, 8 aa, Influenza virus
GLGGRMEF

SEQ ID NO: 297468 - protein, 8 aa, Influenza virus
RMEFFWTL

SEQ ID NO: 297469 - protein, 8 aa, Influenza virus
MEFFWTLL

SEQ ID NO: 297470 - protein, 8 aa, Influenza virus
WDVISFES

SEQ ID NO: 297471 - protein, 8 aa, Influenza virus
DVISFEST

SEQ ID NO: 297472 - protein, 8 aa, Influenza virus
VISFESTG

SEQ ID NO: 297473 - protein, 8 aa, Influenza virus
IAPEYGFR

SEQ ID NO: 297474 - protein, 8 aa, Influenza virus
FRISKRGS

SEQ ID NO: 297475 - protein, 8 aa, Influenza virus
RISKRGSS

SEQ ID NO: 297476 - protein, 8 aa, Influenza virus
SKRGSSGV

SEQ ID NO: 297477 - protein, 8 aa, Influenza virus
KRGSSGVM

SEQ ID NO: 297478 - protein, 8 aa, Influenza virus
RGSSGVMK

SEQ ID NO: 297479 - protein, 8 aa, Influenza virus
GSSGVMKT

SEQ ID NO: 297480 - protein, 8 aa, Influenza virus
SSGIMKTG

SEQ ID NO: 297481 - protein, 8 aa, Influenza virus
SGIMKTGG

SEQ ID NO: 297482 - protein, 8 aa, Influenza virus
GIMKTGGT

SEQ ID NO: 297483 - protein, 8 aa, Influenza virus
IMKTGGTL

SEQ ID NO: 297484 - protein, 8 aa, Influenza virus
MKTEKTLE

SEQ ID NO: 297485 - protein, 8 aa, Influenza virus
EDCETKCQ

SEQ ID NO: 297486 - protein, 8 aa, Influenza virus
DCETKCQT

SEQ ID NO: 297487 - protein, 8 aa, Influenza virus
CDTKCQTP

SEQ ID NO: 297488 - protein, 8 aa, Influenza virus
DTKCQTPL

SEQ ID NO: 297489 - protein, 8 aa, Influenza virus
TQCQTPLG

SEQ ID NO: 297490 - protein, 8 aa, Influenza virus
CQSPLGAI

SEQ ID NO: 297491 - protein, 8 aa, Influenza virus
QSPLGAIN

SEQ ID NO: 297492 - protein, 8 aa, Influenza virus
SPLGAINT

SEQ ID NO: 297493 - protein, 8 aa, Influenza virus
HNIHPLTM

SEQ ID NO: 297494 - protein, 8 aa, Influenza virus
NVHPLAIG

SEQ ID NO: 297495 - protein, 8 aa, Influenza virus
IHPLTMGE

SEQ ID NO: 297496 - protein, 8 aa, Influenza virus
LTIGECPR

SEQ ID NO: 297497 - protein, 8 aa, Influenza virus
TIGECPRY

SEQ ID NO: 297498 - protein, 8 aa, Influenza virus
CPKYVRSE

SEQ ID NO: 297499 - protein, 8 aa, Influenza virus
PKYVKSER

SEQ ID NO: 297500 - protein, 8 aa, Influenza virus
KYVKSERL

SEQ ID NO: 297501 - protein, 8 aa, Influenza virus
YVKSERLV

SEQ ID NO: 297502 - protein, 8 aa, Influenza virus
VKSERLVL

SEQ ID NO: 297503 - protein, 8 aa, Influenza virus
KSERLVLA

SEQ ID NO: 297504 - protein, 8 aa, Influenza virus
SERLVLAT

SEQ ID NO: 297505 - protein, 8 aa, Influenza virus
ERLVLATG

SEQ ID NO: 297506 - protein, 8 aa, Influenza virus
KLVLATGP

SEQ ID NO: 297507 - protein, 8 aa, Influenza virus
LATGPRNV

SEQ ID NO: 297508 - protein, 8 aa, Influenza virus
ATGPRNVP

SEQ ID NO: 297509 - protein, 8 aa, Influenza virus
TGPRNVPQ

SEQ ID NO: 297510 - protein, 8 aa, Influenza virus
GPRNVPQI

SEQ ID NO: 297511 - protein, 8 aa, Influenza virus
PRNVPQIE

SEQ ID NO: 297512 - protein, 8 aa, Influenza virus
RNVPQMES

SEQ ID NO: 297513 - protein, 8 aa, Influenza virus
NVPQMESR

SEQ ID NO: 297514 - protein, 8 aa, Influenza virus
VPQMESRG

SEQ ID NO: 297515 - protein, 8 aa, Influenza virus
PQIEARGL

SEQ ID NO: 297516 - protein, 8 aa, Influenza virus
QIEARGLF

SEQ ID NO: 297517 - protein, 8 aa, Influenza virus
IEARGLFG

SEQ ID NO: 297518 - protein, 8 aa, Influenza virus
AGYAADKE

SEQ ID NO: 297519 - protein, 8 aa, Influenza virus
ADKESTQR

SEQ ID NO: 297520 - protein, 8 aa, Influenza virus
DKESTQRA

SEQ ID NO: 297521 - protein, 8 aa, Influenza virus
KASTQKAI

SEQ ID NO: 297522 - protein, 8 aa, Influenza virus
VNFVIEKM

SEQ ID NO: 297523 - protein, 8 aa, Influenza virus
NFVIEKMN

SEQ ID NO: 297524 - protein, 8 aa, Influenza virus
SVIEKMNI

SEQ ID NO: 297525 - protein, 8 aa, Influenza virus
VIEKMNIQ

SEQ ID NO: 297526 - protein, 8 aa, Influenza virus
IEKMNTQS

SEQ ID NO: 297527 - protein, 8 aa, Influenza virus
EKMNTQFG

SEQ ID NO: 297528 - protein, 8 aa, Influenza virus
AVGKEFGN

SEQ ID NO: 297529 - protein, 8 aa, Influenza virus
VEKEFSNL

SEQ ID NO: 297530 - protein, 8 aa, Influenza virus
EKEFSNLE

SEQ ID NO: 297531 - protein, 8 aa, Influenza virus
KEFNNLER

SEQ ID NO: 297532 - protein, 8 aa, Influenza virus
EFNNLERR

SEQ ID NO: 297533 - protein, 8 aa, Influenza virus
FNNLERRL

SEQ ID NO: 297534 - protein, 8 aa, Influenza virus
NNLERRLE

SEQ ID NO: 297535 - protein, 8 aa, Influenza virus
EKRLENLD

SEQ ID NO: 297536 - protein, 8 aa, Influenza virus
KRLENLDK

SEQ ID NO: 297537 - protein, 8 aa, Influenza virus
RLENLNKR

SEQ ID NO: 297538 - protein, 8 aa, Influenza virus
LENLDKKM

SEQ ID NO: 297539 - protein, 8 aa, Influenza virus
GNLNKKME

SEQ ID NO: 297540 - protein, 8 aa, Influenza virus
NLNKRMED

SEQ ID NO: 297541 - protein, 8 aa, Influenza virus
LSKRMEDG

SEQ ID NO: 297542 - protein, 8 aa, Influenza virus
DKKMEDGF

SEQ ID NO: 297543 - protein, 8 aa, Influenza virus
VEDGFLDV

SEQ ID NO: 297544 - protein, 8 aa, Influenza virus
EDGFRDVW

SEQ ID NO: 297545 - protein, 8 aa, Influenza virus
DGFLGVWT

SEQ ID NO: 297546 - protein, 8 aa, Influenza virus
GLLDVWTY

SEQ ID NO: 297547 - protein, 8 aa, Influenza virus
LLDVWTYN

SEQ ID NO: 297548 - protein, 8 aa, Influenza virus
LGVWTYNA

SEQ ID NO: 297549 - protein, 8 aa, Influenza virus
MENERTLG

SEQ ID NO: 297550 - protein, 8 aa, Influenza virus
ENERILDF

SEQ ID NO: 297551 - protein, 8 aa, Influenza virus
NERILDFH

SEQ ID NO: 297552 - protein, 8 aa, Influenza virus
ERTLGFHD

SEQ ID NO: 297553 - protein, 8 aa, Influenza virus
RTLGFHDS

SEQ ID NO: 297554 - protein, 8 aa, Influenza virus
TLDFHDSS

SEQ ID NO: 297555 - protein, 8 aa, Influenza virus
DFHDSSVK

SEQ ID NO: 297556 - protein, 8 aa, Influenza virus
FHDSNVRN

SEQ ID NO: 297557 - protein, 8 aa, Influenza virus
HDSNVRNL

SEQ ID NO: 297558 - protein, 8 aa, Influenza virus
DSNVRNLY

SEQ ID NO: 297559 - protein, 8 aa, Influenza virus
SNVKNLYN

SEQ ID NO: 297560 - protein, 8 aa, Influenza virus
VKNLYNKV

SEQ ID NO: 297561 - protein, 8 aa, Influenza virus
KNLYNKVR

SEQ ID NO: 297562 - protein, 8 aa, Influenza virus
NLYNKVRM

SEQ ID NO: 297563 - protein, 8 aa, Influenza virus
LYEKVRMQ

SEQ ID NO: 297564 - protein, 8 aa, Influenza virus
YEKVRMQL

SEQ ID NO: 297565 - protein, 8 aa, Influenza virus
EKVRMQLR

SEQ ID NO: 297566 - protein, 8 aa, Influenza virus
LRDNAKEL

SEQ ID NO: 297567 - protein, 8 aa, Influenza virus
RDNAKELG

SEQ ID NO: 297568 - protein, 8 aa, Influenza virus
DNAKELGN

SEQ ID NO: 297569 - protein, 8 aa, Influenza virus
NAKELGNG

SEQ ID NO: 297570 - protein, 8 aa, Influenza virus
AKELGNGC

SEQ ID NO: 297571 - protein, 8 aa, Influenza virus
EFYHKCND

SEQ ID NO: 297572 - protein, 8 aa, Influenza virus
FYHKCNDE

SEQ ID NO: 297573 - protein, 8 aa, Influenza virus
YHKCNDEC

SEQ ID NO: 297574 - protein, 8 aa, Influenza virus
HKCNDECM

SEQ ID NO: 297575 - protein, 8 aa, Influenza virus
CMDSVKNG

SEQ ID NO: 297576 - protein, 8 aa, Influenza virus
MDSVKNGT

SEQ ID NO: 297577 - protein, 8 aa, Influenza virus
DSVKNGTY

SEQ ID NO: 297578 - protein, 8 aa, Influenza virus
SVKNGTYY

SEQ ID NO: 297579 - protein, 8 aa, Influenza virus
VKNGTYYY

SEQ ID NO: 297580 - protein, 8 aa, Influenza virus
KNGTYYYP

SEQ ID NO: 297581 - protein, 8 aa, Influenza virus
NGTYDYSK

SEQ ID NO: 297582 - protein, 8 aa, Influenza virus
GTYNYPKY

SEQ ID NO: 297583 - protein, 8 aa, Influenza virus
TYNYPKYE

SEQ ID NO: 297584 - protein, 8 aa, Influenza virus
YNYPKYEE

SEQ ID NO: 297585 - protein, 8 aa, Influenza virus
DYSKYEEE

SEQ ID NO: 297586 - protein, 8 aa, Influenza virus
PKYEKESK

SEQ ID NO: 297587 - protein, 8 aa, Influenza virus
YEEESRLN

SEQ ID NO: 297588 - protein, 8 aa, Influenza virus
EEESRLNR

SEQ ID NO: 297589 - protein, 8 aa, Influenza virus
EESRLNRN

SEQ ID NO: 297590 - protein, 8 aa, Influenza virus
ESRLNRNE

SEQ ID NO: 297591 - protein, 8 aa, Influenza virus
SRLNRNEI

SEQ ID NO: 297592 - protein, 8 aa, Influenza virus
RLNRNEIK

SEQ ID NO: 297593 - protein, 8 aa, Influenza virus
NKNEIKGV

SEQ ID NO: 297594 - protein, 8 aa, Influenza virus
RNEIKGIK

SEQ ID NO: 297595 - protein, 8 aa, Influenza virus
IKGVELSS

SEQ ID NO: 297596 - protein, 8 aa, Influenza virus
KGVELSSM

SEQ ID NO: 297597 - protein, 8 aa, Influenza virus
GVELSSMG

SEQ ID NO: 297598 - protein, 8 aa, Influenza virus
VKLSNMGI

SEQ ID NO: 297599 - protein, 8 aa, Influenza virus
KLSNMGIY

SEQ ID NO: 297600 - protein, 8 aa, Influenza virus
LSNMGIYQ

SEQ ID NO: 297601 - protein, 8 aa, Influenza virus
SNMGIYQI

SEQ ID NO: 297602 - protein, 8 aa, Influenza virus
NMGIYQIL

SEQ ID NO: 297603 - protein, 8 aa, Influenza virus
MGVYQILV

SEQ ID NO: 297604 - protein, 8 aa, Influenza virus
GVYQILVI

SEQ ID NO: 297605 - protein, 8 aa, Influenza virus
VYQILVIY

SEQ ID NO: 297606 - protein, 8 aa, Influenza virus
SLSLAIMV

SEQ ID NO: 297607 - protein, 8 aa, Influenza virus
LSLAIMVA

SEQ ID NO: 297608 - protein, 8 aa, Influenza virus
SLAIMVAG

SEQ ID NO: 297609 - protein, 8 aa, Influenza virus
LAIMVAGI

SEQ ID NO: 297610 - protein, 8 aa, Influenza virus
AIMVAGIS

SEQ ID NO: 297611 - protein, 8 aa, Influenza virus
AGIFLWMC

SEQ ID NO: 297612 - protein, 8 aa, Influenza virus
GIFLWMCS

SEQ ID NO: 297613 - protein, 8 aa, Influenza virus
IFLWMCSN

SEQ ID NO: 297614 - protein, 8 aa, Influenza virus
FLWMCSNG

SEQ ID NO: 297615 - protein, 8 aa, Influenza virus
PNQKIITM

SEQ ID NO: 297616 - protein, 8 aa, Influenza virus
NQKIITID

SEQ ID NO: 297617 - protein, 8 aa, Influenza virus
QKIITMGS

SEQ ID NO: 297618 - protein, 8 aa, Influenza virus
KTITIGSV

SEQ ID NO: 297619 - protein, 8 aa, Influenza virus
TITIGSVS

SEQ ID NO: 297620 - protein, 8 aa, Influenza virus
ITMGSVSL

SEQ ID NO: 297621 - protein, 8 aa, Influenza virus
TIGSVSLI

SEQ ID NO: 297622 - protein, 8 aa, Influenza virus
QIAILAAT

SEQ ID NO: 297623 - protein, 8 aa, Influenza virus
IAILATTI

SEQ ID NO: 297624 - protein, 8 aa, Influenza virus
AILATTIT

SEQ ID NO: 297625 - protein, 8 aa, Influenza virus
ILATTITL

SEQ ID NO: 297626 - protein, 8 aa, Influenza virus
LATTITLH

SEQ ID NO: 297627 - protein, 8 aa, Influenza virus
AATVTLHF

SEQ ID NO: 297628 - protein, 8 aa, Influenza virus
ATVTLHFK

SEQ ID NO: 297629 - protein, 8 aa, Influenza virus
ITLHFKQN

SEQ ID NO: 297630 - protein, 8 aa, Influenza virus
TLHFKQHD

SEQ ID NO: 297631 - protein, 8 aa, Influenza virus
LHFKQHDC

SEQ ID NO: 297632 - protein, 8 aa, Influenza virus
HFKQHECN

SEQ ID NO: 297633 - protein, 8 aa, Influenza virus
PCEPTIIE

SEQ ID NO: 297634 - protein, 8 aa, Influenza virus
CEPIIIEK

SEQ ID NO: 297635 - protein, 8 aa, Influenza virus
EPIIIEKN

SEQ ID NO: 297636 - protein, 8 aa, Influenza virus
TEIVYLNS

SEQ ID NO: 297637 - protein, 8 aa, Influenza virus
EIVYLNST

SEQ ID NO: 297638 - protein, 8 aa, Influenza virus
IVYLNSTT

SEQ ID NO: 297639 - protein, 8 aa, Influenza virus
YLNSTTIE

SEQ ID NO: 297640 - protein, 8 aa, Influenza virus
YRDWSKPQ

SEQ ID NO: 297641 - protein, 8 aa, Influenza virus
RDWSKPQC

SEQ ID NO: 297642 - protein, 8 aa, Influenza virus
WSKPQCHI

SEQ ID NO: 297643 - protein, 8 aa, Influenza virus
SKPQCQIA

SEQ ID NO: 297644 - protein, 8 aa, Influenza virus
KPQCHITG

SEQ ID NO: 297645 - protein, 8 aa, Influenza virus
PQCQIAGF

SEQ ID NO: 297646 - protein, 8 aa, Influenza virus
QCHITGFA

SEQ ID NO: 297647 - protein, 8 aa, Influenza virus
CQIAGFAP

SEQ ID NO: 297648 - protein, 8 aa, Influenza virus
QIAGFAPF

SEQ ID NO: 297649 - protein, 8 aa, Influenza virus
NSIRLSAS

SEQ ID NO: 297650 - protein, 8 aa, Influenza virus
SIRLSADG

SEQ ID NO: 297651 - protein, 8 aa, Influenza virus
IRLSGGGD

SEQ ID NO: 297652 - protein, 8 aa, Influenza virus
RLSGGGDI

SEQ ID NO: 297653 - protein, 8 aa, Influenza virus
LSASGDIW

SEQ ID NO: 297654 - protein, 8 aa, Influenza virus
SADGDIWV

SEQ ID NO: 297655 - protein, 8 aa, Influenza virus
ADGDIWVT

SEQ ID NO: 297656 - protein, 8 aa, Influenza virus
DGDIWVTR

SEQ ID NO: 297657 - protein, 8 aa, Influenza virus
REPYVSCN

SEQ ID NO: 297658 - protein, 8 aa, Influenza virus
EPYVSCSP

SEQ ID NO: 297659 - protein, 8 aa, Influenza virus
VKCYQFAL

SEQ ID NO: 297660 - protein, 8 aa, Influenza virus
LGQGTTLE

SEQ ID NO: 297661 - protein, 8 aa, Influenza virus
GQGTTLEN

SEQ ID NO: 297662 - protein, 8 aa, Influenza virus
QGTTLNNK

SEQ ID NO: 297663 - protein, 8 aa, Influenza virus
GTTLNNKH

SEQ ID NO: 297664 - protein, 8 aa, Influenza virus
TTLNNKHS

SEQ ID NO: 297665 - protein, 8 aa, Influenza virus
TLENKHSN

SEQ ID NO: 297666 - protein, 8 aa, Influenza virus
LNNKHSNG

SEQ ID NO: 297667 - protein, 8 aa, Influenza virus
NNKHSNGT

SEQ ID NO: 297668 - protein, 8 aa, Influenza virus
NKHSNDTV

SEQ ID NO: 297669 - protein, 8 aa, Influenza virus
KHSNDTVH

SEQ ID NO: 297670 - protein, 8 aa, Influenza virus
HSNDTVHD

SEQ ID NO: 297671 - protein, 8 aa, Influenza virus
SNDTVHDR

SEQ ID NO: 297672 - protein, 8 aa, Influenza virus
TIHDRTPH

SEQ ID NO: 297673 - protein, 8 aa, Influenza virus
IHDRTPHR

SEQ ID NO: 297674 - protein, 8 aa, Influenza virus
HDRSPHRT

SEQ ID NO: 297675 - protein, 8 aa, Influenza virus
DRSPHRTL

SEQ ID NO: 297676 - protein, 8 aa, Influenza virus
RSPHRTLL

SEQ ID NO: 297677 - protein, 8 aa, Influenza virus
SPHRTLLM

SEQ ID NO: 297678 - protein, 8 aa, Influenza virus
VSFHLGTK

SEQ ID NO: 297679 - protein, 8 aa, Influenza virus
SFHLGTKQ

SEQ ID NO: 297680 - protein, 8 aa, Influenza virus
LGTKQVCI

SEQ ID NO: 297681 - protein, 8 aa, Influenza virus
GTKQVCIA

SEQ ID NO: 297682 - protein, 8 aa, Influenza virus
TKQVCIAW

SEQ ID NO: 297683 - protein, 8 aa, Influenza virus
KQVCIAWS

SEQ ID NO: 297684 - protein, 8 aa, Influenza virus
QVCAAWSS

SEQ ID NO: 297685 - protein, 8 aa, Influenza virus
VCAAWSSS

SEQ ID NO: 297686 - protein, 8 aa, Influenza virus
CAAWSSSS

SEQ ID NO: 297687 - protein, 8 aa, Influenza virus
AAWSSSSC

SEQ ID NO: 297688 - protein, 8 aa, Influenza virus
DGKAWLHI

SEQ ID NO: 297689 - protein, 8 aa, Influenza virus
GKAWLHIC

SEQ ID NO: 297690 - protein, 8 aa, Influenza virus
RAWLHVCV

SEQ ID NO: 297691 - protein, 8 aa, Influenza virus
AWLHICVT

SEQ ID NO: 297692 - protein, 8 aa, Influenza virus
WLHICVTG

SEQ ID NO: 297693 - protein, 8 aa, Influenza virus
LHICVTGD

SEQ ID NO: 297694 - protein, 8 aa, Influenza virus
HICVTGDD

SEQ ID NO: 297695 - protein, 8 aa, Influenza virus
CITGDDKN

SEQ ID NO: 297696 - protein, 8 aa, Influenza virus
ITGDDKNA

SEQ ID NO: 297697 - protein, 8 aa, Influenza virus
TGYEKNAT

SEQ ID NO: 297698 - protein, 8 aa, Influenza virus
GYEKNATA

SEQ ID NO: 297699 - protein, 8 aa, Influenza virus
YEKNATAS

SEQ ID NO: 297700 - protein, 8 aa, Influenza virus
DRNATASL

SEQ ID NO: 297701 - protein, 8 aa, Influenza virus
RNATASLI

SEQ ID NO: 297702 - protein, 8 aa, Influenza virus
ATASLIYD

SEQ ID NO: 297703 - protein, 8 aa, Influenza virus
TASLIYDG

SEQ ID NO: 297704 - protein, 8 aa, Influenza virus
DSISSWSQ

SEQ ID NO: 297705 - protein, 8 aa, Influenza virus
SIGSWSHN

SEQ ID NO: 297706 - protein, 8 aa, Influenza virus
IGSWSHNI

SEQ ID NO: 297707 - protein, 8 aa, Influenza virus
GSWSHNIL

SEQ ID NO: 297708 - protein, 8 aa, Influenza virus
ECVCINGI

SEQ ID NO: 297709 - protein, 8 aa, Influenza virus
CVCINGIC

SEQ ID NO: 297710 - protein, 8 aa, Influenza virus
VCINGICT

SEQ ID NO: 297711 - protein, 8 aa, Influenza virus
CINGICTV

SEQ ID NO: 297712 - protein, 8 aa, Influenza virus
INGICTVV

SEQ ID NO: 297713 - protein, 8 aa, Influenza virus
NGICTVVM

SEQ ID NO: 297714 - protein, 8 aa, Influenza virus
GICTVVMT

SEQ ID NO: 297715 - protein, 8 aa, Influenza virus
ICTVVMTD

SEQ ID NO: 297716 - protein, 8 aa, Influenza virus
ASGRADTK

SEQ ID NO: 297717 - protein, 8 aa, Influenza virus
SGRADTKI

SEQ ID NO: 297718 - protein, 8 aa, Influenza virus
GRADTKIL

SEQ ID NO: 297719 - protein, 8 aa, Influenza virus
RADTKILF

SEQ ID NO: 297720 - protein, 8 aa, Influenza virus
ADTKILFI

SEQ ID NO: 297721 - protein, 8 aa, Influenza virus
DTRILFVK

SEQ ID NO: 297722 - protein, 8 aa, Influenza virus
TRILFVKE

SEQ ID NO: 297723 - protein, 8 aa, Influenza virus
RILFVKEG

SEQ ID NO: 297724 - protein, 8 aa, Influenza virus
ILFVKEGK

SEQ ID NO: 297725 - protein, 8 aa, Influenza virus
LFVKEGKI

SEQ ID NO: 297726 - protein, 8 aa, Influenza virus
EGKIVHIG

SEQ ID NO: 297727 - protein, 8 aa, Influenza virus
GKIVHIGP

SEQ ID NO: 297728 - protein, 8 aa, Influenza virus
KIVHIGPL

SEQ ID NO: 297729 - protein, 8 aa, Influenza virus
VHIGPLSG

SEQ ID NO: 297730 - protein, 8 aa, Influenza virus
HISPLAGS

SEQ ID NO: 297731 - protein, 8 aa, Influenza virus
ISPLAGSA

SEQ ID NO: 297732 - protein, 8 aa, Influenza virus
SPLAGSAQ

SEQ ID NO: 297733 - protein, 8 aa, Influenza virus
LAGSAQHV

SEQ ID NO: 297734 - protein, 8 aa, Influenza virus
AGSAQHVE

SEQ ID NO: 297735 - protein, 8 aa, Influenza virus
SCYPRYPN

SEQ ID NO: 297736 - protein, 8 aa, Influenza virus
CYPRYPNV

SEQ ID NO: 297737 - protein, 8 aa, Influenza virus
YPRYPNVR

SEQ ID NO: 297738 - protein, 8 aa, Influenza virus
PRYPNVRC

SEQ ID NO: 297739 - protein, 8 aa, Influenza virus
RYPNVRCV

SEQ ID NO: 297740 - protein, 8 aa, Influenza virus
YPNVRCVC

SEQ ID NO: 297741 - protein, 8 aa, Influenza virus
PNVRCVCR

SEQ ID NO: 297742 - protein, 8 aa, Influenza virus
NVRCVCRD

SEQ ID NO: 297743 - protein, 8 aa, Influenza virus
VRCICKDN

SEQ ID NO: 297744 - protein, 8 aa, Influenza virus
RCTCRDNW

SEQ ID NO: 297745 - protein, 8 aa, Influenza virus
CVCRDNWR

SEQ ID NO: 297746 - protein, 8 aa, Influenza virus
VCRDNWRG

SEQ ID NO: 297747 - protein, 8 aa, Influenza virus
WRGSNRPV

SEQ ID NO: 297748 - protein, 8 aa, Influenza virus
GSNRPIID

SEQ ID NO: 297749 - protein, 8 aa, Influenza virus
SNRPIIDI

SEQ ID NO: 297750 - protein, 8 aa, Influenza virus
NRPIIDIN

SEQ ID NO: 297751 - protein, 8 aa, Influenza virus
DISMEDYS

SEQ ID NO: 297752 - protein, 8 aa, Influenza virus
ISMEDYSI

SEQ ID NO: 297753 - protein, 8 aa, Influenza virus
SMEDYSID

SEQ ID NO: 297754 - protein, 8 aa, Influenza virus
IAEYSIDS

SEQ ID NO: 297755 - protein, 8 aa, Influenza virus
DYSIDSGY

SEQ ID NO: 297756 - protein, 8 aa, Influenza virus
YSIDSNYV

SEQ ID NO: 297757 - protein, 8 aa, Influenza virus
SIDSGYVC

SEQ ID NO: 297758 - protein, 8 aa, Influenza virus
IDSNYVCS

SEQ ID NO: 297759 - protein, 8 aa, Influenza virus
DSNYVCSG

SEQ ID NO: 297760 - protein, 8 aa, Influenza virus
SGYVCSGL

SEQ ID NO: 297761 - protein, 8 aa, Influenza virus
NYVCSGLV

SEQ ID NO: 297762 - protein, 8 aa, Influenza virus
VGDTPRNN

SEQ ID NO: 297763 - protein, 8 aa, Influenza virus
GDTPRSDD

SEQ ID NO: 297764 - protein, 8 aa, Influenza virus
DTPRNGDS

SEQ ID NO: 297765 - protein, 8 aa, Influenza virus
TPRNDDRF

SEQ ID NO: 297766 - protein, 8 aa, Influenza virus
PRNDDRFS

SEQ ID NO: 297767 - protein, 8 aa, Influenza virus
DSSSSSNC

SEQ ID NO: 297768 - protein, 8 aa, Influenza virus
SSSNCRDP

SEQ ID NO: 297769 - protein, 8 aa, Influenza virus
SSNCRDPN

SEQ ID NO: 297770 - protein, 8 aa, Influenza virus
SNCKDPNN

SEQ ID NO: 297771 - protein, 8 aa, Influenza virus
NCKDPNNE

SEQ ID NO: 297772 - protein, 8 aa, Influenza virus
CRNPNNEK

SEQ ID NO: 297773 - protein, 8 aa, Influenza virus
RNPNNEKG

SEQ ID NO: 297774 - protein, 8 aa, Influenza virus
NPNNEKGN

SEQ ID NO: 297775 - protein, 8 aa, Influenza virus
PNNEKGNQ

SEQ ID NO: 297776 - protein, 8 aa, Influenza virus
NNEKGNQG

SEQ ID NO: 297777 - protein, 8 aa, Influenza virus
NEKGNQGV

SEQ ID NO: 297778 - protein, 8 aa, Influenza virus
EKGNQGVK

SEQ ID NO: 297779 - protein, 8 aa, Influenza virus
KGNQGVKG

SEQ ID NO: 297780 - protein, 8 aa, Influenza virus
GTQGVKGW

SEQ ID NO: 297781 - protein, 8 aa, Influenza virus
TQGVKGWA

SEQ ID NO: 297782 - protein, 8 aa, Influenza virus
VKGWAFDD

SEQ ID NO: 297783 - protein, 8 aa, Influenza virus
KGWAFDDG

SEQ ID NO: 297784 - protein, 8 aa, Influenza virus
GSDVWMGR

SEQ ID NO: 297785 - protein, 8 aa, Influenza virus
SDVWMGRT

SEQ ID NO: 297786 - protein, 8 aa, Influenza virus
DLWMGTTI

SEQ ID NO: 297787 - protein, 8 aa, Influenza virus
LWMGRTIS

SEQ ID NO: 297788 - protein, 8 aa, Influenza virus
WMGRTISR

SEQ ID NO: 297789 - protein, 8 aa, Influenza virus
RDSRSGYE

SEQ ID NO: 297790 - protein, 8 aa, Influenza virus
ESRSGYET

SEQ ID NO: 297791 - protein, 8 aa, Influenza virus
FRVIGGWA

SEQ ID NO: 297792 - protein, 8 aa, Influenza virus
RVIGGWAT

SEQ ID NO: 297793 - protein, 8 aa, Influenza virus
VIGGWATA

SEQ ID NO: 297794 - protein, 8 aa, Influenza virus
SKSQTNRQ

SEQ ID NO: 297795 - protein, 8 aa, Influenza virus
RQVIVDSN

SEQ ID NO: 297796 - protein, 8 aa, Influenza virus
SNNWSGYS

SEQ ID NO: 297797 - protein, 8 aa, Influenza virus
NNRSGYSG

SEQ ID NO: 297798 - protein, 8 aa, Influenza virus
SGIFSVEN

SEQ ID NO: 297799 - protein, 8 aa, Influenza virus
GIFSVEHK

SEQ ID NO: 297800 - protein, 8 aa, Influenza virus
KRCINRCF

SEQ ID NO: 297801 - protein, 8 aa, Influenza virus
RCINRCFY

SEQ ID NO: 297802 - protein, 8 aa, Influenza virus
VELIRGRQ

SEQ ID NO: 297803 - protein, 8 aa, Influenza virus
ELIRGRQQ

SEQ ID NO: 297804 - protein, 8 aa, Influenza virus
LIRGRQQE

SEQ ID NO: 297805 - protein, 8 aa, Influenza virus
QQETRVWW

SEQ ID NO: 297806 - protein, 8 aa, Influenza virus
SNSIVVFV

SEQ ID NO: 297807 - protein, 8 aa, Influenza virus
NSIVVFVA

SEQ ID NO: 297808 - protein, 8 aa, Influenza virus
WPDGANID

SEQ ID NO: 297809 - protein, 8 aa, Influenza virus
PDGADINF

SEQ ID NO: 297810 - protein, 8 aa, Influenza virus
DGADINFM

SEQ ID NO: 297811 - protein, 8 aa, Influenza virus
GADINFMP

SEQ ID NO: 297812 - protein, 8 aa, Influenza virus
ADINFMPI

SEQ ID NO: 297813 - protein, 8 aa, Influenza virus
IFNFILLT

SEQ ID NO: 297814 - protein, 8 aa, Influenza virus
FNFILLTH

SEQ ID NO: 297815 - protein, 8 aa, Influenza virus
AATLCLGH

SEQ ID NO: 297816 - protein, 8 aa, Influenza virus
CLGHHAVQ

SEQ ID NO: 297817 - protein, 8 aa, Influenza virus
LGHHAVQN

SEQ ID NO: 297818 - protein, 8 aa, Influenza virus
GHHAVQNG

SEQ ID NO: 297819 - protein, 8 aa, Influenza virus
HHAVQNGT

SEQ ID NO: 297820 - protein, 8 aa, Influenza virus
DQVEVTNA

SEQ ID NO: 297821 - protein, 8 aa, Influenza virus
QVEVTNAT

SEQ ID NO: 297822 - protein, 8 aa, Influenza virus
NATELVQI

SEQ ID NO: 297823 - protein, 8 aa, Influenza virus
CTLIDAML

SEQ ID NO: 297824 - protein, 8 aa, Influenza virus
TLIDAMLG

SEQ ID NO: 297825 - protein, 8 aa, Influenza virus
LIDAMLGD

SEQ ID NO: 297826 - protein, 8 aa, Influenza virus
IDAMLGDP

SEQ ID NO: 297827 - protein, 8 aa, Influenza virus
DAMLGDPH

SEQ ID NO: 297828 - protein, 8 aa, Influenza virus
AMLGDPHC

SEQ ID NO: 297829 - protein, 8 aa, Influenza virus
MLGDPHCD

SEQ ID NO: 297830 - protein, 8 aa, Influenza virus
WDLFIERS

SEQ ID NO: 297831 - protein, 8 aa, Influenza virus
SNCYPYYV

SEQ ID NO: 297832 - protein, 8 aa, Influenza virus
CYPYYVPD

SEQ ID NO: 297833 - protein, 8 aa, Influenza virus
SLRSIVAS

SEQ ID NO: 297834 - protein, 8 aa, Influenza virus
LRSIVASS

SEQ ID NO: 297835 - protein, 8 aa, Influenza virus
RSIVASSG

SEQ ID NO: 297836 - protein, 8 aa, Influenza virus
SIVASSGT

SEQ ID NO: 297837 - protein, 8 aa, Influenza virus
IVASSGTL

SEQ ID NO: 297838 - protein, 8 aa, Influenza virus
VASSGTVE

SEQ ID NO: 297839 - protein, 8 aa, Influenza virus
ASSGNLEF

SEQ ID NO: 297840 - protein, 8 aa, Influenza virus
GFFRRLNW

SEQ ID NO: 297841 - protein, 8 aa, Influenza virus
FFSKLNWL

SEQ ID NO: 297842 - protein, 8 aa, Influenza virus
FSRLNWLY

SEQ ID NO: 297843 - protein, 8 aa, Influenza virus
SDKLYIWG

SEQ ID NO: 297844 - protein, 8 aa, Influenza virus
DKLYIWGI

SEQ ID NO: 297845 - protein, 8 aa, Influenza virus
KLYIWGIH

SEQ ID NO: 297846 - protein, 8 aa, Influenza virus
LYIWGIHH

SEQ ID NO: 297847 - protein, 8 aa, Influenza virus
YIWGIHHP

SEQ ID NO: 297848 - protein, 8 aa, Influenza virus
SVYWTVVK

SEQ ID NO: 297849 - protein, 8 aa, Influenza virus
YWTIVKSG

SEQ ID NO: 297850 - protein, 8 aa, Influenza virus
WTIVKSGD

SEQ ID NO: 297851 - protein, 8 aa, Influenza virus
SNGNLVAP

SEQ ID NO: 297852 - protein, 8 aa, Influenza virus
NGNLVAPR

SEQ ID NO: 297853 - protein, 8 aa, Influenza virus
IAPRGYFR

SEQ ID NO: 297854 - protein, 8 aa, Influenza virus
APRGYFKL

SEQ ID NO: 297855 - protein, 8 aa, Influenza virus
SGCITPNG

SEQ ID NO: 297856 - protein, 8 aa, Influenza virus
GCITPNGS

SEQ ID NO: 297857 - protein, 8 aa, Influenza virus
PNGSIPNE

SEQ ID NO: 297858 - protein, 8 aa, Influenza virus
NGSIPNEK

SEQ ID NO: 297859 - protein, 8 aa, Influenza virus
GSIPNEKP

SEQ ID NO: 297860 - protein, 8 aa, Influenza virus
SIPNEKPF

SEQ ID NO: 297861 - protein, 8 aa, Influenza virus
IPNEKPFQ

SEQ ID NO: 297862 - protein, 8 aa, Influenza virus
PNEKPFQN

SEQ ID NO: 297863 - protein, 8 aa, Influenza virus
NNKPFQNV

SEQ ID NO: 297864 - protein, 8 aa, Influenza virus
NKPFQNVN

SEQ ID NO: 297865 - protein, 8 aa, Influenza virus
PFQNVNKV

SEQ ID NO: 297866 - protein, 8 aa, Influenza virus
FQNVNKVT

SEQ ID NO: 297867 - protein, 8 aa, Influenza virus
QNVNKVTY

SEQ ID NO: 297868 - protein, 8 aa, Influenza virus
NVNKVTYG

SEQ ID NO: 297869 - protein, 8 aa, Influenza virus
TYGKCPKY

SEQ ID NO: 297870 - protein, 8 aa, Influenza virus
QKTLKLAT

SEQ ID NO: 297871 - protein, 8 aa, Influenza virus
GMRNIPEK

SEQ ID NO: 297872 - protein, 8 aa, Influenza virus
MRNIPEKQ

SEQ ID NO: 297873 - protein, 8 aa, Influenza virus
QIRGIFGA

SEQ ID NO: 297874 - protein, 8 aa, Influenza virus
IRGIFGAI

SEQ ID NO: 297875 - protein, 8 aa, Influenza virus
KGLFGAIA

SEQ ID NO: 297876 - protein, 8 aa, Influenza virus
ENGWEGMM

SEQ ID NO: 297877 - protein, 8 aa, Influenza virus
NGWEGMMD

SEQ ID NO: 297878 - protein, 8 aa, Influenza virus
GWEGMMDG

SEQ ID NO: 297879 - protein, 8 aa, Influenza virus
WEGMMDGW

SEQ ID NO: 297880 - protein, 8 aa, Influenza virus
EGMMDGWY

SEQ ID NO: 297881 - protein, 8 aa, Influenza virus
GMMDGWYG

SEQ ID NO: 297882 - protein, 8 aa, Influenza virus
MMDGWYGF

SEQ ID NO: 297883 - protein, 8 aa, Influenza virus
MDGWYGFR

SEQ ID NO: 297884 - protein, 8 aa, Influenza virus
NGWYGFRH

SEQ ID NO: 297885 - protein, 8 aa, Influenza virus
YGFRHLNS

SEQ ID NO: 297886 - protein, 8 aa, Influenza virus
GFRHLNSE

SEQ ID NO: 297887 - protein, 8 aa, Influenza virus
FRHLNSEG

SEQ ID NO: 297888 - protein, 8 aa, Influenza virus
QNSEGRGQ

SEQ ID NO: 297889 - protein, 8 aa, Influenza virus
NSEGRGQA

SEQ ID NO: 297890 - protein, 8 aa, Influenza virus
SEGRGQAA

SEQ ID NO: 297891 - protein, 8 aa, Influenza virus
EGRGQAAD

SEQ ID NO: 297892 - protein, 8 aa, Influenza virus
GRGQAADL

SEQ ID NO: 297893 - protein, 8 aa, Influenza virus
RGQAADLK

SEQ ID NO: 297894 - protein, 8 aa, Influenza virus
FKSTQAAI

SEQ ID NO: 297895 - protein, 8 aa, Influenza virus
KSTQTAID

SEQ ID NO: 297896 - protein, 8 aa, Influenza virus
STQTAIDQ

SEQ ID NO: 297897 - protein, 8 aa, Influenza virus
TQTAIDQI

SEQ ID NO: 297898 - protein, 8 aa, Influenza virus
QINEKLNR

SEQ ID NO: 297899 - protein, 8 aa, Influenza virus
IERTNEKF

SEQ ID NO: 297900 - protein, 8 aa, Influenza virus
ERTNEKFH

SEQ ID NO: 297901 - protein, 8 aa, Influenza virus
RYVEDTKI

SEQ ID NO: 297902 - protein, 8 aa, Influenza virus
SYNADVLV

SEQ ID NO: 297903 - protein, 8 aa, Influenza virus
YNADVLVA

SEQ ID NO: 297904 - protein, 8 aa, Influenza virus
NADVLVAL

SEQ ID NO: 297905 - protein, 8 aa, Influenza virus
ADVLVALE

SEQ ID NO: 297906 - protein, 8 aa, Influenza virus
DVLVALEN

SEQ ID NO: 297907 - protein, 8 aa, Influenza virus
FLVALENQ

SEQ ID NO: 297908 - protein, 8 aa, Influenza virus
NQHTIDLA

SEQ ID NO: 297909 - protein, 8 aa, Influenza virus
QHTIDLAD

SEQ ID NO: 297910 - protein, 8 aa, Influenza virus
HTIHLTDS

SEQ ID NO: 297911 - protein, 8 aa, Influenza virus
TIHLTDSE

SEQ ID NO: 297912 - protein, 8 aa, Influenza virus
IHLTDSEM

SEQ ID NO: 297913 - protein, 8 aa, Influenza virus
DLTDSEMS

SEQ ID NO: 297914 - protein, 8 aa, Influenza virus
LTDSEMSK

SEQ ID NO: 297915 - protein, 8 aa, Influenza virus
TDSEMSKL

SEQ ID NO: 297916 - protein, 8 aa, Influenza virus
DSEMSKLF

SEQ ID NO: 297917 - protein, 8 aa, Influenza virus
SEMSKLFE

SEQ ID NO: 297918 - protein, 8 aa, Influenza virus
EMSKLFEK

SEQ ID NO: 297919 - protein, 8 aa, Influenza virus
MSKLFEKT

SEQ ID NO: 297920 - protein, 8 aa, Influenza virus
TRKQLREN

SEQ ID NO: 297921 - protein, 8 aa, Influenza virus
RKQLRENA

SEQ ID NO: 297922 - protein, 8 aa, Influenza virus
ENAEDMGD

SEQ ID NO: 297923 - protein, 8 aa, Influenza virus
NAEDMGDG

SEQ ID NO: 297924 - protein, 8 aa, Influenza virus
AEDMGDGC

SEQ ID NO: 297925 - protein, 8 aa, Influenza virus
EDMGNGCL

SEQ ID NO: 297926 - protein, 8 aa, Influenza virus
GNGCFTIY

SEQ ID NO: 297927 - protein, 8 aa, Influenza virus
NGCFTIYH

SEQ ID NO: 297928 - protein, 8 aa, Influenza virus
GCLKIYHK

SEQ ID NO: 297929 - protein, 8 aa, Influenza virus
CLKIYHKC

SEQ ID NO: 297930 - protein, 8 aa, Influenza virus
LKIYHKCD

SEQ ID NO: 297931 - protein, 8 aa, Influenza virus
RIYHKCDN

SEQ ID NO: 297932 - protein, 8 aa, Influenza virus
IYHKCDNT

SEQ ID NO: 297933 - protein, 8 aa, Influenza virus
YHKCDNTC

SEQ ID NO: 297934 - protein, 8 aa, Influenza virus
DSIRNGTY

SEQ ID NO: 297935 - protein, 8 aa, Influenza virus
SIRTGTYD

SEQ ID NO: 297936 - protein, 8 aa, Influenza virus
IRTGTYDH

SEQ ID NO: 297937 - protein, 8 aa, Influenza virus
YRNEALNN

SEQ ID NO: 297938 - protein, 8 aa, Influenza virus
RNEALNNR

SEQ ID NO: 297939 - protein, 8 aa, Influenza virus
NEALNNRF

SEQ ID NO: 297940 - protein, 8 aa, Influenza virus
EALNNRFH

SEQ ID NO: 297941 - protein, 8 aa, Influenza virus
EYKDWILW

SEQ ID NO: 297942 - protein, 8 aa, Influenza virus
YKNWILWI

SEQ ID NO: 297943 - protein, 8 aa, Influenza virus
ILWISFAT

SEQ ID NO: 297944 - protein, 8 aa, Influenza virus
LWISFAMS

SEQ ID NO: 297945 - protein, 8 aa, Influenza virus
WISFAMSC

SEQ ID NO: 297946 - protein, 8 aa, Influenza virus
ISFAMSCF

SEQ ID NO: 297947 - protein, 8 aa, Influenza virus
SFAMSCFL

SEQ ID NO: 297948 - protein, 8 aa, Influenza virus
FATSCFLL

SEQ ID NO: 297949 - protein, 8 aa, Influenza virus
ATSCFLLC

SEQ ID NO: 297950 - protein, 8 aa, Influenza virus
LGFIMWTC

SEQ ID NO: 297951 - protein, 8 aa, Influenza virus
GFIMWTCQ

SEQ ID NO: 297952 - protein, 8 aa, Influenza virus
FIVWACQR

SEQ ID NO: 297953 - protein, 8 aa, Influenza virus
IVWACQRG

SEQ ID NO: 297954 - protein, 8 aa, Influenza virus
VWACQRGN

SEQ ID NO: 297955 - protein, 8 aa, Influenza virus
ACQKGNIK

SEQ ID NO: 297956 - protein, 8 aa, Influenza virus
CQKGNIKC

SEQ ID NO: 297957 - protein, 8 aa, Influenza virus
QKGNIKCN

SEQ ID NO: 297958 - protein, 8 aa, Influenza virus
KGNIKCNI

SEQ ID NO: 297959 - protein, 8 aa, Influenza virus
GNIRCDIC

SEQ ID NO: 297960 - protein, 8 aa, Influenza virus
NIRCDICI

SEQ ID NO: 297961 - protein, 8 aa, Influenza virus
AATLCLGH

SEQ ID NO: 297962 - protein, 8 aa, Influenza virus
HAVPNGTV

SEQ ID NO: 297963 - protein, 8 aa, Influenza virus
AVPNGTVV

SEQ ID NO: 297964 - protein, 8 aa, Influenza virus
VPNGTVVK

SEQ ID NO: 297965 - protein, 8 aa, Influenza virus
PNGTVVKT

SEQ ID NO: 297966 - protein, 8 aa, Influenza virus
NGTVVKTI

SEQ ID NO: 297967 - protein, 8 aa, Influenza virus
GTVVKTIT

SEQ ID NO: 297968 - protein, 8 aa, Influenza virus
DQVEVTNA

SEQ ID NO: 297969 - protein, 8 aa, Influenza virus
QVEVTNAT

SEQ ID NO: 297970 - protein, 8 aa, Influenza virus
NATELVQI

SEQ ID NO: 297971 - protein, 8 aa, Influenza virus
CTLVDALL

SEQ ID NO: 297972 - protein, 8 aa, Influenza virus
TLVDALLG

SEQ ID NO: 297973 - protein, 8 aa, Influenza virus
LVDALLGD

SEQ ID NO: 297974 - protein, 8 aa, Influenza virus
VDALLGDP

SEQ ID NO: 297975 - protein, 8 aa, Influenza virus
WDLYVERS

SEQ ID NO: 297976 - protein, 8 aa, Influenza virus
SSCYPYDV

SEQ ID NO: 297977 - protein, 8 aa, Influenza virus
CYPYDVPE

SEQ ID NO: 297978 - protein, 8 aa, Influenza virus
YPYDVPDH

SEQ ID NO: 297979 - protein, 8 aa, Influenza virus
SLRSIVAS

SEQ ID NO: 297980 - protein, 8 aa, Influenza virus
LRSIVASS

SEQ ID NO: 297981 - protein, 8 aa, Influenza virus
RSIVASSG

SEQ ID NO: 297982 - protein, 8 aa, Influenza virus
SIVASSGT

SEQ ID NO: 297983 - protein, 8 aa, Influenza virus
IVASSGTL

SEQ ID NO: 297984 - protein, 8 aa, Influenza virus
VASSGNLE

SEQ ID NO: 297985 - protein, 8 aa, Influenza virus
SSGTLEFT

SEQ ID NO: 297986 - protein, 8 aa, Influenza virus
GFFRRLNW

SEQ ID NO: 297987 - protein, 8 aa, Influenza virus
FSRLNWLY

SEQ ID NO: 297988 - protein, 8 aa, Influenza virus
SDKLYIWG

SEQ ID NO: 297989 - protein, 8 aa, Influenza virus
DKLYIWGI

SEQ ID NO: 297990 - protein, 8 aa, Influenza virus
LYIWGIHH

SEQ ID NO: 297991 - protein, 8 aa, Influenza virus
YIWGIHHP

SEQ ID NO: 297992 - protein, 8 aa, Influenza virus
WGIHHPST

SEQ ID NO: 297993 - protein, 8 aa, Influenza virus
ISVYWTVV

SEQ ID NO: 297994 - protein, 8 aa, Influenza virus
SIHWTIVK

SEQ ID NO: 297995 - protein, 8 aa, Influenza virus
IHWTIVKP

SEQ ID NO: 297996 - protein, 8 aa, Influenza virus
HWTIVKPG

SEQ ID NO: 297997 - protein, 8 aa, Influenza virus
CTGNLIAP

SEQ ID NO: 297998 - protein, 8 aa, Influenza virus
APRGYFKV

SEQ ID NO: 297999 - protein, 8 aa, Influenza virus
GKSSVMRS

SEQ ID NO: 298000 - protein, 8 aa, Influenza virus
KSSIMKSD

SEQ ID NO: 298001 - protein, 8 aa, Influenza virus
SSIMKSDA

SEQ ID NO: 298002 - protein, 8 aa, Influenza virus
SGCITPNG

SEQ ID NO: 298003 - protein, 8 aa, Influenza virus
GCITPNGS

SEQ ID NO: 298004 - protein, 8 aa, Influenza virus
PNGSISND

SEQ ID NO: 298005 - protein, 8 aa, Influenza virus
NGSISNDK

SEQ ID NO: 298006 - protein, 8 aa, Influenza virus
GSISNDKP

SEQ ID NO: 298007 - protein, 8 aa, Influenza virus
SISNDKPF

SEQ ID NO: 298008 - protein, 8 aa, Influenza virus
ISNDKPFQ

SEQ ID NO: 298009 - protein, 8 aa, Influenza virus
SNDKPFQN

SEQ ID NO: 298010 - protein, 8 aa, Influenza virus
NNKPFQNV

SEQ ID NO: 298011 - protein, 8 aa, Influenza virus
NKPFQNVN

SEQ ID NO: 298012 - protein, 8 aa, Influenza virus
VNRITYGP

SEQ ID NO: 298013 - protein, 8 aa, Influenza virus
NRITYGPC

SEQ ID NO: 298014 - protein, 8 aa, Influenza virus
RITYGPCP

SEQ ID NO: 298015 - protein, 8 aa, Influenza virus
ITYGPCPR

SEQ ID NO: 298016 - protein, 8 aa, Influenza virus
TYGPCPRY

SEQ ID NO: 298017 - protein, 8 aa, Influenza virus
YGPCPRYV

SEQ ID NO: 298018 - protein, 8 aa, Influenza virus
YIKQNTLK

SEQ ID NO: 298019 - protein, 8 aa, Influenza virus
IKQNTLKL

SEQ ID NO: 298020 - protein, 8 aa, Influenza virus
KQKTLKLA

SEQ ID NO: 298021 - protein, 8 aa, Influenza virus
QKTLKLAT

SEQ ID NO: 298022 - protein, 8 aa, Influenza virus
KTLKLATG

SEQ ID NO: 298023 - protein, 8 aa, Influenza virus
GMRNVPET

SEQ ID NO: 298024 - protein, 8 aa, Influenza virus
MRNIPEKQ

SEQ ID NO: 298025 - protein, 8 aa, Influenza virus
RNVPERQT

SEQ ID NO: 298026 - protein, 8 aa, Influenza virus
NVPERQTR

SEQ ID NO: 298027 - protein, 8 aa, Influenza virus
VPERQTRG

SEQ ID NO: 298028 - protein, 8 aa, Influenza virus
PETQTRGI

SEQ ID NO: 298029 - protein, 8 aa, Influenza virus
ETQTRGIF

SEQ ID NO: 298030 - protein, 8 aa, Influenza virus
TQTRGIFG

SEQ ID NO: 298031 - protein, 8 aa, Influenza virus
ENGWEGMI

SEQ ID NO: 298032 - protein, 8 aa, Influenza virus
NGWEGMID

SEQ ID NO: 298033 - protein, 8 aa, Influenza virus
GWEGMIDG

SEQ ID NO: 298034 - protein, 8 aa, Influenza virus
WEGMIDGW

SEQ ID NO: 298035 - protein, 8 aa, Influenza virus
EGMIDGWY

SEQ ID NO: 298036 - protein, 8 aa, Influenza virus
GMIDGWYG

SEQ ID NO: 298037 - protein, 8 aa, Influenza virus
MIDGWYGF

SEQ ID NO: 298038 - protein, 8 aa, Influenza virus
IDGWYGFR

SEQ ID NO: 298039 - protein, 8 aa, Influenza virus
YGFRHLNS

SEQ ID NO: 298040 - protein, 8 aa, Influenza virus
GFRHLNSE

SEQ ID NO: 298041 - protein, 8 aa, Influenza virus
FRHLNSEG

SEQ ID NO: 298042 - protein, 8 aa, Influenza virus
RHQNSEGR

SEQ ID NO: 298043 - protein, 8 aa, Influenza virus
HQNSEGRG

SEQ ID NO: 298044 - protein, 8 aa, Influenza virus
QNSEGRGQ

SEQ ID NO: 298045 - protein, 8 aa, Influenza virus
NSEGRGQA

SEQ ID NO: 298046 - protein, 8 aa, Influenza virus
SEGRGQAA

SEQ ID NO: 298047 - protein, 8 aa, Influenza virus
EGRGQAAD

SEQ ID NO: 298048 - protein, 8 aa, Influenza virus
GRGQAADL

SEQ ID NO: 298049 - protein, 8 aa, Influenza virus
RGQAADLK

SEQ ID NO: 298050 - protein, 8 aa, Influenza virus
KSTQAAVN

SEQ ID NO: 298051 - protein, 8 aa, Influenza virus
STQAAVNQ

SEQ ID NO: 298052 - protein, 8 aa, Influenza virus
TQAAIDQV

SEQ ID NO: 298053 - protein, 8 aa, Influenza virus
NQITGKLN

SEQ ID NO: 298054 - protein, 8 aa, Influenza virus
QINGKLNK

SEQ ID NO: 298055 - protein, 8 aa, Influenza virus
IKKTNEKF

SEQ ID NO: 298056 - protein, 8 aa, Influenza virus
KKTNEKFH

SEQ ID NO: 298057 - protein, 8 aa, Influenza virus
RYVEDTKI

SEQ ID NO: 298058 - protein, 8 aa, Influenza virus
YNAELLIA

SEQ ID NO: 298059 - protein, 8 aa, Influenza virus
NAEFLVAL

SEQ ID NO: 298060 - protein, 8 aa, Influenza virus
AEFLVALE

SEQ ID NO: 298061 - protein, 8 aa, Influenza virus
EFLVALEN

SEQ ID NO: 298062 - protein, 8 aa, Influenza virus
VLVALENQ

SEQ ID NO: 298063 - protein, 8 aa, Influenza virus
NTIDLTDS

SEQ ID NO: 298064 - protein, 8 aa, Influenza virus
HLTDSEMN

SEQ ID NO: 298065 - protein, 8 aa, Influenza virus
LADSEMNK

SEQ ID NO: 298066 - protein, 8 aa, Influenza virus
EMSKLFER

SEQ ID NO: 298067 - protein, 8 aa, Influenza virus
MSKLFERT

SEQ ID NO: 298068 - protein, 8 aa, Influenza virus
TRRQLREN

SEQ ID NO: 298069 - protein, 8 aa, Influenza virus
RRQLRENA

SEQ ID NO: 298070 - protein, 8 aa, Influenza virus
DMGNGCLK

SEQ ID NO: 298071 - protein, 8 aa, Influenza virus
MGNGCLKI

SEQ ID NO: 298072 - protein, 8 aa, Influenza virus
GNGCLKIY

SEQ ID NO: 298073 - protein, 8 aa, Influenza virus
NGCLKIYH

SEQ ID NO: 298074 - protein, 8 aa, Influenza virus
GCLKIYHK

SEQ ID NO: 298075 - protein, 8 aa, Influenza virus
CLKIYHKC

SEQ ID NO: 298076 - protein, 8 aa, Influenza virus
LKIYHKCD

SEQ ID NO: 298077 - protein, 8 aa, Influenza virus
RIYHKCDN

SEQ ID NO: 298078 - protein, 8 aa, Influenza virus
IYHKCDNT

SEQ ID NO: 298079 - protein, 8 aa, Influenza virus
YHKCDNTC

SEQ ID NO: 298080 - protein, 8 aa, Influenza virus
HKCDNSCM

SEQ ID NO: 298081 - protein, 8 aa, Influenza virus
CIGSIRNE

SEQ ID NO: 298082 - protein, 8 aa, Influenza virus
IGSIRNET

SEQ ID NO: 298083 - protein, 8 aa, Influenza virus
GSIRNETY

SEQ ID NO: 298084 - protein, 8 aa, Influenza virus
SIRNETYD

SEQ ID NO: 298085 - protein, 8 aa, Influenza virus
IRNETYDH

SEQ ID NO: 298086 - protein, 8 aa, Influenza virus
RNGTYNHD

SEQ ID NO: 298087 - protein, 8 aa, Influenza virus
YRNEALNN

SEQ ID NO: 298088 - protein, 8 aa, Influenza virus
RNEALNNR

SEQ ID NO: 298089 - protein, 8 aa, Influenza virus
NEALNNRF

SEQ ID NO: 298090 - protein, 8 aa, Influenza virus
EALNNRSQ

SEQ ID NO: 298091 - protein, 8 aa, Influenza virus
ALNNRSQI

SEQ ID NO: 298092 - protein, 8 aa, Influenza virus
LNNRSQIK

SEQ ID NO: 298093 - protein, 8 aa, Influenza virus
NNRSQIKG

SEQ ID NO: 298094 - protein, 8 aa, Influenza virus
NRSQIKGV

SEQ ID NO: 298095 - protein, 8 aa, Influenza virus
LKTGYKDW

SEQ ID NO: 298096 - protein, 8 aa, Influenza virus
EYKDWILW

SEQ ID NO: 298097 - protein, 8 aa, Influenza virus
YKNWILWI

SEQ ID NO: 298098 - protein, 8 aa, Influenza virus
KNWILWIS

SEQ ID NO: 298099 - protein, 8 aa, Influenza virus
NWILWISF

SEQ ID NO: 298100 - protein, 8 aa, Influenza virus
ILWISFAT

SEQ ID NO: 298101 - protein, 8 aa, Influenza virus
LWISFAMS

SEQ ID NO: 298102 - protein, 8 aa, Influenza virus
ISFAMSCF

SEQ ID NO: 298103 - protein, 8 aa, Influenza virus
SFAMSCFL

SEQ ID NO: 298104 - protein, 8 aa, Influenza virus
FAMSCFLL

SEQ ID NO: 298105 - protein, 8 aa, Influenza virus
AMSCFLLC

SEQ ID NO: 298106 - protein, 8 aa, Influenza virus
LGFIMWTC

SEQ ID NO: 298107 - protein, 8 aa, Influenza virus
GFIMWTCQ

SEQ ID NO: 298108 - protein, 8 aa, Influenza virus
FIMWTCQK

SEQ ID NO: 298109 - protein, 8 aa, Influenza virus
IMWTCQKG

SEQ ID NO: 298110 - protein, 8 aa, Influenza virus
ACQKGNIK

SEQ ID NO: 298111 - protein, 8 aa, Influenza virus
CQKGNIKC

SEQ ID NO: 298112 - protein, 8 aa, Influenza virus
QKGNIKCN

SEQ ID NO: 298113 - protein, 8 aa, Influenza virus
KGNIKCNI

SEQ ID NO: 298114 - protein, 8 aa, Influenza virus
GNIRCDIC

SEQ ID NO: 298115 - protein, 8 aa, Influenza virus
NIRCDICI

SEQ ID NO: 298116 - protein, 8 aa, Influenza virus
MYPIKKII

SEQ ID NO: 298117 - protein, 8 aa, Influenza virus
NPNKKIIT

SEQ ID NO: 298118 - protein, 8 aa, Influenza virus
PIKKIITI

SEQ ID NO: 298119 - protein, 8 aa, Influenza virus
KKIITIGS

SEQ ID NO: 298120 - protein, 8 aa, Influenza virus
KIITIGSA

SEQ ID NO: 298121 - protein, 8 aa, Influenza virus
TTITLHFK

SEQ ID NO: 298122 - protein, 8 aa, Influenza virus
TVTLHLKQ

SEQ ID NO: 298123 - protein, 8 aa, Influenza virus
YRDWSKPQ

SEQ ID NO: 298124 - protein, 8 aa, Influenza virus
RDWSKPQC

SEQ ID NO: 298125 - protein, 8 aa, Influenza virus
IRLAAGGD

SEQ ID NO: 298126 - protein, 8 aa, Influenza virus
RLAAGGDI

SEQ ID NO: 298127 - protein, 8 aa, Influenza virus
LAAGGDIW

SEQ ID NO: 298128 - protein, 8 aa, Influenza virus
AAGGDIWV

SEQ ID NO: 298129 - protein, 8 aa, Influenza virus
AIWVTREP

SEQ ID NO: 298130 - protein, 8 aa, Influenza virus
RELYVSCD

SEQ ID NO: 298131 - protein, 8 aa, Influenza virus
SKCYQFAL

SEQ ID NO: 298132 - protein, 8 aa, Influenza virus
LGQGTTLS

SEQ ID NO: 298133 - protein, 8 aa, Influenza virus
RTPHRTLL

SEQ ID NO: 298134 - protein, 8 aa, Influenza virus
TPHRTLLM

SEQ ID NO: 298135 - protein, 8 aa, Influenza virus
VPFYLGTK

SEQ ID NO: 298136 - protein, 8 aa, Influenza virus
LGTRQVCM

SEQ ID NO: 298137 - protein, 8 aa, Influenza virus
GTRQVCMA

SEQ ID NO: 298138 - protein, 8 aa, Influenza virus
TRQVCMAW

SEQ ID NO: 298139 - protein, 8 aa, Influenza virus
RQVCMAWS

SEQ ID NO: 298140 - protein, 8 aa, Influenza virus
DRNATASF

SEQ ID NO: 298141 - protein, 8 aa, Influenza virus
RNATASFI

SEQ ID NO: 298142 - protein, 8 aa, Influenza virus
ATASFIYG

SEQ ID NO: 298143 - protein, 8 aa, Influenza virus
TASFIYGG

SEQ ID NO: 298144 - protein, 8 aa, Influenza virus
LVDSVVSW

SEQ ID NO: 298145 - protein, 8 aa, Influenza virus
VDSVVSWS

SEQ ID NO: 298146 - protein, 8 aa, Influenza virus
NILRTQES

SEQ ID NO: 298147 - protein, 8 aa, Influenza virus
ICINGTCT

SEQ ID NO: 298148 - protein, 8 aa, Influenza virus
CISGTCAV

SEQ ID NO: 298149 - protein, 8 aa, Influenza virus
ISGTCAVV

SEQ ID NO: 298150 - protein, 8 aa, Influenza virus
SGTCAVVM

SEQ ID NO: 298151 - protein, 8 aa, Influenza virus
TVVMTDGN

SEQ ID NO: 298152 - protein, 8 aa, Influenza virus
MTDGSASD

SEQ ID NO: 298153 - protein, 8 aa, Influenza virus
LFIREGKI

SEQ ID NO: 298154 - protein, 8 aa, Influenza virus
LLGSAQHV

SEQ ID NO: 298155 - protein, 8 aa, Influenza virus
LGSAQHVE

SEQ ID NO: 298156 - protein, 8 aa, Influenza virus
CSCYPRYS

SEQ ID NO: 298157 - protein, 8 aa, Influenza virus
SCYPRYPD

SEQ ID NO: 298158 - protein, 8 aa, Influenza virus
NVRCVCRD

SEQ ID NO: 298159 - protein, 8 aa, Influenza virus
IRCVCRDN

SEQ ID NO: 298160 - protein, 8 aa, Influenza virus
CVCRDNWR

SEQ ID NO: 298161 - protein, 8 aa, Influenza virus
VCRDNWRG

SEQ ID NO: 298162 - protein, 8 aa, Influenza virus
KGSNRPVI

SEQ ID NO: 298163 - protein, 8 aa, Influenza virus
GSNRPVID

SEQ ID NO: 298164 - protein, 8 aa, Influenza virus
SNRPVIDI

SEQ ID NO: 298165 - protein, 8 aa, Influenza virus
NRPVIDIN

SEQ ID NO: 298166 - protein, 8 aa, Influenza virus
SSYMCSGL

SEQ ID NO: 298167 - protein, 8 aa, Influenza virus
SYMCSGLV

SEQ ID NO: 298168 - protein, 8 aa, Influenza virus
YLCSGLVG

SEQ ID NO: 298169 - protein, 8 aa, Influenza virus
LCSGLVGD

SEQ ID NO: 298170 - protein, 8 aa, Influenza virus
QGVKGWAF

SEQ ID NO: 298171 - protein, 8 aa, Influenza virus
KGWAFDNE

SEQ ID NO: 298172 - protein, 8 aa, Influenza virus
ENDVWMGR

SEQ ID NO: 298173 - protein, 8 aa, Influenza virus
NDIWMGRT

SEQ ID NO: 298174 - protein, 8 aa, Influenza virus
VWMGRTIG

SEQ ID NO: 298175 - protein, 8 aa, Influenza virus
WMGRTINE

SEQ ID NO: 298176 - protein, 8 aa, Influenza virus
SRSGYETF

SEQ ID NO: 298177 - protein, 8 aa, Influenza virus
RSGYETFR

SEQ ID NO: 298178 - protein, 8 aa, Influenza virus
SGYETFRV

SEQ ID NO: 298179 - protein, 8 aa, Influenza virus
GYETFKVV

SEQ ID NO: 298180 - protein, 8 aa, Influenza virus
QVNRQVIV

SEQ ID NO: 298181 - protein, 8 aa, Influenza virus
MSGYSGIF

SEQ ID NO: 298182 - protein, 8 aa, Influenza virus
SGIFSVEN

SEQ ID NO: 298183 - protein, 8 aa, Influenza virus
GIFSVENK

SEQ ID NO: 298184 - protein, 8 aa, Influenza virus
FSVENKSC

SEQ ID NO: 298185 - protein, 8 aa, Influenza virus
KNCINRCF

SEQ ID NO: 298186 - protein, 8 aa, Influenza virus
NCINRCFY

SEQ ID NO: 298187 - protein, 8 aa, Influenza virus
RVWWTSNS

SEQ ID NO: 298188 - protein, 8 aa, Influenza virus
SWPDGADL

SEQ ID NO: 298189 - protein, 8 aa, Influenza virus
DINLMPIY

SEQ ID NO: 298190 - protein, 8 aa, Influenza virus
INLMPIYS

SEQ ID NO: 298191 - protein, 8 aa, Influenza virus
GLMGRTRI

SEQ ID NO: 298192 - protein, 8 aa, Influenza virus
HTGNPVIC

SEQ ID NO: 298193 - protein, 8 aa, Influenza virus
TENPVICL

SEQ ID NO: 298194 - protein, 8 aa, Influenza virus
VICLGHHS

SEQ ID NO: 298195 - protein, 8 aa, Influenza virus
ICLGHHSV

SEQ ID NO: 298196 - protein, 8 aa, Influenza virus
GHHAVANG

SEQ ID NO: 298197 - protein, 8 aa, Influenza virus
HHAVANGT

SEQ ID NO: 298198 - protein, 8 aa, Influenza virus
VANGTMVK

SEQ ID NO: 298199 - protein, 8 aa, Influenza virus
ANGTMVKT

SEQ ID NO: 298200 - protein, 8 aa, Influenza virus
GTMVKTLA

SEQ ID NO: 298201 - protein, 8 aa, Influenza virus
TIVKTLTD

SEQ ID NO: 298202 - protein, 8 aa, Influenza virus
VKTLTDDK

SEQ ID NO: 298203 - protein, 8 aa, Influenza virus
IEVVAAQE

SEQ ID NO: 298204 - protein, 8 aa, Influenza virus
EVITAQEL

SEQ ID NO: 298205 - protein, 8 aa, Influenza virus
TAQELVEA

SEQ ID NO: 298206 - protein, 8 aa, Influenza virus
AQELVESK

SEQ ID NO: 298207 - protein, 8 aa, Influenza virus
QELCPSPL

SEQ ID NO: 298208 - protein, 8 aa, Influenza virus
ELCSSPLR

SEQ ID NO: 298209 - protein, 8 aa, Influenza virus
LCPKPLKL

SEQ ID NO: 298210 - protein, 8 aa, Influenza virus
CPSPLKLI

SEQ ID NO: 298211 - protein, 8 aa, Influenza virus
PSPLKLID

SEQ ID NO: 298212 - protein, 8 aa, Influenza virus
SPLKLIDG

SEQ ID NO: 298213 - protein, 8 aa, Influenza virus
PLKLVDGQ

SEQ ID NO: 298214 - protein, 8 aa, Influenza virus
CDIVNSAL

SEQ ID NO: 298215 - protein, 8 aa, Influenza virus
DIVNSALG

SEQ ID NO: 298216 - protein, 8 aa, Influenza virus
IVNSALGS

SEQ ID NO: 298217 - protein, 8 aa, Influenza virus
VNSALGSP

SEQ ID NO: 298218 - protein, 8 aa, Influenza virus
EWDVYIER

SEQ ID NO: 298219 - protein, 8 aa, Influenza virus
WDVYIERP

SEQ ID NO: 298220 - protein, 8 aa, Influenza virus
CYPFDVPN

SEQ ID NO: 298221 - protein, 8 aa, Influenza virus
YPFDVPGY

SEQ ID NO: 298222 - protein, 8 aa, Influenza virus
PFDVPGYQ

SEQ ID NO: 298223 - protein, 8 aa, Influenza virus
FDVPNYQS

SEQ ID NO: 298224 - protein, 8 aa, Influenza virus
DVPNYQSL

SEQ ID NO: 298225 - protein, 8 aa, Influenza virus
VPNYQSLR

SEQ ID NO: 298226 - protein, 8 aa, Influenza virus
PNYQSLRS

SEQ ID NO: 298227 - protein, 8 aa, Influenza virus
DYQSIRSI

SEQ ID NO: 298228 - protein, 8 aa, Influenza virus
NGKFEFIV

SEQ ID NO: 298229 - protein, 8 aa, Influenza virus
GKFEFIVE

SEQ ID NO: 298230 - protein, 8 aa, Influenza virus
KFEFIAED

SEQ ID NO: 298231 - protein, 8 aa, Influenza virus
FEFIVEKF

SEQ ID NO: 298232 - protein, 8 aa, Influenza virus
FIAEDFQW

SEQ ID NO: 298233 - protein, 8 aa, Influenza virus
TIKQNGKS

SEQ ID NO: 298234 - protein, 8 aa, Influenza virus
VKQDGKSS

SEQ ID NO: 298235 - protein, 8 aa, Influenza virus
KQDGKSSA

SEQ ID NO: 298236 - protein, 8 aa, Influenza virus
QDGKSSAC

SEQ ID NO: 298237 - protein, 8 aa, Influenza virus
DGKSSACK

SEQ ID NO: 298238 - protein, 8 aa, Influenza virus
SGACKRAD

SEQ ID NO: 298239 - protein, 8 aa, Influenza virus
RANVDDFF

SEQ ID NO: 298240 - protein, 8 aa, Influenza virus
DDFFNRLN

SEQ ID NO: 298241 - protein, 8 aa, Influenza virus
DFFKRLNW

SEQ ID NO: 298242 - protein, 8 aa, Influenza virus
FFKRLNWL

SEQ ID NO: 298243 - protein, 8 aa, Influenza virus
RLNWLIKS

SEQ ID NO: 298244 - protein, 8 aa, Influenza virus
LNWLTKSN

SEQ ID NO: 298245 - protein, 8 aa, Influenza virus
AYPIQNLT

SEQ ID NO: 298246 - protein, 8 aa, Influenza virus
PLQNLTKT

SEQ ID NO: 298247 - protein, 8 aa, Influenza virus
LQNLTKTN

SEQ ID NO: 298248 - protein, 8 aa, Influenza virus
QNLTKVNS

SEQ ID NO: 298249 - protein, 8 aa, Influenza virus
NLTKVNSG

SEQ ID NO: 298250 - protein, 8 aa, Influenza virus
LTKVNSGD

SEQ ID NO: 298251 - protein, 8 aa, Influenza virus
TKVNNGNY

SEQ ID NO: 298252 - protein, 8 aa, Influenza virus
NSGDYARL

SEQ ID NO: 298253 - protein, 8 aa, Influenza virus
SGDYARLY

SEQ ID NO: 298254 - protein, 8 aa, Influenza virus
GNYARLYI

SEQ ID NO: 298255 - protein, 8 aa, Influenza virus
NYARLYIW

SEQ ID NO: 298256 - protein, 8 aa, Influenza virus
VHHPSTDA

SEQ ID NO: 298257 - protein, 8 aa, Influenza virus
HHPSTDAE

SEQ ID NO: 298258 - protein, 8 aa, Influenza virus
HPSTDAEQ

SEQ ID NO: 298259 - protein, 8 aa, Influenza virus
LYENNPGR

SEQ ID NO: 298260 - protein, 8 aa, Influenza virus
YENNPGRV

SEQ ID NO: 298261 - protein, 8 aa, Influenza virus
ENNPGRVT

SEQ ID NO: 298262 - protein, 8 aa, Influenza virus
NNPGRVSV

SEQ ID NO: 298263 - protein, 8 aa, Influenza virus
NPGRVSVS

SEQ ID NO: 298264 - protein, 8 aa, Influenza virus
GRVSVSTK

SEQ ID NO: 298265 - protein, 8 aa, Influenza virus
QTSVVPDI

SEQ ID NO: 298266 - protein, 8 aa, Influenza virus
TSIVPNIG

SEQ ID NO: 298267 - protein, 8 aa, Influenza virus
SVVPDIGS

SEQ ID NO: 298268 - protein, 8 aa, Influenza virus
RPLVRSQS

SEQ ID NO: 298269 - protein, 8 aa, Influenza virus
PLVRSQSG

SEQ ID NO: 298270 - protein, 8 aa, Influenza virus
LVRSQSGR

SEQ ID NO: 298271 - protein, 8 aa, Influenza virus
VRSQSGRI

SEQ ID NO: 298272 - protein, 8 aa, Influenza virus
RSQSGRIS

SEQ ID NO: 298273 - protein, 8 aa, Influenza virus
SQSGRISF

SEQ ID NO: 298274 - protein, 8 aa, Influenza virus
LSSRISFY

SEQ ID NO: 298275 - protein, 8 aa, Influenza virus
SSRISFYW

SEQ ID NO: 298276 - protein, 8 aa, Influenza virus
SLYWTIVE

SEQ ID NO: 298277 - protein, 8 aa, Influenza virus
WTIVEPGN

SEQ ID NO: 298278 - protein, 8 aa, Influenza virus
PGDLILFN

SEQ ID NO: 298279 - protein, 8 aa, Influenza virus
GDLILFNT

SEQ ID NO: 298280 - protein, 8 aa, Influenza virus
DLILFNTI

SEQ ID NO: 298281 - protein, 8 aa, Influenza virus
LILFNTIG

SEQ ID NO: 298282 - protein, 8 aa, Influenza virus
IAPRGHYR

SEQ ID NO: 298283 - protein, 8 aa, Influenza virus
IGSCESKC

SEQ ID NO: 298284 - protein, 8 aa, Influenza virus
GSCESKCH

SEQ ID NO: 298285 - protein, 8 aa, Influenza virus
SCESKCHT

SEQ ID NO: 298286 - protein, 8 aa, Influenza virus
SRCHTDKG

SEQ ID NO: 298287 - protein, 8 aa, Influenza virus
RCHTDKGS

SEQ ID NO: 298288 - protein, 8 aa, Influenza virus
RPFQNISR

SEQ ID NO: 298289 - protein, 8 aa, Influenza virus
PFQNVSRI

SEQ ID NO: 298290 - protein, 8 aa, Influenza virus
FQNISRVS

SEQ ID NO: 298291 - protein, 8 aa, Influenza virus
GECPKYVK

SEQ ID NO: 298292 - protein, 8 aa, Influenza virus
DCPKYIKQ

SEQ ID NO: 298293 - protein, 8 aa, Influenza virus
CPRYVKQG

SEQ ID NO: 298294 - protein, 8 aa, Influenza virus
PRYVKQGS

SEQ ID NO: 298295 - protein, 8 aa, Influenza virus
RYVKQGSL

SEQ ID NO: 298296 - protein, 8 aa, Influenza virus
YVKQGSLR

SEQ ID NO: 298297 - protein, 8 aa, Influenza virus
VKQGSLRL

SEQ ID NO: 298298 - protein, 8 aa, Influenza virus
TQAAINQI

SEQ ID NO: 298299 - protein, 8 aa, Influenza virus
QTAIDQIT

SEQ ID NO: 298300 - protein, 8 aa, Influenza virus
TAIDQITG

SEQ ID NO: 298301 - protein, 8 aa, Influenza virus
AINQINGK

SEQ ID NO: 298302 - protein, 8 aa, Influenza virus
IDQVNGKL

SEQ ID NO: 298303 - protein, 8 aa, Influenza virus
DQVNGKLN

SEQ ID NO: 298304 - protein, 8 aa, Influenza virus
QISGKLNR

SEQ ID NO: 298305 - protein, 8 aa, Influenza virus
RLIEKTND

SEQ ID NO: 298306 - protein, 8 aa, Influenza virus
LIERTNEK

SEQ ID NO: 298307 - protein, 8 aa, Influenza virus
IERTNEKY

SEQ ID NO: 298308 - protein, 8 aa, Influenza virus
ERTNEKYH

SEQ ID NO: 298309 - protein, 8 aa, Influenza virus
RTNEKYHQ

SEQ ID NO: 298310 - protein, 8 aa, Influenza virus
FEQVEGRT

SEQ ID NO: 298311 - protein, 8 aa, Influenza virus
EQVEGRTQ

SEQ ID NO: 298312 - protein, 8 aa, Influenza virus
QVEGRIQY

SEQ ID NO: 298313 - protein, 8 aa, Influenza virus
VEGRIQYL

SEQ ID NO: 298314 - protein, 8 aa, Influenza virus
EGRIQYLE

SEQ ID NO: 298315 - protein, 8 aa, Influenza virus
QDLENYVE

SEQ ID NO: 298316 - protein, 8 aa, Influenza virus
DLENYVED

SEQ ID NO: 298317 - protein, 8 aa, Influenza virus
LEEYVEDT

SEQ ID NO: 298318 - protein, 8 aa, Influenza virus
EEYVEDTK

SEQ ID NO: 298319 - protein, 8 aa, Influenza virus
RYVEDTKI

SEQ ID NO: 298320 - protein, 8 aa, Influenza virus
HTIDVADS

SEQ ID NO: 298321 - protein, 8 aa, Influenza virus
IIDVTDSE

SEQ ID NO: 298322 - protein, 8 aa, Influenza virus
DVTDSEMD

SEQ ID NO: 298323 - protein, 8 aa, Influenza virus
VTDSEMDK

SEQ ID NO: 298324 - protein, 8 aa, Influenza virus
TDSEMNRL

SEQ ID NO: 298325 - protein, 8 aa, Influenza virus
DSEMDKLF

SEQ ID NO: 298326 - protein, 8 aa, Influenza virus
SEMNRLFE

SEQ ID NO: 298327 - protein, 8 aa, Influenza virus
EMDKLFER

SEQ ID NO: 298328 - protein, 8 aa, Influenza virus
MDKLFERV

SEQ ID NO: 298329 - protein, 8 aa, Influenza virus
DKLFERVR

SEQ ID NO: 298330 - protein, 8 aa, Influenza virus
KLFERVKR

SEQ ID NO: 298331 - protein, 8 aa, Influenza virus
LFERVKRQ

SEQ ID NO: 298332 - protein, 8 aa, Influenza virus
FERVKRQL

SEQ ID NO: 298333 - protein, 8 aa, Influenza virus
ERVKRQLR

SEQ ID NO: 298334 - protein, 8 aa, Influenza virus
RVKRQLRE

SEQ ID NO: 298335 - protein, 8 aa, Influenza virus
VKRQLREN

SEQ ID NO: 298336 - protein, 8 aa, Influenza virus
GCFEIFHR

SEQ ID NO: 298337 - protein, 8 aa, Influenza virus
CFEIFHRC

SEQ ID NO: 298338 - protein, 8 aa, Influenza virus
FEIFHRCD

SEQ ID NO: 298339 - protein, 8 aa, Influenza virus
EIFHRCDN

SEQ ID NO: 298340 - protein, 8 aa, Influenza virus
CDNKCIES

SEQ ID NO: 298341 - protein, 8 aa, Influenza virus
DNKCIESI

SEQ ID NO: 298342 - protein, 8 aa, Influenza virus
NKCIESIR

SEQ ID NO: 298343 - protein, 8 aa, Influenza virus
KCIESIRN

SEQ ID NO: 298344 - protein, 8 aa, Influenza virus
RNGTYDHN

SEQ ID NO: 298345 - protein, 8 aa, Influenza virus
TYNHDIYR

SEQ ID NO: 298346 - protein, 8 aa, Influenza virus
HDIYRNEA

SEQ ID NO: 298347 - protein, 8 aa, Influenza virus
DIYRNEAI

SEQ ID NO: 298348 - protein, 8 aa, Influenza virus
IYRNEAIN

SEQ ID NO: 298349 - protein, 8 aa, Influenza virus
YRNEAINN

SEQ ID NO: 298350 - protein, 8 aa, Influenza virus
RNEAINNR

SEQ ID NO: 298351 - protein, 8 aa, Influenza virus
NEAINNRF

SEQ ID NO: 298352 - protein, 8 aa, Influenza virus
EAINSRFQ

SEQ ID NO: 298353 - protein, 8 aa, Influenza virus
AINSRFQI

SEQ ID NO: 298354 - protein, 8 aa, Influenza virus
INSRFQIQ

SEQ ID NO: 298355 - protein, 8 aa, Influenza virus
NSRFQIQG

SEQ ID NO: 298356 - protein, 8 aa, Influenza virus
NRFQIQGI

SEQ ID NO: 298357 - protein, 8 aa, Influenza virus
RFQIQGIK

SEQ ID NO: 298358 - protein, 8 aa, Influenza virus
FQIQGIKL

SEQ ID NO: 298359 - protein, 8 aa, Influenza virus
QIQGVKLA

SEQ ID NO: 298360 - protein, 8 aa, Influenza virus
IQGVKLAQ

SEQ ID NO: 298361 - protein, 8 aa, Influenza virus
QGVKLAQG

SEQ ID NO: 298362 - protein, 8 aa, Influenza virus
GVKLAQGY

SEQ ID NO: 298363 - protein, 8 aa, Influenza virus
VKLAQGYK

SEQ ID NO: 298364 - protein, 8 aa, Influenza virus
KLAQGYKD

SEQ ID NO: 298365 - protein, 8 aa, Influenza virus
LIQGYKDI

SEQ ID NO: 298366 - protein, 8 aa, Influenza virus
IQGYKDII

SEQ ID NO: 298367 - protein, 8 aa, Influenza virus
YKDIILWF

SEQ ID NO: 298368 - protein, 8 aa, Influenza virus
KDIILWFS

SEQ ID NO: 298369 - protein, 8 aa, Influenza virus
DVILWISF

SEQ ID NO: 298370 - protein, 8 aa, Influenza virus
VILWISFS

SEQ ID NO: 298371 - protein, 8 aa, Influenza virus
SISCFLLI

SEQ ID NO: 298372 - protein, 8 aa, Influenza virus
ISCFLLIA

SEQ ID NO: 298373 - protein, 8 aa, Influenza virus
CFLLIALL

SEQ ID NO: 298374 - protein, 8 aa, Influenza virus
FLLVALLI

SEQ ID NO: 298375 - protein, 8 aa, Influenza virus
ALLLAFVL

SEQ ID NO: 298376 - protein, 8 aa, Influenza virus
LLLAFMLW

SEQ ID NO: 298377 - protein, 8 aa, Influenza virus
LLAFMLWA

SEQ ID NO: 298378 - protein, 8 aa, Influenza virus
LAFMLWAC

SEQ ID NO: 298379 - protein, 8 aa, Influenza virus
AFMLWACQ

SEQ ID NO: 298380 - protein, 8 aa, Influenza virus
FMLWACQN

SEQ ID NO: 298381 - protein, 8 aa, Influenza virus
MLWACQNG

SEQ ID NO: 298382 - protein, 8 aa, Influenza virus
LWACQNEN

SEQ ID NO: 298383 - protein, 8 aa, Influenza virus
WACQNGNV

SEQ ID NO: 298384 - protein, 8 aa, Influenza virus
ACQNGNVR

SEQ ID NO: 298385 - protein, 8 aa, Influenza virus
CQNGNVRC

SEQ ID NO: 298386 - protein, 8 aa, Influenza virus
QNGNVRCQ

SEQ ID NO: 298387 - protein, 8 aa, Influenza virus
NGNVRCQI

SEQ ID NO: 298388 - protein, 8 aa, Influenza virus
GNVRCQIC

SEQ ID NO: 298389 - protein, 8 aa, Influenza virus
SDHICIGY

SEQ ID NO: 298390 - protein, 8 aa, Influenza virus
DRICIGYH

SEQ ID NO: 298391 - protein, 8 aa, Influenza virus
RICIGYHA

SEQ ID NO: 298392 - protein, 8 aa, Influenza virus
YHANNSTV

SEQ ID NO: 298393 - protein, 8 aa, Influenza virus
HANNSTVQ

SEQ ID NO: 298394 - protein, 8 aa, Influenza virus
STVQVDTI

SEQ ID NO: 298395 - protein, 8 aa, Influenza virus
VQVDTIME

SEQ ID NO: 298396 - protein, 8 aa, Influenza virus
QVDTIMER

SEQ ID NO: 298397 - protein, 8 aa, Influenza virus
EKNITVTH

SEQ ID NO: 298398 - protein, 8 aa, Influenza virus
KNITVTHA

SEQ ID NO: 298399 - protein, 8 aa, Influenza virus
NITVTHAQ

SEQ ID NO: 298400 - protein, 8 aa, Influenza virus
VTVTHAKD

SEQ ID NO: 298401 - protein, 8 aa, Influenza virus
TVTHAKDI

SEQ ID NO: 298402 - protein, 8 aa, Influenza virus
VTHAKDIL

SEQ ID NO: 298403 - protein, 8 aa, Influenza virus
THAKDILE

SEQ ID NO: 298404 - protein, 8 aa, Influenza virus
HAQNILEK

SEQ ID NO: 298405 - protein, 8 aa, Influenza virus
GVRPLILK

SEQ ID NO: 298406 - protein, 8 aa, Influenza virus
RPLILKDC

SEQ ID NO: 298407 - protein, 8 aa, Influenza virus
PLILGDCS

SEQ ID NO: 298408 - protein, 8 aa, Influenza virus
LILKDCSI

SEQ ID NO: 298409 - protein, 8 aa, Influenza virus
ILKDCSIA

SEQ ID NO: 298410 - protein, 8 aa, Influenza virus
LKDCSIAG

SEQ ID NO: 298411 - protein, 8 aa, Influenza virus
KDCSIAGW

SEQ ID NO: 298412 - protein, 8 aa, Influenza virus
LGNPMCDK

SEQ ID NO: 298413 - protein, 8 aa, Influenza virus
GNPMCDKF

SEQ ID NO: 298414 - protein, 8 aa, Influenza virus
DVPEWSYI

SEQ ID NO: 298415 - protein, 8 aa, Influenza virus
DYEELKYL

SEQ ID NO: 298416 - protein, 8 aa, Influenza virus
SGRSSFFR

SEQ ID NO: 298417 - protein, 8 aa, Influenza virus
SFFRNVIW

SEQ ID NO: 298418 - protein, 8 aa, Influenza virus
FFRNVIWL

SEQ ID NO: 298419 - protein, 8 aa, Influenza virus
LLIIWGIH

SEQ ID NO: 298420 - protein, 8 aa, Influenza virus
LIIWGIHH

SEQ ID NO: 298421 - protein, 8 aa, Influenza virus
YISIGTST

SEQ ID NO: 298422 - protein, 8 aa, Influenza virus
ISIGTSTL

SEQ ID NO: 298423 - protein, 8 aa, Influenza virus
VGTSTLNL

SEQ ID NO: 298424 - protein, 8 aa, Influenza virus
TSTLNLRL

SEQ ID NO: 298425 - protein, 8 aa, Influenza virus
FDSNGNFI

SEQ ID NO: 298426 - protein, 8 aa, Influenza virus
DSNGNFIA

SEQ ID NO: 298427 - protein, 8 aa, Influenza virus
NGNFITPE

SEQ ID NO: 298428 - protein, 8 aa, Influenza virus
IAPEYAYI

SEQ ID NO: 298429 - protein, 8 aa, Influenza virus
APEYAYIV

SEQ ID NO: 298430 - protein, 8 aa, Influenza virus
CQTPVGAI

SEQ ID NO: 298431 - protein, 8 aa, Influenza virus
QTPVGAIN

SEQ ID NO: 298432 - protein, 8 aa, Influenza virus
GAVNSSMP

SEQ ID NO: 298433 - protein, 8 aa, Influenza virus
NSSMPLHN

SEQ ID NO: 298434 - protein, 8 aa, Influenza virus
SSLPFHNV

SEQ ID NO: 298435 - protein, 8 aa, Influenza virus
SLPFHNVH

SEQ ID NO: 298436 - protein, 8 aa, Influenza virus
LPFHNVHP

SEQ ID NO: 298437 - protein, 8 aa, Influenza virus
PFHNVHPF

SEQ ID NO: 298438 - protein, 8 aa, Influenza virus
FHNVHPFT

SEQ ID NO: 298439 - protein, 8 aa, Influenza virus
HNVHPFTI

SEQ ID NO: 298440 - protein, 8 aa, Influenza virus
NVHPFTIG

SEQ ID NO: 298441 - protein, 8 aa, Influenza virus
VHPFTIGE

SEQ ID NO: 298442 - protein, 8 aa, Influenza virus
HPLTIGKC

SEQ ID NO: 298443 - protein, 8 aa, Influenza virus
PLTIGKCP

SEQ ID NO: 298444 - protein, 8 aa, Influenza virus
FTIGECPR

SEQ ID NO: 298445 - protein, 8 aa, Influenza virus
TIGKCPKY

SEQ ID NO: 298446 - protein, 8 aa, Influenza virus
IGKCPKYV

SEQ ID NO: 298447 - protein, 8 aa, Influenza virus
GKCPKYVK

SEQ ID NO: 298448 - protein, 8 aa, Influenza virus
KCPKYVKS

SEQ ID NO: 298449 - protein, 8 aa, Influenza virus
LILATGLR

SEQ ID NO: 298450 - protein, 8 aa, Influenza virus
ILATGLRN

SEQ ID NO: 298451 - protein, 8 aa, Influenza virus
RRRKRGLF

SEQ ID NO: 298452 - protein, 8 aa, Influenza virus
RKRGLFGA

SEQ ID NO: 298453 - protein, 8 aa, Influenza virus
MIDGWYGY

SEQ ID NO: 298454 - protein, 8 aa, Influenza virus
IDGWYGYH

SEQ ID NO: 298455 - protein, 8 aa, Influenza virus
GWYGYHHN

SEQ ID NO: 298456 - protein, 8 aa, Influenza virus
WYGYHHNN

SEQ ID NO: 298457 - protein, 8 aa, Influenza virus
NDQGSGYA

SEQ ID NO: 298458 - protein, 8 aa, Influenza virus
GSGYAADR

SEQ ID NO: 298459 - protein, 8 aa, Influenza virus
SGYAADKK

SEQ ID NO: 298460 - protein, 8 aa, Influenza virus
GYAADKKS

SEQ ID NO: 298461 - protein, 8 aa, Influenza virus
YAADKKST

SEQ ID NO: 298462 - protein, 8 aa, Influenza virus
AADKKSTQ

SEQ ID NO: 298463 - protein, 8 aa, Influenza virus
ADQESTQK

SEQ ID NO: 298464 - protein, 8 aa, Influenza virus
DQESTQKA

SEQ ID NO: 298465 - protein, 8 aa, Influenza virus
ESTQKAIN

SEQ ID NO: 298466 - protein, 8 aa, Influenza virus
STQKAING

SEQ ID NO: 298467 - protein, 8 aa, Influenza virus
NGITNKVN

SEQ ID NO: 298468 - protein, 8 aa, Influenza virus
GITNKINS

SEQ ID NO: 298469 - protein, 8 aa, Influenza virus
ITNKINSI

SEQ ID NO: 298470 - protein, 8 aa, Influenza virus
NKVNSIIG

SEQ ID NO: 298471 - protein, 8 aa, Influenza virus
KVNSIIGK

SEQ ID NO: 298472 - protein, 8 aa, Influenza virus
VNSIIGKM

SEQ ID NO: 298473 - protein, 8 aa, Influenza virus
NSIIGKMN

SEQ ID NO: 298474 - protein, 8 aa, Influenza virus
SIIGKMNT

SEQ ID NO: 298475 - protein, 8 aa, Influenza virus
IIGKMNTQ

SEQ ID NO: 298476 - protein, 8 aa, Influenza virus
IGKMNTQF

SEQ ID NO: 298477 - protein, 8 aa, Influenza virus
LERRIESL

SEQ ID NO: 298478 - protein, 8 aa, Influenza virus
ERRIESLN

SEQ ID NO: 298479 - protein, 8 aa, Influenza virus
SLNKKMED

SEQ ID NO: 298480 - protein, 8 aa, Influenza virus
LNKKMEDD

SEQ ID NO: 298481 - protein, 8 aa, Influenza virus
NKKMEDDF

SEQ ID NO: 298482 - protein, 8 aa, Influenza virus
EDGFIDVW

SEQ ID NO: 298483 - protein, 8 aa, Influenza virus
GFIDVWTY

SEQ ID NO: 298484 - protein, 8 aa, Influenza virus
FIDVWTYN

SEQ ID NO: 298485 - protein, 8 aa, Influenza virus
IDVWTYNA

SEQ ID NO: 298486 - protein, 8 aa, Influenza virus
GVWTYNAE

SEQ ID NO: 298487 - protein, 8 aa, Influenza virus
DFHDSNVR

SEQ ID NO: 298488 - protein, 8 aa, Influenza virus
FHDSNVRN

SEQ ID NO: 298489 - protein, 8 aa, Influenza virus
SNVRNLYD

SEQ ID NO: 298490 - protein, 8 aa, Influenza virus
NVRNLYDK

SEQ ID NO: 298491 - protein, 8 aa, Influenza virus
VRNLYDKV

SEQ ID NO: 298492 - protein, 8 aa, Influenza virus
RNLYDKVR

SEQ ID NO: 298493 - protein, 8 aa, Influenza virus
NLYNKVRL

SEQ ID NO: 298494 - protein, 8 aa, Influenza virus
LYDRVRLQ

SEQ ID NO: 298495 - protein, 8 aa, Influenza virus
YDRVRLQL

SEQ ID NO: 298496 - protein, 8 aa, Influenza virus
RVRLQLRD

SEQ ID NO: 298497 - protein, 8 aa, Influenza virus
LQLKDNAR

SEQ ID NO: 298498 - protein, 8 aa, Influenza virus
QLKDNARE

SEQ ID NO: 298499 - protein, 8 aa, Influenza virus
LKDNAREL

SEQ ID NO: 298500 - protein, 8 aa, Influenza virus
KDNARELG

SEQ ID NO: 298501 - protein, 8 aa, Influenza virus
FEFYHKCN

SEQ ID NO: 298502 - protein, 8 aa, Influenza virus
EFYHKCDD

SEQ ID NO: 298503 - protein, 8 aa, Influenza virus
CMESVKNG

SEQ ID NO: 298504 - protein, 8 aa, Influenza virus
MESVKNGT

SEQ ID NO: 298505 - protein, 8 aa, Influenza virus
ESVKNGTY

SEQ ID NO: 298506 - protein, 8 aa, Influenza virus
VYQILSIY

SEQ ID NO: 298507 - protein, 8 aa, Influenza virus
ILSLYSTV

SEQ ID NO: 298508 - protein, 8 aa, Influenza virus
LSIYSTVV

SEQ ID NO: 298509 - protein, 8 aa, Influenza virus
SIYSTVVS

SEQ ID NO: 298510 - protein, 8 aa, Influenza virus
IYSTVVSS

SEQ ID NO: 298511 - protein, 8 aa, Influenza virus
YSTVVSSL

SEQ ID NO: 298512 - protein, 8 aa, Influenza virus
ASSLTLAI

SEQ ID NO: 298513 - protein, 8 aa, Influenza virus
SSLTLAIM

SEQ ID NO: 298514 - protein, 8 aa, Influenza virus
LAIMMAGL

SEQ ID NO: 298515 - protein, 8 aa, Influenza virus
AGLFLWMC

SEQ ID NO: 298516 - protein, 8 aa, Influenza virus
GLFLWMCS

SEQ ID NO: 298517 - protein, 8 aa, Influenza virus
LFLWMCSN

SEQ ID NO: 298518 - protein, 8 aa, Influenza virus
FLWMCSNG

SEQ ID NO: 298519 - protein, 8 aa, Influenza virus
GSLQCRIA

SEQ ID NO: 298520 - protein, 8 aa, Influenza virus
SLQCKICI

SEQ ID NO: 298521 - protein, 8 aa, Influenza virus
CIKFVSSD

SEQ ID NO: 298522 - protein, 8 aa, Influenza virus
RFVNSDCS

SEQ ID NO: 298523 - protein, 8 aa, Influenza virus
GDQICIGY

SEQ ID NO: 298524 - protein, 8 aa, Influenza virus
DQICVGYH

SEQ ID NO: 298525 - protein, 8 aa, Influenza virus
QICVGYHA

SEQ ID NO: 298526 - protein, 8 aa, Influenza virus
YHANNSTV

SEQ ID NO: 298527 - protein, 8 aa, Influenza virus
HANNSTVQ

SEQ ID NO: 298528 - protein, 8 aa, Influenza virus
ANNSTVQV

SEQ ID NO: 298529 - protein, 8 aa, Influenza virus
NNSTVQVD

SEQ ID NO: 298530 - protein, 8 aa, Influenza virus
NSTVQVDT

SEQ ID NO: 298531 - protein, 8 aa, Influenza virus
STVQVDTI

SEQ ID NO: 298532 - protein, 8 aa, Influenza virus
TVQVDTIM

SEQ ID NO: 298533 - protein, 8 aa, Influenza virus
VQVDTIME

SEQ ID NO: 298534 - protein, 8 aa, Influenza virus
RVDTIMEK

SEQ ID NO: 298535 - protein, 8 aa, Influenza virus
VTVTHAKD

SEQ ID NO: 298536 - protein, 8 aa, Influenza virus
HAQNILEK

SEQ ID NO: 298537 - protein, 8 aa, Influenza virus
DILEKAHN

SEQ ID NO: 298538 - protein, 8 aa, Influenza virus
ILEKAHNG

SEQ ID NO: 298539 - protein, 8 aa, Influenza virus
HNGKLCSL

SEQ ID NO: 298540 - protein, 8 aa, Influenza virus
LKGVRPLI

SEQ ID NO: 298541 - protein, 8 aa, Influenza virus
KGVRPLIL

SEQ ID NO: 298542 - protein, 8 aa, Influenza virus
GVRPLILK

SEQ ID NO: 298543 - protein, 8 aa, Influenza virus
VRPLILKD

SEQ ID NO: 298544 - protein, 8 aa, Influenza virus
RPLILRDC

SEQ ID NO: 298545 - protein, 8 aa, Influenza virus
DVPEWSYI

SEQ ID NO: 298546 - protein, 8 aa, Influenza virus
WSYIVEKD

SEQ ID NO: 298547 - protein, 8 aa, Influenza virus
LNDYEELK

SEQ ID NO: 298548 - protein, 8 aa, Influenza virus
SDYEELKH

SEQ ID NO: 298549 - protein, 8 aa, Influenza virus
EELKHLLN

SEQ ID NO: 298550 - protein, 8 aa, Influenza virus
ELKHLLSS

SEQ ID NO: 298551 - protein, 8 aa, Influenza virus
LKHLLSST

SEQ ID NO: 298552 - protein, 8 aa, Influenza virus
KHLLSSTN

SEQ ID NO: 298553 - protein, 8 aa, Influenza virus
SFFRNVIW

SEQ ID NO: 298554 - protein, 8 aa, Influenza virus
FFRNVIWL

SEQ ID NO: 298555 - protein, 8 aa, Influenza virus
EDLLVMWG

SEQ ID NO: 298556 - protein, 8 aa, Influenza virus
LLVMWGIH

SEQ ID NO: 298557 - protein, 8 aa, Influenza virus
LVMWGIHH

SEQ ID NO: 298558 - protein, 8 aa, Influenza virus
MWGIHHPN

SEQ ID NO: 298559 - protein, 8 aa, Influenza virus
WGIHHPNN

SEQ ID NO: 298560 - protein, 8 aa, Influenza virus
TYVSVGTS

SEQ ID NO: 298561 - protein, 8 aa, Influenza virus
YVSVGTST

SEQ ID NO: 298562 - protein, 8 aa, Influenza virus
VSVGTSTL

SEQ ID NO: 298563 - protein, 8 aa, Influenza virus
VGTSTLNL

SEQ ID NO: 298564 - protein, 8 aa, Influenza virus
TSTLNQRS

SEQ ID NO: 298565 - protein, 8 aa, Influenza virus
KINGQRGR

SEQ ID NO: 298566 - protein, 8 aa, Influenza virus
ISFESNGN

SEQ ID NO: 298567 - protein, 8 aa, Influenza virus
SFESNGNF

SEQ ID NO: 298568 - protein, 8 aa, Influenza virus
IAPEYAYI

SEQ ID NO: 298569 - protein, 8 aa, Influenza virus
APEYAYIV

SEQ ID NO: 298570 - protein, 8 aa, Influenza virus
PEYAYIVK

SEQ ID NO: 298571 - protein, 8 aa, Influenza virus
EYAYIVKK

SEQ ID NO: 298572 - protein, 8 aa, Influenza virus
YAYKIVKE

SEQ ID NO: 298573 - protein, 8 aa, Influenza virus
AYIVKKGD

SEQ ID NO: 298574 - protein, 8 aa, Influenza virus
YIVKKGDS

SEQ ID NO: 298575 - protein, 8 aa, Influenza virus
KIVKTGDS

SEQ ID NO: 298576 - protein, 8 aa, Influenza virus
CSTKCQTP

SEQ ID NO: 298577 - protein, 8 aa, Influenza virus
CQTPVGAI

SEQ ID NO: 298578 - protein, 8 aa, Influenza virus
QTPVGAIN

SEQ ID NO: 298579 - protein, 8 aa, Influenza virus
TPVGAINS

SEQ ID NO: 298580 - protein, 8 aa, Influenza virus
PVGAINSS

SEQ ID NO: 298581 - protein, 8 aa, Influenza virus
VGAINSSM

SEQ ID NO: 298582 - protein, 8 aa, Influenza virus
AINSSMPL

SEQ ID NO: 298583 - protein, 8 aa, Influenza virus
INSSMPLH

SEQ ID NO: 298584 - protein, 8 aa, Influenza virus
IHPLTIGK

SEQ ID NO: 298585 - protein, 8 aa, Influenza virus
CPKYVKSS

SEQ ID NO: 298586 - protein, 8 aa, Influenza virus
RLILATGL

SEQ ID NO: 298587 - protein, 8 aa, Influenza virus
LATGLRNA

SEQ ID NO: 298588 - protein, 8 aa, Influenza virus
RRKRGLFG

SEQ ID NO: 298589 - protein, 8 aa, Influenza virus
RKRGLFGA

SEQ ID NO: 298590 - protein, 8 aa, Influenza virus
MIDGWYGY

SEQ ID NO: 298591 - protein, 8 aa, Influenza virus
IDGWYGYH

SEQ ID NO: 298592 - protein, 8 aa, Influenza virus
WYGYHHNN

SEQ ID NO: 298593 - protein, 8 aa, Influenza virus
YGYHHSNG

SEQ ID NO: 298594 - protein, 8 aa, Influenza virus
GYHHSNGQ

SEQ ID NO: 298595 - protein, 8 aa, Influenza virus
YHHSNGQG

SEQ ID NO: 298596 - protein, 8 aa, Influenza virus
HHNNEQGS

SEQ ID NO: 298597 - protein, 8 aa, Influenza virus
HNNEQGSG

SEQ ID NO: 298598 - protein, 8 aa, Influenza virus
NNEQGSGY

SEQ ID NO: 298599 - protein, 8 aa, Influenza virus
SGYAADRE

SEQ ID NO: 298600 - protein, 8 aa, Influenza virus
GYAADRES

SEQ ID NO: 298601 - protein, 8 aa, Influenza virus
YAADREST

SEQ ID NO: 298602 - protein, 8 aa, Influenza virus
AADRESTQ

SEQ ID NO: 298603 - protein, 8 aa, Influenza virus
ADQESTQK

SEQ ID NO: 298604 - protein, 8 aa, Influenza virus
DQESTQKA

SEQ ID NO: 298605 - protein, 8 aa, Influenza virus
QESTQKAI

SEQ ID NO: 298606 - protein, 8 aa, Influenza virus
ESTQKAIN

SEQ ID NO: 298607 - protein, 8 aa, Influenza virus
STQKAING

SEQ ID NO: 298608 - protein, 8 aa, Influenza virus
TQRAIDGV

SEQ ID NO: 298609 - protein, 8 aa, Influenza virus
QRAIDGVT

SEQ ID NO: 298610 - protein, 8 aa, Influenza virus
RAIDGVTN

SEQ ID NO: 298611 - protein, 8 aa, Influenza virus
AINGVTNK

SEQ ID NO: 298612 - protein, 8 aa, Influenza virus
INGVTNKV

SEQ ID NO: 298613 - protein, 8 aa, Influenza virus
NGVTNKVN

SEQ ID NO: 298614 - protein, 8 aa, Influenza virus
NKVNSIIG

SEQ ID NO: 298615 - protein, 8 aa, Influenza virus
KVNSIIGK

SEQ ID NO: 298616 - protein, 8 aa, Influenza virus
VNSIIGKM

SEQ ID NO: 298617 - protein, 8 aa, Influenza virus
IIGKMNTQ

SEQ ID NO: 298618 - protein, 8 aa, Influenza virus
IGKMNTQF

SEQ ID NO: 298619 - protein, 8 aa, Influenza virus
GKMNTQFE

SEQ ID NO: 298620 - protein, 8 aa, Influenza virus
MNTQFETV

SEQ ID NO: 298621 - protein, 8 aa, Influenza virus
NTRFEAVG

SEQ ID NO: 298622 - protein, 8 aa, Influenza virus
TQFEAIGR

SEQ ID NO: 298623 - protein, 8 aa, Influenza virus
QFEAIGRE

SEQ ID NO: 298624 - protein, 8 aa, Influenza virus
FEAIGREF

SEQ ID NO: 298625 - protein, 8 aa, Influenza virus
EAVGREFS

SEQ ID NO: 298626 - protein, 8 aa, Influenza virus
EFSNLERR

SEQ ID NO: 298627 - protein, 8 aa, Influenza virus
RRIESLNK

SEQ ID NO: 298628 - protein, 8 aa, Influenza virus
RIENLNRK

SEQ ID NO: 298629 - protein, 8 aa, Influenza virus
IENLNRKM

SEQ ID NO: 298630 - protein, 8 aa, Influenza virus
ENLNRKME

SEQ ID NO: 298631 - protein, 8 aa, Influenza virus
NLNRKMED

SEQ ID NO: 298632 - protein, 8 aa, Influenza virus
SNVRNLYD

SEQ ID NO: 298633 - protein, 8 aa, Influenza virus
NVRNLYDK

SEQ ID NO: 298634 - protein, 8 aa, Influenza virus
VRNLYDKV

SEQ ID NO: 298635 - protein, 8 aa, Influenza virus
RNLYDKVR

SEQ ID NO: 298636 - protein, 8 aa, Influenza virus
NLYDRVRL

SEQ ID NO: 298637 - protein, 8 aa, Influenza virus
LYDRVRLQ

SEQ ID NO: 298638 - protein, 8 aa, Influenza virus
YDRVRLQL

SEQ ID NO: 298639 - protein, 8 aa, Influenza virus
EKVRLQLR

SEQ ID NO: 298640 - protein, 8 aa, Influenza virus
RVRLQLRD

SEQ ID NO: 298641 - protein, 8 aa, Influenza virus
FEFYHKCN

SEQ ID NO: 298642 - protein, 8 aa, Influenza virus
EFYHKCNN

SEQ ID NO: 298643 - protein, 8 aa, Influenza virus
CMESVKNG

SEQ ID NO: 298644 - protein, 8 aa, Influenza virus
MESVKNGT

SEQ ID NO: 298645 - protein, 8 aa, Influenza virus
ESVKNGTY

SEQ ID NO: 298646 - protein, 8 aa, Influenza virus
SVKNGTYD

SEQ ID NO: 298647 - protein, 8 aa, Influenza virus
VKNGTYDY

SEQ ID NO: 298648 - protein, 8 aa, Influenza virus
KNGTYDYP

SEQ ID NO: 298649 - protein, 8 aa, Influenza virus
NGTYSYPQ

SEQ ID NO: 298650 - protein, 8 aa, Influenza virus
GTYSYPQY

SEQ ID NO: 298651 - protein, 8 aa, Influenza virus
VTYQILSI

SEQ ID NO: 298652 - protein, 8 aa, Influenza virus
VYQILSIY

SEQ ID NO: 298653 - protein, 8 aa, Influenza virus
LSIYSTVV

SEQ ID NO: 298654 - protein, 8 aa, Influenza virus
SIYSTVTS

SEQ ID NO: 298655 - protein, 8 aa, Influenza virus
IYSTVTSS

SEQ ID NO: 298656 - protein, 8 aa, Influenza virus
STAASSLA

SEQ ID NO: 298657 - protein, 8 aa, Influenza virus
TAASSLAL

SEQ ID NO: 298658 - protein, 8 aa, Influenza virus
AASSLALA

SEQ ID NO: 298659 - protein, 8 aa, Influenza virus
ASSLTLAI

SEQ ID NO: 298660 - protein, 8 aa, Influenza virus
SSLTLAIM

SEQ ID NO: 298661 - protein, 8 aa, Influenza virus
LAIMIAGL

SEQ ID NO: 298662 - protein, 8 aa, Influenza virus
AGLSFWMC

SEQ ID NO: 298663 - protein, 8 aa, Influenza virus
GLSFWMCS

SEQ ID NO: 298664 - protein, 8 aa, Influenza virus
LSFWMCSN

SEQ ID NO: 298665 - protein, 8 aa, Influenza virus
SFWMCSNG

SEQ ID NO: 298666 - protein, 8 aa, Influenza virus
NGSLQCKI

SEQ ID NO: 298667 - protein, 8 aa, Influenza virus
GSLQCRIA

SEQ ID NO: 298668 - protein, 8 aa, Influenza virus
CIKFVSSD

SEQ ID NO: 298669 - protein, 8 aa, Influenza virus
RFVNSDCS

SEQ ID NO: 298670 - protein, 8 aa, Influenza virus
FSGSQKQE

SEQ ID NO: 298671 - protein, 8 aa, Influenza virus
FREQKQEF

SEQ ID NO: 298672 - protein, 8 aa, Influenza virus
INYENNTW

SEQ ID NO: 298673 - protein, 8 aa, Influenza virus
NQNSTWVS

SEQ ID NO: 298674 - protein, 8 aa, Influenza virus
ENTTWVNQ

SEQ ID NO: 298675 - protein, 8 aa, Influenza virus
NSTWVSQT

SEQ ID NO: 298676 - protein, 8 aa, Influenza virus
NTWGNQTY

SEQ ID NO: 298677 - protein, 8 aa, Influenza virus
TWVNQTFV

SEQ ID NO: 298678 - protein, 8 aa, Influenza virus
GNSPLCPI

SEQ ID NO: 298679 - protein, 8 aa, Influenza virus
GWAIHSKD

SEQ ID NO: 298680 - protein, 8 aa, Influenza virus
WAIHSKDN

SEQ ID NO: 298681 - protein, 8 aa, Influenza virus
YSKDNGIR

SEQ ID NO: 298682 - protein, 8 aa, Influenza virus
SKDNNIRI

SEQ ID NO: 298683 - protein, 8 aa, Influenza virus
KDNNIRIG

SEQ ID NO: 298684 - protein, 8 aa, Influenza virus
DNNIRIGS

SEQ ID NO: 298685 - protein, 8 aa, Influenza virus
NGIRIGSK

SEQ ID NO: 298686 - protein, 8 aa, Influenza virus
GIRIGSKG

SEQ ID NO: 298687 - protein, 8 aa, Influenza virus
GSRGDVFI

SEQ ID NO: 298688 - protein, 8 aa, Influenza virus
GDVFVTRE

SEQ ID NO: 298689 - protein, 8 aa, Influenza virus
DVFVTREP

SEQ ID NO: 298690 - protein, 8 aa, Influenza virus
VFIIREPF

SEQ ID NO: 298691 - protein, 8 aa, Influenza virus
FVIREPFV

SEQ ID NO: 298692 - protein, 8 aa, Influenza virus
VIREPFVS

SEQ ID NO: 298693 - protein, 8 aa, Influenza virus
IREPFVSC

SEQ ID NO: 298694 - protein, 8 aa, Influenza virus
PFISCSHS

SEQ ID NO: 298695 - protein, 8 aa, Influenza virus
FVSCSHLE

SEQ ID NO: 298696 - protein, 8 aa, Influenza virus
VSCSHLEC

SEQ ID NO: 298697 - protein, 8 aa, Influenza virus
SCSHSECR

SEQ ID NO: 298698 - protein, 8 aa, Influenza virus
CSHSECRT

SEQ ID NO: 298699 - protein, 8 aa, Influenza virus
SHSECRTF

SEQ ID NO: 298700 - protein, 8 aa, Influenza virus
HSECRTFF

SEQ ID NO: 298701 - protein, 8 aa, Influenza virus
SECRTFFL

SEQ ID NO: 298702 - protein, 8 aa, Influenza virus
TFFLTHGA

SEQ ID NO: 298703 - protein, 8 aa, Influenza virus
HGALLNDK

SEQ ID NO: 298704 - protein, 8 aa, Influenza virus
DKHSNETV

SEQ ID NO: 298705 - protein, 8 aa, Influenza virus
KHSNGTVN

SEQ ID NO: 298706 - protein, 8 aa, Influenza virus
HSNETVKD

SEQ ID NO: 298707 - protein, 8 aa, Influenza virus
SNGTVNDR

SEQ ID NO: 298708 - protein, 8 aa, Influenza virus
NGTVNDRS

SEQ ID NO: 298709 - protein, 8 aa, Influenza virus
ETVKDRSP

SEQ ID NO: 298710 - protein, 8 aa, Influenza virus
IKDRSPHR

SEQ ID NO: 298711 - protein, 8 aa, Influenza virus
KDRSPHRA

SEQ ID NO: 298712 - protein, 8 aa, Influenza virus
DRSPHRAL

SEQ ID NO: 298713 - protein, 8 aa, Influenza virus
RSPHRALM

SEQ ID NO: 298714 - protein, 8 aa, Influenza virus
SPHRALMS

SEQ ID NO: 298715 - protein, 8 aa, Influenza virus
PHRALMSC

SEQ ID NO: 298716 - protein, 8 aa, Influenza virus
HRALMSCP

SEQ ID NO: 298717 - protein, 8 aa, Influenza virus
RALMSCPV

SEQ ID NO: 298718 - protein, 8 aa, Influenza virus
ALMSCPVG

SEQ ID NO: 298719 - protein, 8 aa, Influenza virus
LMSCPIGE

SEQ ID NO: 298720 - protein, 8 aa, Influenza virus
PIGEAPSP

SEQ ID NO: 298721 - protein, 8 aa, Influenza virus
IGEAPSPY

SEQ ID NO: 298722 - protein, 8 aa, Influenza virus
GVAPSPYN

SEQ ID NO: 298723 - protein, 8 aa, Influenza virus
VAPSPYNS

SEQ ID NO: 298724 - protein, 8 aa, Influenza virus
VPSPYNSR

SEQ ID NO: 298725 - protein, 8 aa, Influenza virus
ASACHDGS

SEQ ID NO: 298726 - protein, 8 aa, Influenza virus
SACHDGTN

SEQ ID NO: 298727 - protein, 8 aa, Influenza virus
ACHDGTNW

SEQ ID NO: 298728 - protein, 8 aa, Influenza virus
CHDGTNWL

SEQ ID NO: 298729 - protein, 8 aa, Influenza virus
HDGTNWLT

SEQ ID NO: 298730 - protein, 8 aa, Influenza virus
DGTNWLTI

SEQ ID NO: 298731 - protein, 8 aa, Influenza virus
SWLTIGVS

SEQ ID NO: 298732 - protein, 8 aa, Influenza virus
IGVSGPDN

SEQ ID NO: 298733 - protein, 8 aa, Influenza virus
GISGPDSG

SEQ ID NO: 298734 - protein, 8 aa, Influenza virus
ISGPDSGA

SEQ ID NO: 298735 - protein, 8 aa, Influenza virus
SGPDSGAV

SEQ ID NO: 298736 - protein, 8 aa, Influenza virus
GPDSGAVA

SEQ ID NO: 298737 - protein, 8 aa, Influenza virus
PDSGAVAV

SEQ ID NO: 298738 - protein, 8 aa, Influenza virus
DSGAVAVL

SEQ ID NO: 298739 - protein, 8 aa, Influenza virus
SGAVAVLK

SEQ ID NO: 298740 - protein, 8 aa, Influenza virus
GAVAVVKY

SEQ ID NO: 298741 - protein, 8 aa, Influenza virus
AVAVLKYD

SEQ ID NO: 298742 - protein, 8 aa, Influenza virus
VAVLKYDG

SEQ ID NO: 298743 - protein, 8 aa, Influenza virus
KYDGIITD

SEQ ID NO: 298744 - protein, 8 aa, Influenza virus
YDGIITDT

SEQ ID NO: 298745 - protein, 8 aa, Influenza virus
DGIITDTI

SEQ ID NO: 298746 - protein, 8 aa, Influenza virus
GLITDTIK

SEQ ID NO: 298747 - protein, 8 aa, Influenza virus
LITDTIKS

SEQ ID NO: 298748 - protein, 8 aa, Influenza virus
TDTIRSWR

SEQ ID NO: 298749 - protein, 8 aa, Influenza virus
NTLRTQES

SEQ ID NO: 298750 - protein, 8 aa, Influenza virus
TLRTQESE

SEQ ID NO: 298751 - protein, 8 aa, Influenza virus
SECACANG

SEQ ID NO: 298752 - protein, 8 aa, Influenza virus
GFCFTVMT

SEQ ID NO: 298753 - protein, 8 aa, Influenza virus
FCFTVMTD

SEQ ID NO: 298754 - protein, 8 aa, Influenza virus
TVMTDGPN

SEQ ID NO: 298755 - protein, 8 aa, Influenza virus
QASYKIFR

SEQ ID NO: 298756 - protein, 8 aa, Influenza virus
APNYYYEE

SEQ ID NO: 298757 - protein, 8 aa, Influenza virus
PNYYYEEC

SEQ ID NO: 298758 - protein, 8 aa, Influenza virus
ECSCYPNA

SEQ ID NO: 298759 - protein, 8 aa, Influenza virus
CSCYPDSG

SEQ ID NO: 298760 - protein, 8 aa, Influenza virus
SCYPDSGE

SEQ ID NO: 298761 - protein, 8 aa, Influenza virus
MCVCRDNW

SEQ ID NO: 298762 - protein, 8 aa, Influenza virus
HGSNRPWL

SEQ ID NO: 298763 - protein, 8 aa, Influenza virus
GSNRPWLS

SEQ ID NO: 298764 - protein, 8 aa, Influenza virus
SNRPWLSF

SEQ ID NO: 298765 - protein, 8 aa, Influenza virus
NRPWLSFN

SEQ ID NO: 298766 - protein, 8 aa, Influenza virus
RPWLSFNQ

SEQ ID NO: 298767 - protein, 8 aa, Influenza virus
YKIGYICS

SEQ ID NO: 298768 - protein, 8 aa, Influenza virus
KIGYICSG

SEQ ID NO: 298769 - protein, 8 aa, Influenza virus
IGYICSGF

SEQ ID NO: 298770 - protein, 8 aa, Influenza virus
GYICSGFF

SEQ ID NO: 298771 - protein, 8 aa, Influenza virus
YICSGFFG

SEQ ID NO: 298772 - protein, 8 aa, Influenza virus
ICSGFFGD

SEQ ID NO: 298773 - protein, 8 aa, Influenza virus
CSGVFGDT

SEQ ID NO: 298774 - protein, 8 aa, Influenza virus
SGVFGDTP

SEQ ID NO: 298775 - protein, 8 aa, Influenza virus
GVFGDTPR

SEQ ID NO: 298776 - protein, 8 aa, Influenza virus
VFGDTPRP

SEQ ID NO: 298777 - protein, 8 aa, Influenza virus
FGDSPRPN

SEQ ID NO: 298778 - protein, 8 aa, Influenza virus
GDSPRPND

SEQ ID NO: 298779 - protein, 8 aa, Influenza virus
DSPRPNDG

SEQ ID NO: 298780 - protein, 8 aa, Influenza virus
PRPNDGKG

SEQ ID NO: 298781 - protein, 8 aa, Influenza virus
DGKGSCGP

SEQ ID NO: 298782 - protein, 8 aa, Influenza virus
GTYGVKGF

SEQ ID NO: 298783 - protein, 8 aa, Influenza virus
TYGVKGFS

SEQ ID NO: 298784 - protein, 8 aa, Influenza virus
YGVKGFAF

SEQ ID NO: 298785 - protein, 8 aa, Influenza virus
GVKGFAFK

SEQ ID NO: 298786 - protein, 8 aa, Influenza virus
VKGFSFRY

SEQ ID NO: 298787 - protein, 8 aa, Influenza virus
KGFAFKYG

SEQ ID NO: 298788 - protein, 8 aa, Influenza virus
GFAFKYGN

SEQ ID NO: 298789 - protein, 8 aa, Influenza virus
FAFKYGNG

SEQ ID NO: 298790 - protein, 8 aa, Influenza virus
FKYGDGVW

SEQ ID NO: 298791 - protein, 8 aa, Influenza virus
KYGDGVWI

SEQ ID NO: 298792 - protein, 8 aa, Influenza virus
YGNGAWIG

SEQ ID NO: 298793 - protein, 8 aa, Influenza virus
GNGAWIGR

SEQ ID NO: 298794 - protein, 8 aa, Influenza virus
WIGRTKSI

SEQ ID NO: 298795 - protein, 8 aa, Influenza virus
HSRSGFEM

SEQ ID NO: 298796 - protein, 8 aa, Influenza virus
SRSGFEII

SEQ ID NO: 298797 - protein, 8 aa, Influenza virus
FEMIWDPD

SEQ ID NO: 298798 - protein, 8 aa, Influenza virus
EMIWDPDG

SEQ ID NO: 298799 - protein, 8 aa, Influenza virus
MIWDPDGW

SEQ ID NO: 298800 - protein, 8 aa, Influenza virus
LTDWSGYS

SEQ ID NO: 298801 - protein, 8 aa, Influenza virus
SFVQHPEM

SEQ ID NO: 298802 - protein, 8 aa, Influenza virus
FVQHPEMT

SEQ ID NO: 298803 - protein, 8 aa, Influenza virus
VQHPEMTG

SEQ ID NO: 298804 - protein, 8 aa, Influenza virus
HPEMTGLD

SEQ ID NO: 298805 - protein, 8 aa, Influenza virus
PEMTGLDC

SEQ ID NO: 298806 - protein, 8 aa, Influenza virus
TGLNCIRP

SEQ ID NO: 298807 - protein, 8 aa, Influenza virus
GLNCIRPC

SEQ ID NO: 298808 - protein, 8 aa, Influenza virus
LNCIRPCF

SEQ ID NO: 298809 - protein, 8 aa, Influenza virus
NCIRPCFW

SEQ ID NO: 298810 - protein, 8 aa, Influenza virus
CIKPCFWV

SEQ ID NO: 298811 - protein, 8 aa, Influenza virus
IKPCFWVE

SEQ ID NO: 298812 - protein, 8 aa, Influenza virus
WVELVRGR

SEQ ID NO: 298813 - protein, 8 aa, Influenza virus
VELVRGRP

SEQ ID NO: 298814 - protein, 8 aa, Influenza virus
ELVRGRPK

SEQ ID NO: 298815 - protein, 8 aa, Influenza virus
LVRGRPKE

SEQ ID NO: 298816 - protein, 8 aa, Influenza virus
TVWTSGSI

SEQ ID NO: 298817 - protein, 8 aa, Influenza virus
VWTSGSII

SEQ ID NO: 298818 - protein, 8 aa, Influenza virus
WASGSSIS

SEQ ID NO: 298819 - protein, 8 aa, Influenza virus
ASGSSISF

SEQ ID NO: 298820 - protein, 8 aa, Influenza virus
SISFCGVD

SEQ ID NO: 298821 - protein, 8 aa, Influenza virus
ISFCGVDS

SEQ ID NO: 298822 - protein, 8 aa, Influenza virus
IVSWSWPD

SEQ ID NO: 298823 - protein, 8 aa, Influenza virus
GWSWPDDA

SEQ ID NO: 298824 - protein, 8 aa, Influenza virus
PDGAELPS

SEQ ID NO: 298825 - protein, 8 aa, Influenza virus
AELPFTMT

SEQ ID NO: 298826 - protein, 8 aa, Influenza virus
GDRICIGY

SEQ ID NO: 298827 - protein, 8 aa, Influenza virus
DQICIGHH

SEQ ID NO: 298828 - protein, 8 aa, Influenza virus
RICVGYHA

SEQ ID NO: 298829 - protein, 8 aa, Influenza virus
GHHANNST

SEQ ID NO: 298830 - protein, 8 aa, Influenza virus
HHANNSTE

SEQ ID NO: 298831 - protein, 8 aa, Influenza virus
HANNSKKQ

SEQ ID NO: 298832 - protein, 8 aa, Influenza virus
ANNSTKQI

SEQ ID NO: 298833 - protein, 8 aa, Influenza virus
NNSTKQID

SEQ ID NO: 298834 - protein, 8 aa, Influenza virus
NSTKQIDT

SEQ ID NO: 298835 - protein, 8 aa, Influenza virus
STKQIDTI

SEQ ID NO: 298836 - protein, 8 aa, Influenza virus
KQIDTIME

SEQ ID NO: 298837 - protein, 8 aa, Influenza virus
QVDTIMER

SEQ ID NO: 298838 - protein, 8 aa, Influenza virus
VDTIMERN

SEQ ID NO: 298839 - protein, 8 aa, Influenza virus
DTIVEKNV

SEQ ID NO: 298840 - protein, 8 aa, Influenza virus
TIMEKIVT

SEQ ID NO: 298841 - protein, 8 aa, Influenza virus
TMEKNVTV

SEQ ID NO: 298842 - protein, 8 aa, Influenza virus
MEKNVIFT

SEQ ID NO: 298843 - protein, 8 aa, Influenza virus
EKNVIFTH

SEQ ID NO: 298844 - protein, 8 aa, Influenza virus
KNVTVTHT

SEQ ID NO: 298845 - protein, 8 aa, Influenza virus
IVTVTHAQ

SEQ ID NO: 298846 - protein, 8 aa, Influenza virus
VTVTQAQD

SEQ ID NO: 298847 - protein, 8 aa, Influenza virus
HNGKLCSI

SEQ ID NO: 298848 - protein, 8 aa, Influenza virus
DCSVAGWI

SEQ ID NO: 298849 - protein, 8 aa, Influenza virus
AGWLIGNP

SEQ ID NO: 298850 - protein, 8 aa, Influenza virus
GWILGNPM

SEQ ID NO: 298851 - protein, 8 aa, Influenza virus
LVLGNPMC

SEQ ID NO: 298852 - protein, 8 aa, Influenza virus
TPEWSYIV

SEQ ID NO: 298853 - protein, 8 aa, Influenza virus
WSYIVEKA

SEQ ID NO: 298854 - protein, 8 aa, Influenza virus
SYIVEKNN

SEQ ID NO: 298855 - protein, 8 aa, Influenza virus
YIVEKNNP

SEQ ID NO: 298856 - protein, 8 aa, Influenza virus
SGVTSACS

SEQ ID NO: 298857 - protein, 8 aa, Influenza virus
SGVSSACL

SEQ ID NO: 298858 - protein, 8 aa, Influenza virus
SSFYRNVV

SEQ ID NO: 298859 - protein, 8 aa, Influenza virus
SFFRNIVW

SEQ ID NO: 298860 - protein, 8 aa, Influenza virus
FFRNIVWL

SEQ ID NO: 298861 - protein, 8 aa, Influenza virus
FRNVVWLV

SEQ ID NO: 298862 - protein, 8 aa, Influenza virus
RNVVWLVK

SEQ ID NO: 298863 - protein, 8 aa, Influenza virus
NVVWLVKK

SEQ ID NO: 298864 - protein, 8 aa, Influenza virus
FVGTSTLN

SEQ ID NO: 298865 - protein, 8 aa, Influenza virus
GTPTLNQR

SEQ ID NO: 298866 - protein, 8 aa, Influenza virus
TSTLNKRS

SEQ ID NO: 298867 - protein, 8 aa, Influenza virus
IATRPRVN

SEQ ID NO: 298868 - protein, 8 aa, Influenza virus
ATRPRVNG

SEQ ID NO: 298869 - protein, 8 aa, Influenza virus
TRPRVNGQ

SEQ ID NO: 298870 - protein, 8 aa, Influenza virus
RPRVNGQS

SEQ ID NO: 298871 - protein, 8 aa, Influenza virus
PRVNGQSG

SEQ ID NO: 298872 - protein, 8 aa, Influenza virus
RVNGQSGR

SEQ ID NO: 298873 - protein, 8 aa, Influenza virus
VNGQSGRI

SEQ ID NO: 298874 - protein, 8 aa, Influenza virus
IAPEYAFK

SEQ ID NO: 298875 - protein, 8 aa, Influenza virus
APEYAYRI

SEQ ID NO: 298876 - protein, 8 aa, Influenza virus
PEYAYKIA

SEQ ID NO: 298877 - protein, 8 aa, Influenza virus
EYAYKIAK

SEQ ID NO: 298878 - protein, 8 aa, Influenza virus
YGNCNAKC

SEQ ID NO: 298879 - protein, 8 aa, Influenza virus
GNCNAKCQ

SEQ ID NO: 298880 - protein, 8 aa, Influenza virus
NCNAKCQT

SEQ ID NO: 298881 - protein, 8 aa, Influenza virus
CNAKCQTP

SEQ ID NO: 298882 - protein, 8 aa, Influenza virus
KCQTPLGA

SEQ ID NO: 298883 - protein, 8 aa, Influenza virus
LPFHNVHP

SEQ ID NO: 298884 - protein, 8 aa, Influenza virus
PFHNVHPF

SEQ ID NO: 298885 - protein, 8 aa, Influenza virus
FHNVHPFT

SEQ ID NO: 298886 - protein, 8 aa, Influenza virus
KTRGLFGA

SEQ ID NO: 298887 - protein, 8 aa, Influenza virus
EGGWQGLV

SEQ ID NO: 298888 - protein, 8 aa, Influenza virus
GGWQGLVD

SEQ ID NO: 298889 - protein, 8 aa, Influenza virus
GWQGLVDG

SEQ ID NO: 298890 - protein, 8 aa, Influenza virus
WQGLVDGW

SEQ ID NO: 298891 - protein, 8 aa, Influenza virus
QGLVDGWY

SEQ ID NO: 298892 - protein, 8 aa, Influenza virus
GLVDGWYG

SEQ ID NO: 298893 - protein, 8 aa, Influenza virus
LVDGWYGY

SEQ ID NO: 298894 - protein, 8 aa, Influenza virus
GWYGYHHT

SEQ ID NO: 298895 - protein, 8 aa, Influenza virus
WYGYHHTN

SEQ ID NO: 298896 - protein, 8 aa, Influenza virus
NDQGSGYA

SEQ ID NO: 298897 - protein, 8 aa, Influenza virus
DQGSGYAA

SEQ ID NO: 298898 - protein, 8 aa, Influenza virus
SGYAADRK

SEQ ID NO: 298899 - protein, 8 aa, Influenza virus
GYAADRKS

SEQ ID NO: 298900 - protein, 8 aa, Influenza virus
YAADRKST

SEQ ID NO: 298901 - protein, 8 aa, Influenza virus
AADRKSTQ

SEQ ID NO: 298902 - protein, 8 aa, Influenza virus
ADKESTQR

SEQ ID NO: 298903 - protein, 8 aa, Influenza virus
DKESTQRA

SEQ ID NO: 298904 - protein, 8 aa, Influenza virus
KESTQRAI

SEQ ID NO: 298905 - protein, 8 aa, Influenza virus
KSTQKAID

SEQ ID NO: 298906 - protein, 8 aa, Influenza virus
STQRAIDG

SEQ ID NO: 298907 - protein, 8 aa, Influenza virus
TQRAIDGI

SEQ ID NO: 298908 - protein, 8 aa, Influenza virus
QRAIDGIT

SEQ ID NO: 298909 - protein, 8 aa, Influenza virus
RAIDGITN

SEQ ID NO: 298910 - protein, 8 aa, Influenza virus
NSIIDRMN

SEQ ID NO: 298911 - protein, 8 aa, Influenza virus
GVWTYNAE

SEQ ID NO: 298912 - protein, 8 aa, Influenza virus
WTYNAELF

SEQ ID NO: 298913 - protein, 8 aa, Influenza virus
TYNTELLV

SEQ ID NO: 298914 - protein, 8 aa, Influenza virus
YNTELLVL

SEQ ID NO: 298915 - protein, 8 aa, Influenza virus
NAELLVLI

SEQ ID NO: 298916 - protein, 8 aa, Influenza virus
TELLVLME

SEQ ID NO: 298917 - protein, 8 aa, Influenza virus
ELLVLIEN

SEQ ID NO: 298918 - protein, 8 aa, Influenza virus
LLVLIENE

SEQ ID NO: 298919 - protein, 8 aa, Influenza virus
LVLIENER

SEQ ID NO: 298920 - protein, 8 aa, Influenza virus
IENERTLD

SEQ ID NO: 298921 - protein, 8 aa, Influenza virus
ENERTLYF

SEQ ID NO: 298922 - protein, 8 aa, Influenza virus
NERTLYFH

SEQ ID NO: 298923 - protein, 8 aa, Influenza virus
ERTLYFHD

SEQ ID NO: 298924 - protein, 8 aa, Influenza virus
RTLYFHDS

SEQ ID NO: 298925 - protein, 8 aa, Influenza virus
TLYFHDSN

SEQ ID NO: 298926 - protein, 8 aa, Influenza virus
DFHDSNVR

SEQ ID NO: 298927 - protein, 8 aa, Influenza virus
FHDSNVRN

SEQ ID NO: 298928 - protein, 8 aa, Influenza virus
SNVKNLYN

SEQ ID NO: 298929 - protein, 8 aa, Influenza virus
NVKNLYNK

SEQ ID NO: 298930 - protein, 8 aa, Influenza virus
VKNLYNKV

SEQ ID NO: 298931 - protein, 8 aa, Influenza virus
KNLYNKVR

SEQ ID NO: 298932 - protein, 8 aa, Influenza virus
NLYDKVRH

SEQ ID NO: 298933 - protein, 8 aa, Influenza virus
LYDKVRHQ

SEQ ID NO: 298934 - protein, 8 aa, Influenza virus
YDKVRHQL

SEQ ID NO: 298935 - protein, 8 aa, Influenza virus
VRHQLRDN

SEQ ID NO: 298936 - protein, 8 aa, Influenza virus
RHQLRDNA

SEQ ID NO: 298937 - protein, 8 aa, Influenza virus
QLKDNAKE

SEQ ID NO: 298938 - protein, 8 aa, Influenza virus
DNAKEMGN

SEQ ID NO: 298939 - protein, 8 aa, Influenza virus
NAKEMGNG

SEQ ID NO: 298940 - protein, 8 aa, Influenza virus
AKEMGNGC

SEQ ID NO: 298941 - protein, 8 aa, Influenza virus
KEMGNGCF

SEQ ID NO: 298942 - protein, 8 aa, Influenza virus
EWGNGCFE

SEQ ID NO: 298943 - protein, 8 aa, Influenza virus
WGNGCFEF

SEQ ID NO: 298944 - protein, 8 aa, Influenza virus
FEFYHKCN

SEQ ID NO: 298945 - protein, 8 aa, Influenza virus
EFYHRCDN

SEQ ID NO: 298946 - protein, 8 aa, Influenza virus
KCMESVRN

SEQ ID NO: 298947 - protein, 8 aa, Influenza virus
CIESVRNG

SEQ ID NO: 298948 - protein, 8 aa, Influenza virus
IESVRNGT

SEQ ID NO: 298949 - protein, 8 aa, Influenza virus
SVKNGTYD

SEQ ID NO: 298950 - protein, 8 aa, Influenza virus
VKNGTYDY

SEQ ID NO: 298951 - protein, 8 aa, Influenza virus
YQILTIYS

SEQ ID NO: 298952 - protein, 8 aa, Influenza virus
ILTIYSTV

SEQ ID NO: 298953 - protein, 8 aa, Influenza virus
LSIYSSVA

SEQ ID NO: 298954 - protein, 8 aa, Influenza virus
SIYSSVAS

SEQ ID NO: 298955 - protein, 8 aa, Influenza virus
IYSSVASS

SEQ ID NO: 298956 - protein, 8 aa, Influenza virus
YSSVASSL

SEQ ID NO: 298957 - protein, 8 aa, Influenza virus
VASSLVLA

SEQ ID NO: 298958 - protein, 8 aa, Influenza virus
ASSLVLAI

SEQ ID NO: 298959 - protein, 8 aa, Influenza virus
SSLTLAIM

SEQ ID NO: 298960 - protein, 8 aa, Influenza virus
LAIMMAGL

SEQ ID NO: 298961 - protein, 8 aa, Influenza virus
AIMMAGLS

SEQ ID NO: 298962 - protein, 8 aa, Influenza virus
IMMAGLSF

SEQ ID NO: 298963 - protein, 8 aa, Influenza virus
MMAGLSFW

SEQ ID NO: 298964 - protein, 8 aa, Influenza virus
MAGLSFWM

SEQ ID NO: 298965 - protein, 8 aa, Influenza virus
NGSLQCRV

SEQ ID NO: 298966 - protein, 8 aa, Influenza virus
GSLQCRVC

SEQ ID NO: 298967 - protein, 8 aa, Influenza virus
SLQCRVCI

SEQ ID NO: 298968 - protein, 8 aa, Influenza virus
QKIITVGS

SEQ ID NO: 298969 - protein, 8 aa, Influenza virus
IITIGSAS

SEQ ID NO: 298970 - protein, 8 aa, Influenza virus
ITIGSASL

SEQ ID NO: 298971 - protein, 8 aa, Influenza virus
YKNWSKPQ

SEQ ID NO: 298972 - protein, 8 aa, Influenza virus
RGWSKPQC

SEQ ID NO: 298973 - protein, 8 aa, Influenza virus
WSKPQCEI

SEQ ID NO: 298974 - protein, 8 aa, Influenza virus
KPQCQIAG

SEQ ID NO: 298975 - protein, 8 aa, Influenza virus
PQCQIAGF

SEQ ID NO: 298976 - protein, 8 aa, Influenza virus
QCQIAGFA

SEQ ID NO: 298977 - protein, 8 aa, Influenza virus
CQIAGFAP

SEQ ID NO: 298978 - protein, 8 aa, Influenza virus
QIAGFAPF

SEQ ID NO: 298979 - protein, 8 aa, Influenza virus
IAGFAPFS

SEQ ID NO: 298980 - protein, 8 aa, Influenza virus
RLSAGGSI

SEQ ID NO: 298981 - protein, 8 aa, Influenza virus
LSAGGSIW

SEQ ID NO: 298982 - protein, 8 aa, Influenza virus
REPYVSCG

SEQ ID NO: 298983 - protein, 8 aa, Influenza virus
GQGTTLDH

SEQ ID NO: 298984 - protein, 8 aa, Influenza virus
NRHSNGTI

SEQ ID NO: 298985 - protein, 8 aa, Influenza virus
RHSNGTIH

SEQ ID NO: 298986 - protein, 8 aa, Influenza virus
NGTIHDRS

SEQ ID NO: 298987 - protein, 8 aa, Influenza virus
SYRTLLMN

SEQ ID NO: 298988 - protein, 8 aa, Influenza virus
YRTLLMNE

SEQ ID NO: 298989 - protein, 8 aa, Influenza virus
LLMNELGI

SEQ ID NO: 298990 - protein, 8 aa, Influenza virus
LMNELGIP

SEQ ID NO: 298991 - protein, 8 aa, Influenza virus
MNELGIPF

SEQ ID NO: 298992 - protein, 8 aa, Influenza virus
NELGIPFH

SEQ ID NO: 298993 - protein, 8 aa, Influenza virus
IPFHLGTK

SEQ ID NO: 298994 - protein, 8 aa, Influenza virus
LGTKQVCM

SEQ ID NO: 298995 - protein, 8 aa, Influenza virus
GTKQVCMA

SEQ ID NO: 298996 - protein, 8 aa, Influenza virus
TKQVCMAW

SEQ ID NO: 298997 - protein, 8 aa, Influenza virus
KQVCMAWS

SEQ ID NO: 298998 - protein, 8 aa, Influenza virus
QVCVAWSS

SEQ ID NO: 298999 - protein, 8 aa, Influenza virus
VCVAWSSS

SEQ ID NO: 299000 - protein, 8 aa, Influenza virus
CVAWSSSS

SEQ ID NO: 299001 - protein, 8 aa, Influenza virus
VAWSSSSC

SEQ ID NO: 299002 - protein, 8 aa, Influenza virus
SSSCHDGN

SEQ ID NO: 299003 - protein, 8 aa, Influenza virus
SSCHDGNA

SEQ ID NO: 299004 - protein, 8 aa, Influenza virus
SCHDGNAW

SEQ ID NO: 299005 - protein, 8 aa, Influenza virus
CHDGNAWL

SEQ ID NO: 299006 - protein, 8 aa, Influenza virus
HDGNAWLH

SEQ ID NO: 299007 - protein, 8 aa, Influenza virus
DGNAWLHV

SEQ ID NO: 299008 - protein, 8 aa, Influenza virus
GNAWLHVC

SEQ ID NO: 299009 - protein, 8 aa, Influenza virus
NAWLHVCV

SEQ ID NO: 299010 - protein, 8 aa, Influenza virus
AWLHVCIT

SEQ ID NO: 299011 - protein, 8 aa, Influenza virus
WLHVCITG

SEQ ID NO: 299012 - protein, 8 aa, Influenza virus
LHVCITGD

SEQ ID NO: 299013 - protein, 8 aa, Influenza virus
HVCITGDD

SEQ ID NO: 299014 - protein, 8 aa, Influenza virus
TGDDGNAT

SEQ ID NO: 299015 - protein, 8 aa, Influenza virus
GDDGNATA

SEQ ID NO: 299016 - protein, 8 aa, Influenza virus
DDGNATAS

SEQ ID NO: 299017 - protein, 8 aa, Influenza virus
NATASIIY

SEQ ID NO: 299018 - protein, 8 aa, Influenza virus
SWSLNILR

SEQ ID NO: 299019 - protein, 8 aa, Influenza virus
ESECVCID

SEQ ID NO: 299020 - protein, 8 aa, Influenza virus
CTVIMTDG

SEQ ID NO: 299021 - protein, 8 aa, Influenza virus
AVVMTDGN

SEQ ID NO: 299022 - protein, 8 aa, Influenza virus
VIMTDGSA

SEQ ID NO: 299023 - protein, 8 aa, Influenza virus
VMTDGNAS

SEQ ID NO: 299024 - protein, 8 aa, Influenza virus
MTDGNASG

SEQ ID NO: 299025 - protein, 8 aa, Influenza virus
TDGNASGR

SEQ ID NO: 299026 - protein, 8 aa, Influenza virus
DGNASGRA

SEQ ID NO: 299027 - protein, 8 aa, Influenza virus
SSLSGSAQ

SEQ ID NO: 299028 - protein, 8 aa, Influenza virus
SLSGSAQH

SEQ ID NO: 299029 - protein, 8 aa, Influenza virus
LSGSAQHV

SEQ ID NO: 299030 - protein, 8 aa, Influenza virus
SGSAQHVE

SEQ ID NO: 299031 - protein, 8 aa, Influenza virus
GGAQHIEE

SEQ ID NO: 299032 - protein, 8 aa, Influenza virus
GAQHIEEC

SEQ ID NO: 299033 - protein, 8 aa, Influenza virus
EECSCYPH

SEQ ID NO: 299034 - protein, 8 aa, Influenza virus
VRCICRDN

SEQ ID NO: 299035 - protein, 8 aa, Influenza virus
CVCRDNWM

SEQ ID NO: 299036 - protein, 8 aa, Influenza virus
VCRDNWMG

SEQ ID NO: 299037 - protein, 8 aa, Influenza virus
WMGSNRPV

SEQ ID NO: 299038 - protein, 8 aa, Influenza virus
SRYICSGL

SEQ ID NO: 299039 - protein, 8 aa, Influenza virus
RYICSGLV

SEQ ID NO: 299040 - protein, 8 aa, Influenza virus
DTPRNNDS

SEQ ID NO: 299041 - protein, 8 aa, Influenza virus
SNSNCRDP

SEQ ID NO: 299042 - protein, 8 aa, Influenza virus
NSNCRDPN

SEQ ID NO: 299043 - protein, 8 aa, Influenza virus
SNCRDSNN

SEQ ID NO: 299044 - protein, 8 aa, Influenza virus
NCRDSNNE

SEQ ID NO: 299045 - protein, 8 aa, Influenza virus
CRDPNNES

SEQ ID NO: 299046 - protein, 8 aa, Influenza virus
RDPNNESG

SEQ ID NO: 299047 - protein, 8 aa, Influenza virus
GSQGVKGW

SEQ ID NO: 299048 - protein, 8 aa, Influenza virus
SQGVKGWA

SEQ ID NO: 299049 - protein, 8 aa, Influenza virus
VKGWAFDD

SEQ ID NO: 299050 - protein, 8 aa, Influenza virus
SDVWMGRT

SEQ ID NO: 299051 - protein, 8 aa, Influenza virus
DVWMGRTV

SEQ ID NO: 299052 - protein, 8 aa, Influenza virus
VWMGRTVS

SEQ ID NO: 299053 - protein, 8 aa, Influenza virus
WMGRTISR

SEQ ID NO: 299054 - protein, 8 aa, Influenza virus
GRTVSKDS

SEQ ID NO: 299055 - protein, 8 aa, Influenza virus
RTVSKDSR

SEQ ID NO: 299056 - protein, 8 aa, Influenza virus
SRDSRSGY

SEQ ID NO: 299057 - protein, 8 aa, Influenza virus
EDSRSGYE

SEQ ID NO: 299058 - protein, 8 aa, Influenza virus
GYETFRVT

SEQ ID NO: 299059 - protein, 8 aa, Influenza virus
NNRSGYSG

SEQ ID NO: 299060 - protein, 8 aa, Influenza virus
NRSGYSGI

SEQ ID NO: 299061 - protein, 8 aa, Influenza virus
RSGYSGIF

SEQ ID NO: 299062 - protein, 8 aa, Influenza virus
GYSGIFSI

SEQ ID NO: 299063 - protein, 8 aa, Influenza virus
YSGIFSIE

SEQ ID NO: 299064 - protein, 8 aa, Influenza virus
SCVNRCFY

SEQ ID NO: 299065 - protein, 8 aa, Influenza virus
WTTNSIVV

SEQ ID NO: 299066 - protein, 8 aa, Influenza virus
TTNSIVVF

SEQ ID NO: 299067 - protein, 8 aa, Influenza virus
TNSIVVFC

SEQ ID NO: 299068 - protein, 8 aa, Influenza virus
PDGADINF

SEQ ID NO: 299069 - protein, 8 aa, Influenza virus
DGADINFM

SEQ ID NO: 299070 - protein, 8 aa, Influenza virus
GANINFMA

SEQ ID NO: 299071 - protein, 8 aa, Influenza virus
SKSDRICI

SEQ ID NO: 299072 - protein, 8 aa, Influenza virus
KSDRICIG

SEQ ID NO: 299073 - protein, 8 aa, Influenza virus
SHKICIGY

SEQ ID NO: 299074 - protein, 8 aa, Influenza virus
HKICIGYH

SEQ ID NO: 299075 - protein, 8 aa, Influenza virus
ANNSTTQI

SEQ ID NO: 299076 - protein, 8 aa, Influenza virus
NNSTTQVN

SEQ ID NO: 299077 - protein, 8 aa, Influenza virus
NSTTQVNT

SEQ ID NO: 299078 - protein, 8 aa, Influenza virus
STTQVDTL

SEQ ID NO: 299079 - protein, 8 aa, Influenza virus
TQVDTLLE

SEQ ID NO: 299080 - protein, 8 aa, Influenza virus
VDTILERN

SEQ ID NO: 299081 - protein, 8 aa, Influenza virus
DTILERNV

SEQ ID NO: 299082 - protein, 8 aa, Influenza virus
TILERNVT

SEQ ID NO: 299083 - protein, 8 aa, Influenza virus
ILERNVTV

SEQ ID NO: 299084 - protein, 8 aa, Influenza virus
LEKNITVT

SEQ ID NO: 299085 - protein, 8 aa, Influenza virus
EKNITVTH

SEQ ID NO: 299086 - protein, 8 aa, Influenza virus
KNITVTHS

SEQ ID NO: 299087 - protein, 8 aa, Influenza virus
NITVTHSV

SEQ ID NO: 299088 - protein, 8 aa, Influenza virus
ITVTHSVE

SEQ ID NO: 299089 - protein, 8 aa, Influenza virus
HSIELLEN

SEQ ID NO: 299090 - protein, 8 aa, Influenza virus
KGWILGNP

SEQ ID NO: 299091 - protein, 8 aa, Influenza virus
GWILGNPK

SEQ ID NO: 299092 - protein, 8 aa, Influenza virus
WILGNPKC

SEQ ID NO: 299093 - protein, 8 aa, Influenza virus
ILGNPRCG

SEQ ID NO: 299094 - protein, 8 aa, Influenza virus
QSWSYVVE

SEQ ID NO: 299095 - protein, 8 aa, Influenza virus
RWSYIVER

SEQ ID NO: 299096 - protein, 8 aa, Influenza virus
WSYIVERL

SEQ ID NO: 299097 - protein, 8 aa, Influenza virus
ARNGICYP

SEQ ID NO: 299098 - protein, 8 aa, Influenza virus
RNGICYPG

SEQ ID NO: 299099 - protein, 8 aa, Influenza virus
GICYPGAL

SEQ ID NO: 299100 - protein, 8 aa, Influenza virus
VQRFEMFP

SEQ ID NO: 299101 - protein, 8 aa, Influenza virus
ERFEMFPR

SEQ ID NO: 299102 - protein, 8 aa, Influenza virus
SSFYRNLV

SEQ ID NO: 299103 - protein, 8 aa, Influenza virus
FYRSLLWI

SEQ ID NO: 299104 - protein, 8 aa, Influenza virus
SVLYFWGI

SEQ ID NO: 299105 - protein, 8 aa, Influenza virus
VLYFWGIH

SEQ ID NO: 299106 - protein, 8 aa, Influenza virus
RYIRMGTE

SEQ ID NO: 299107 - protein, 8 aa, Influenza virus
YIRMGTES

SEQ ID NO: 299108 - protein, 8 aa, Influenza virus
GQRSRIDY

SEQ ID NO: 299109 - protein, 8 aa, Influenza virus
KGRIDYYW

SEQ ID NO: 299110 - protein, 8 aa, Influenza virus
SRIDYYWS

SEQ ID NO: 299111 - protein, 8 aa, Influenza virus
RIDYYWSI

SEQ ID NO: 299112 - protein, 8 aa, Influenza virus
IDYYWSIL

SEQ ID NO: 299113 - protein, 8 aa, Influenza virus
WSVLRPGE

SEQ ID NO: 299114 - protein, 8 aa, Influenza virus
SVLRPGET

SEQ ID NO: 299115 - protein, 8 aa, Influenza virus
VLRPGETL

SEQ ID NO: 299116 - protein, 8 aa, Influenza virus
LKPGETLK

SEQ ID NO: 299117 - protein, 8 aa, Influenza virus
KPGETLKV

SEQ ID NO: 299118 - protein, 8 aa, Influenza virus
PGETLNIE

SEQ ID NO: 299119 - protein, 8 aa, Influenza virus
GETLNIES

SEQ ID NO: 299120 - protein, 8 aa, Influenza virus
ETLNIESN

SEQ ID NO: 299121 - protein, 8 aa, Influenza virus
TLNIESNG

SEQ ID NO: 299122 - protein, 8 aa, Influenza virus
LNIESNGN

SEQ ID NO: 299123 - protein, 8 aa, Influenza virus
NIESNGNL

SEQ ID NO: 299124 - protein, 8 aa, Influenza virus
IESNGNLI

SEQ ID NO: 299125 - protein, 8 aa, Influenza virus
LIAPWYAF

SEQ ID NO: 299126 - protein, 8 aa, Influenza virus
VAPWYAYK

SEQ ID NO: 299127 - protein, 8 aa, Influenza virus
RTNRTFQN

SEQ ID NO: 299128 - protein, 8 aa, Influenza virus
TNRTFQNV

SEQ ID NO: 299129 - protein, 8 aa, Influenza virus
NRTFQNVS

SEQ ID NO: 299130 - protein, 8 aa, Influenza virus
RTFQNVSP

SEQ ID NO: 299131 - protein, 8 aa, Influenza virus
TFQNVSPV

SEQ ID NO: 299132 - protein, 8 aa, Influenza virus
FQNVSPVW

SEQ ID NO: 299133 - protein, 8 aa, Influenza virus
QNVSPVWI

SEQ ID NO: 299134 - protein, 8 aa, Influenza virus
NVSPVWIG

SEQ ID NO: 299135 - protein, 8 aa, Influenza virus
WIGGCPKY

SEQ ID NO: 299136 - protein, 8 aa, Influenza virus
IGGCPKYV

SEQ ID NO: 299137 - protein, 8 aa, Influenza virus
GECPKYVR

SEQ ID NO: 299138 - protein, 8 aa, Influenza virus
ECPKYVRS

SEQ ID NO: 299139 - protein, 8 aa, Influenza virus
NLKLATGL

SEQ ID NO: 299140 - protein, 8 aa, Influenza virus
TGLRNVPK

SEQ ID NO: 299141 - protein, 8 aa, Influenza virus
NRGLFGAI

SEQ ID NO: 299142 - protein, 8 aa, Influenza virus
EGGWTGLI

SEQ ID NO: 299143 - protein, 8 aa, Influenza virus
GGWTGLID

SEQ ID NO: 299144 - protein, 8 aa, Influenza virus
GWTGLIDG

SEQ ID NO: 299145 - protein, 8 aa, Influenza virus
WTGLIDGW

SEQ ID NO: 299146 - protein, 8 aa, Influenza virus
TGLIDGWY

SEQ ID NO: 299147 - protein, 8 aa, Influenza virus
GLIDGWYG

SEQ ID NO: 299148 - protein, 8 aa, Influenza virus
LIDGWYGY

SEQ ID NO: 299149 - protein, 8 aa, Influenza virus
ADRESTQR

SEQ ID NO: 299150 - protein, 8 aa, Influenza virus
DRESTQRA

SEQ ID NO: 299151 - protein, 8 aa, Influenza virus
ESTQRAID

SEQ ID NO: 299152 - protein, 8 aa, Influenza virus
ITSKVNSI

SEQ ID NO: 299153 - protein, 8 aa, Influenza virus
TSKVNSII

SEQ ID NO: 299154 - protein, 8 aa, Influenza virus
NSIIEKMN

SEQ ID NO: 299155 - protein, 8 aa, Influenza virus
SIIEKMNT

SEQ ID NO: 299156 - protein, 8 aa, Influenza virus
IIEKMNTQ

SEQ ID NO: 299157 - protein, 8 aa, Influenza virus
IEKMNTQF

SEQ ID NO: 299158 - protein, 8 aa, Influenza virus
EKMNTQFE

SEQ ID NO: 299159 - protein, 8 aa, Influenza virus
KMNTQFDA

SEQ ID NO: 299160 - protein, 8 aa, Influenza virus
MNTQFEAI

SEQ ID NO: 299161 - protein, 8 aa, Influenza virus
HEFSNLEK

SEQ ID NO: 299162 - protein, 8 aa, Influenza virus
EFSNLEKR

SEQ ID NO: 299163 - protein, 8 aa, Influenza virus
FSNLEKRI

SEQ ID NO: 299164 - protein, 8 aa, Influenza virus
NMNKRMED

SEQ ID NO: 299165 - protein, 8 aa, Influenza virus
MNKRMEDG

SEQ ID NO: 299166 - protein, 8 aa, Influenza virus
NKRMEDGL

SEQ ID NO: 299167 - protein, 8 aa, Influenza virus
KRMQDGFM

SEQ ID NO: 299168 - protein, 8 aa, Influenza virus
DGFMDVWT

SEQ ID NO: 299169 - protein, 8 aa, Influenza virus
GFMDVWTY

SEQ ID NO: 299170 - protein, 8 aa, Influenza virus
FMDVWTYN

SEQ ID NO: 299171 - protein, 8 aa, Influenza virus
MDVWTYNA

SEQ ID NO: 299172 - protein, 8 aa, Influenza virus
LLVLLENG

SEQ ID NO: 299173 - protein, 8 aa, Influenza virus
LVLLENGR

SEQ ID NO: 299174 - protein, 8 aa, Influenza virus
VLLENGRT

SEQ ID NO: 299175 - protein, 8 aa, Influenza virus
LLEDERTL

SEQ ID NO: 299176 - protein, 8 aa, Influenza virus
LEDERTLD

SEQ ID NO: 299177 - protein, 8 aa, Influenza virus
ENGRTLDM

SEQ ID NO: 299178 - protein, 8 aa, Influenza virus
NGRTLDMH

SEQ ID NO: 299179 - protein, 8 aa, Influenza virus
GRTLDMHD

SEQ ID NO: 299180 - protein, 8 aa, Influenza virus
RTLDMHDV

SEQ ID NO: 299181 - protein, 8 aa, Influenza virus
LDMHDVNV

SEQ ID NO: 299182 - protein, 8 aa, Influenza virus
DQHDANVK

SEQ ID NO: 299183 - protein, 8 aa, Influenza virus
HDANVRNL

SEQ ID NO: 299184 - protein, 8 aa, Influenza virus
VKSQLKDN

SEQ ID NO: 299185 - protein, 8 aa, Influenza virus
KSQLKDNA

SEQ ID NO: 299186 - protein, 8 aa, Influenza virus
SQLKDNAK

SEQ ID NO: 299187 - protein, 8 aa, Influenza virus
QLKDNAKD

SEQ ID NO: 299188 - protein, 8 aa, Influenza virus
LKDNAKDL

SEQ ID NO: 299189 - protein, 8 aa, Influenza virus
KDNAKDLG

SEQ ID NO: 299190 - protein, 8 aa, Influenza virus
EFWHKCNN

SEQ ID NO: 299191 - protein, 8 aa, Influenza virus
FWHKCDND

SEQ ID NO: 299192 - protein, 8 aa, Influenza virus
WHKCDNDC

SEQ ID NO: 299193 - protein, 8 aa, Influenza virus
SVKKGTYD

SEQ ID NO: 299194 - protein, 8 aa, Influenza virus
VKKGTYDY

SEQ ID NO: 299195 - protein, 8 aa, Influenza virus
KKGTYDYP

SEQ ID NO: 299196 - protein, 8 aa, Influenza virus
KGTYDYPK

SEQ ID NO: 299197 - protein, 8 aa, Influenza virus
TYNYPKYH

SEQ ID NO: 299198 - protein, 8 aa, Influenza virus
FDVYQILA

SEQ ID NO: 299199 - protein, 8 aa, Influenza virus
GIYQILAI

SEQ ID NO: 299200 - protein, 8 aa, Influenza virus
VYQILSIY

SEQ ID NO: 299201 - protein, 8 aa, Influenza virus
VSSGLVLV

SEQ ID NO: 299202 - protein, 8 aa, Influenza virus
SLVLMGLI

SEQ ID NO: 299203 - protein, 8 aa, Influenza virus
WMCLNGSM

SEQ ID NO: 299204 - protein, 8 aa, Influenza virus
MCLNGSMQ

SEQ ID NO: 299205 - protein, 8 aa, Influenza virus
CLNGSMQC

SEQ ID NO: 299206 - protein, 8 aa, Influenza virus
SNGSMQCN

SEQ ID NO: 299207 - protein, 8 aa, Influenza virus
NGSMQCNV

SEQ ID NO: 299208 - protein, 8 aa, Influenza virus
GSMQCNVC

SEQ ID NO: 299209 - protein, 8 aa, Influenza virus
SMQCNVCI

SEQ ID NO: 299210 - protein, 8 aa, Influenza virus
SRGYKMNI

SEQ ID NO: 299211 - protein, 8 aa, Influenza virus
RGYKMNTR

SEQ ID NO: 299212 - protein, 8 aa, Influenza virus
GYKMNNQI

SEQ ID NO: 299213 - protein, 8 aa, Influenza virus
YKMNTRIL

SEQ ID NO: 299214 - protein, 8 aa, Influenza virus
NGTRVNTL

SEQ ID NO: 299215 - protein, 8 aa, Influenza virus
GTRVNTLT

SEQ ID NO: 299216 - protein, 8 aa, Influenza virus
TLTEKGIE

SEQ ID NO: 299217 - protein, 8 aa, Influenza virus
LTEKGIEV

SEQ ID NO: 299218 - protein, 8 aa, Influenza virus
TEKGIEVV

SEQ ID NO: 299219 - protein, 8 aa, Influenza virus
EKGIEVVN

SEQ ID NO: 299220 - protein, 8 aa, Influenza virus
KGIEVVNA

SEQ ID NO: 299221 - protein, 8 aa, Influenza virus
GVEVVDAT

SEQ ID NO: 299222 - protein, 8 aa, Influenza virus
VEVVDATE

SEQ ID NO: 299223 - protein, 8 aa, Influenza virus
NATETVEQ

SEQ ID NO: 299224 - protein, 8 aa, Influenza virus
GPPQCDRF

SEQ ID NO: 299225 - protein, 8 aa, Influenza virus
PPQCDRFL

SEQ ID NO: 299226 - protein, 8 aa, Influenza virus
PQCDRFLE

SEQ ID NO: 299227 - protein, 8 aa, Influenza virus
QCDRFLEF

SEQ ID NO: 299228 - protein, 8 aa, Influenza virus
DICYPGKF

SEQ ID NO: 299229 - protein, 8 aa, Influenza virus
ESSFYAEM

SEQ ID NO: 299230 - protein, 8 aa, Influenza virus
SSFYAEME

SEQ ID NO: 299231 - protein, 8 aa, Influenza virus
EMEWLLSN

SEQ ID NO: 299232 - protein, 8 aa, Influenza virus
ALIVWGIH

SEQ ID NO: 299233 - protein, 8 aa, Influenza virus
LIVWGIHH

SEQ ID NO: 299234 - protein, 8 aa, Influenza virus
MNGQSGRI

SEQ ID NO: 299235 - protein, 8 aa, Influenza virus
NGQFGRIN

SEQ ID NO: 299236 - protein, 8 aa, Influenza virus
GQSGRINF

SEQ ID NO: 299237 - protein, 8 aa, Influenza virus
QFGRINFH

SEQ ID NO: 299238 - protein, 8 aa, Influenza virus
FGRINFHW

SEQ ID NO: 299239 - protein, 8 aa, Influenza virus
GRIDFHWM

SEQ ID NO: 299240 - protein, 8 aa, Influenza virus
TFNFNGAF

SEQ ID NO: 299241 - protein, 8 aa, Influenza virus
FSFNGAFV

SEQ ID NO: 299242 - protein, 8 aa, Influenza virus
SFNGAFVA

SEQ ID NO: 299243 - protein, 8 aa, Influenza virus
NGAFVAPD

SEQ ID NO: 299244 - protein, 8 aa, Influenza virus
GAFVAPDR

SEQ ID NO: 299245 - protein, 8 aa, Influenza virus
AFIAPNRA

SEQ ID NO: 299246 - protein, 8 aa, Influenza virus
FIAPNRAS

SEQ ID NO: 299247 - protein, 8 aa, Influenza virus
IAPNRASF

SEQ ID NO: 299248 - protein, 8 aa, Influenza virus
LPFQNVNS

SEQ ID NO: 299249 - protein, 8 aa, Influenza virus
IGKCPRYV

SEQ ID NO: 299250 - protein, 8 aa, Influenza virus
GKCPRYVR

SEQ ID NO: 299251 - protein, 8 aa, Influenza virus
KCPRYVRQ

SEQ ID NO: 299252 - protein, 8 aa, Influenza virus
LMLATGMK

SEQ ID NO: 299253 - protein, 8 aa, Influenza virus
MLATGMKN

SEQ ID NO: 299254 - protein, 8 aa, Influenza virus
LATGMRNI

SEQ ID NO: 299255 - protein, 8 aa, Influenza virus
ATGMRNIP

SEQ ID NO: 299256 - protein, 8 aa, Influenza virus
TGMRNIPE

SEQ ID NO: 299257 - protein, 8 aa, Influenza virus
IHKQLTHH

SEQ ID NO: 299258 - protein, 8 aa, Influenza virus
RKTRGLFG

SEQ ID NO: 299259 - protein, 8 aa, Influenza virus
KTRGLFGA

SEQ ID NO: 299260 - protein, 8 aa, Influenza virus
KRGLFGAI

SEQ ID NO: 299261 - protein, 8 aa, Influenza virus
NGWEGLVD

SEQ ID NO: 299262 - protein, 8 aa, Influenza virus
GWEGLVDG

SEQ ID NO: 299263 - protein, 8 aa, Influenza virus
WEGLVDGW

SEQ ID NO: 299264 - protein, 8 aa, Influenza virus
EGLVDGWY

SEQ ID NO: 299265 - protein, 8 aa, Influenza virus
GLVDGWYG

SEQ ID NO: 299266 - protein, 8 aa, Influenza virus
LVDGWYGF

SEQ ID NO: 299267 - protein, 8 aa, Influenza virus
VDGWYGFR

SEQ ID NO: 299268 - protein, 8 aa, Influenza virus
DGWYGYRH

SEQ ID NO: 299269 - protein, 8 aa, Influenza virus
GWYGFKHQ

SEQ ID NO: 299270 - protein, 8 aa, Influenza virus
WYGFKHQN

SEQ ID NO: 299271 - protein, 8 aa, Influenza virus
YGFRHQNS

SEQ ID NO: 299272 - protein, 8 aa, Influenza virus
GFRHQNSQ

SEQ ID NO: 299273 - protein, 8 aa, Influenza virus
FRHQNSQG

SEQ ID NO: 299274 - protein, 8 aa, Influenza virus
RHQNSQGE

SEQ ID NO: 299275 - protein, 8 aa, Influenza virus
QNSQGEGT

SEQ ID NO: 299276 - protein, 8 aa, Influenza virus
NSQGEGTA

SEQ ID NO: 299277 - protein, 8 aa, Influenza virus
SQGEGTAA

SEQ ID NO: 299278 - protein, 8 aa, Influenza virus
KSTQSAVD

SEQ ID NO: 299279 - protein, 8 aa, Influenza virus
STQSAVDQ

SEQ ID NO: 299280 - protein, 8 aa, Influenza virus
TQSAINQI

SEQ ID NO: 299281 - protein, 8 aa, Influenza virus
QSAINQIT

SEQ ID NO: 299282 - protein, 8 aa, Influenza virus
SAINQITG

SEQ ID NO: 299283 - protein, 8 aa, Influenza virus
AINQITGK

SEQ ID NO: 299284 - protein, 8 aa, Influenza virus
INQITGKL

SEQ ID NO: 299285 - protein, 8 aa, Influenza virus
NQITGKLN

SEQ ID NO: 299286 - protein, 8 aa, Influenza virus
ITGKLNRI

SEQ ID NO: 299287 - protein, 8 aa, Influenza virus
TGKLNHLI

SEQ ID NO: 299288 - protein, 8 aa, Influenza virus
IDKTNQQF

SEQ ID NO: 299289 - protein, 8 aa, Influenza virus
KTNQQFKL

SEQ ID NO: 299290 - protein, 8 aa, Influenza virus
TNQQFKLI

SEQ ID NO: 299291 - protein, 8 aa, Influenza virus
EVEQQIGN

SEQ ID NO: 299292 - protein, 8 aa, Influenza virus
ERQIGNVI

SEQ ID NO: 299293 - protein, 8 aa, Influenza virus
RQIGNVIN

SEQ ID NO: 299294 - protein, 8 aa, Influenza virus
VINWTQDA

SEQ ID NO: 299295 - protein, 8 aa, Influenza virus
IEVWSYNA

SEQ ID NO: 299296 - protein, 8 aa, Influenza virus
ELWSYNAE

SEQ ID NO: 299297 - protein, 8 aa, Influenza virus
SYNAELLI

SEQ ID NO: 299298 - protein, 8 aa, Influenza virus
YNAELLIA

SEQ ID NO: 299299 - protein, 8 aa, Influenza virus
AELLIAME

SEQ ID NO: 299300 - protein, 8 aa, Influenza virus
ELLIAMEN

SEQ ID NO: 299301 - protein, 8 aa, Influenza virus
LLIAMENQ

SEQ ID NO: 299302 - protein, 8 aa, Influenza virus
LIAMENQH

SEQ ID NO: 299303 - protein, 8 aa, Influenza virus
IAMENQHT

SEQ ID NO: 299304 - protein, 8 aa, Influenza virus
ALENQHTI

SEQ ID NO: 299305 - protein, 8 aa, Influenza virus
LENQHTID

SEQ ID NO: 299306 - protein, 8 aa, Influenza virus
HIIDLADS

SEQ ID NO: 299307 - protein, 8 aa, Influenza virus
IIDLADSE

SEQ ID NO: 299308 - protein, 8 aa, Influenza virus
DSEMDKLY

SEQ ID NO: 299309 - protein, 8 aa, Influenza virus
SEMDKLYE

SEQ ID NO: 299310 - protein, 8 aa, Influenza virus
EMNKLYEK

SEQ ID NO: 299311 - protein, 8 aa, Influenza virus
MNKLYEKV

SEQ ID NO: 299312 - protein, 8 aa, Influenza virus
KLYERVKR

SEQ ID NO: 299313 - protein, 8 aa, Influenza virus
VRRQLREN

SEQ ID NO: 299314 - protein, 8 aa, Influenza virus
RRQLRENA

SEQ ID NO: 299315 - protein, 8 aa, Influenza virus
RLLRENAE

SEQ ID NO: 299316 - protein, 8 aa, Influenza virus
EIFHKCDN

SEQ ID NO: 299317 - protein, 8 aa, Influenza virus
CMASIRNS

SEQ ID NO: 299318 - protein, 8 aa, Influenza virus
MASIRNST

SEQ ID NO: 299319 - protein, 8 aa, Influenza virus
ASIRNSTY

SEQ ID NO: 299320 - protein, 8 aa, Influenza virus
SIRNSTYD

SEQ ID NO: 299321 - protein, 8 aa, Influenza virus
IRNSTYDH

SEQ ID NO: 299322 - protein, 8 aa, Influenza virus
YRAESLQN

SEQ ID NO: 299323 - protein, 8 aa, Influenza virus
RAESLQNR

SEQ ID NO: 299324 - protein, 8 aa, Influenza virus
IKLSSGYK

SEQ ID NO: 299325 - protein, 8 aa, Influenza virus
KLSGGYKD

SEQ ID NO: 299326 - protein, 8 aa, Influenza virus
SSGYKEVI

SEQ ID NO: 299327 - protein, 8 aa, Influenza virus
SGYKEVIL

SEQ ID NO: 299328 - protein, 8 aa, Influenza virus
GYKEVILW

SEQ ID NO: 299329 - protein, 8 aa, Influenza virus
YKEVILWF

SEQ ID NO: 299330 - protein, 8 aa, Influenza virus
KEVILWFS

SEQ ID NO: 299331 - protein, 8 aa, Influenza virus
EVILWFSF

SEQ ID NO: 299332 - protein, 8 aa, Influenza virus
SFGASCLI

SEQ ID NO: 299333 - protein, 8 aa, Influenza virus
FGASCFLF

SEQ ID NO: 299334 - protein, 8 aa, Influenza virus
GASCFLLI

SEQ ID NO: 299335 - protein, 8 aa, Influenza virus
ASCFLLIA

SEQ ID NO: 299336 - protein, 8 aa, Influenza virus
FMCVKNGN

SEQ ID NO: 299337 - protein, 8 aa, Influenza virus
MCVKNGNM

SEQ ID NO: 299338 - protein, 8 aa, Influenza virus
CVKNGNMR

SEQ ID NO: 299339 - protein, 8 aa, Influenza virus
RNGNMRCT

SEQ ID NO: 299340 - protein, 8 aa, Influenza virus
PTNADKIC

SEQ ID NO: 299341 - protein, 8 aa, Influenza virus
TNADKICL

SEQ ID NO: 299342 - protein, 8 aa, Influenza virus
RGDKICLG

SEQ ID NO: 299343 - protein, 8 aa, Influenza virus
VSNGTKIN

SEQ ID NO: 299344 - protein, 8 aa, Influenza virus
SNGTKINT

SEQ ID NO: 299345 - protein, 8 aa, Influenza virus
KINTLTER

SEQ ID NO: 299346 - protein, 8 aa, Influenza virus
INTLTERG

SEQ ID NO: 299347 - protein, 8 aa, Influenza virus
NTLTERGV

SEQ ID NO: 299348 - protein, 8 aa, Influenza virus
TLTERGVE

SEQ ID NO: 299349 - protein, 8 aa, Influenza virus
LTERGVEV

SEQ ID NO: 299350 - protein, 8 aa, Influenza virus
TERGVEVV

SEQ ID NO: 299351 - protein, 8 aa, Influenza virus
ERGVEVVN

SEQ ID NO: 299352 - protein, 8 aa, Influenza virus
RGVEVVNA

SEQ ID NO: 299353 - protein, 8 aa, Influenza virus
ATETVERT

SEQ ID NO: 299354 - protein, 8 aa, Influenza virus
GQCGLLGI

SEQ ID NO: 299355 - protein, 8 aa, Influenza virus
QCGLLGTI

SEQ ID NO: 299356 - protein, 8 aa, Influenza virus
CGLLGTIT

SEQ ID NO: 299357 - protein, 8 aa, Influenza virus
GLLGTITG

SEQ ID NO: 299358 - protein, 8 aa, Influenza virus
LLGTITGP

SEQ ID NO: 299359 - protein, 8 aa, Influenza virus
LGTITGPP

SEQ ID NO: 299360 - protein, 8 aa, Influenza virus
ITGPPQCD

SEQ ID NO: 299361 - protein, 8 aa, Influenza virus
IGPPQCDK

SEQ ID NO: 299362 - protein, 8 aa, Influenza virus
PPHCDQFL

SEQ ID NO: 299363 - protein, 8 aa, Influenza virus
CDQFLEFD

SEQ ID NO: 299364 - protein, 8 aa, Influenza virus
SDLIIERK

SEQ ID NO: 299365 - protein, 8 aa, Influenza virus
IIERKEGT

SEQ ID NO: 299366 - protein, 8 aa, Influenza virus
IERREGAD

SEQ ID NO: 299367 - protein, 8 aa, Influenza virus
EGNDVCYP

SEQ ID NO: 299368 - protein, 8 aa, Influenza virus
GNDVCYPG

SEQ ID NO: 299369 - protein, 8 aa, Influenza virus
DICYPGRF

SEQ ID NO: 299370 - protein, 8 aa, Influenza virus
CYPGKFVN

SEQ ID NO: 299371 - protein, 8 aa, Influenza virus
YPGKFVNE

SEQ ID NO: 299372 - protein, 8 aa, Influenza virus
PGKFVNEE

SEQ ID NO: 299373 - protein, 8 aa, Influenza virus
FVNGEALR

SEQ ID NO: 299374 - protein, 8 aa, Influenza virus
VNGEALRQ

SEQ ID NO: 299375 - protein, 8 aa, Influenza virus
NGEALRQI

SEQ ID NO: 299376 - protein, 8 aa, Influenza virus
GEALRQIL

SEQ ID NO: 299377 - protein, 8 aa, Influenza virus
EPLRQILR

SEQ ID NO: 299378 - protein, 8 aa, Influenza virus
LRQILRES

SEQ ID NO: 299379 - protein, 8 aa, Influenza virus
RQILRESG

SEQ ID NO: 299380 - protein, 8 aa, Influenza virus
QILRESGG

SEQ ID NO: 299381 - protein, 8 aa, Influenza virus
ILRESGGI

SEQ ID NO: 299382 - protein, 8 aa, Influenza virus
RGSGGIDK

SEQ ID NO: 299383 - protein, 8 aa, Influenza virus
GSGGIDKE

SEQ ID NO: 299384 - protein, 8 aa, Influenza virus
GFTYSEIR

SEQ ID NO: 299385 - protein, 8 aa, Influenza virus
FIYSGIRT

SEQ ID NO: 299386 - protein, 8 aa, Influenza virus
IYSGIRTN

SEQ ID NO: 299387 - protein, 8 aa, Influenza virus
SGIRTNGT

SEQ ID NO: 299388 - protein, 8 aa, Influenza virus
GIRTNGAA

SEQ ID NO: 299389 - protein, 8 aa, Influenza virus
IRTNGAAS

SEQ ID NO: 299390 - protein, 8 aa, Influenza virus
RSSSSFYA

SEQ ID NO: 299391 - protein, 8 aa, Influenza virus
SSSSFYAE

SEQ ID NO: 299392 - protein, 8 aa, Influenza virus
SSSFYAEM

SEQ ID NO: 299393 - protein, 8 aa, Influenza virus
MKWLLSSS

SEQ ID NO: 299394 - protein, 8 aa, Influenza virus
KWLLSSSD

SEQ ID NO: 299395 - protein, 8 aa, Influenza virus
WLLSSSDN

SEQ ID NO: 299396 - protein, 8 aa, Influenza virus
ALIVWGIH

SEQ ID NO: 299397 - protein, 8 aa, Influenza virus
LIVWGIHH

SEQ ID NO: 299398 - protein, 8 aa, Influenza virus
IVWGIHHS

SEQ ID NO: 299399 - protein, 8 aa, Influenza virus
AEQTKLYG

SEQ ID NO: 299400 - protein, 8 aa, Influenza virus
TKLYGSGS

SEQ ID NO: 299401 - protein, 8 aa, Influenza virus
KLYGSGSK

SEQ ID NO: 299402 - protein, 8 aa, Influenza virus
LYGSGSKL

SEQ ID NO: 299403 - protein, 8 aa, Influenza virus
YGNGNKLV

SEQ ID NO: 299404 - protein, 8 aa, Influenza virus
SSNYQQSF

SEQ ID NO: 299405 - protein, 8 aa, Influenza virus
PGTRRIDF

SEQ ID NO: 299406 - protein, 8 aa, Influenza virus
GTRRIDFH

SEQ ID NO: 299407 - protein, 8 aa, Influenza virus
TRRIDFHW

SEQ ID NO: 299408 - protein, 8 aa, Influenza virus
RRIDFNWL

SEQ ID NO: 299409 - protein, 8 aa, Influenza virus
RIDFHWLI

SEQ ID NO: 299410 - protein, 8 aa, Influenza virus
IDFHWLIL

SEQ ID NO: 299411 - protein, 8 aa, Influenza virus
NDTVTFIF

SEQ ID NO: 299412 - protein, 8 aa, Influenza virus
DTVTFIFN

SEQ ID NO: 299413 - protein, 8 aa, Influenza virus
TVTFIFNG

SEQ ID NO: 299414 - protein, 8 aa, Influenza virus
VTFIFNGA

SEQ ID NO: 299415 - protein, 8 aa, Influenza virus
TFIFNGAF

SEQ ID NO: 299416 - protein, 8 aa, Influenza virus
FIFNGAFI

SEQ ID NO: 299417 - protein, 8 aa, Influenza virus
IFNGAFIA

SEQ ID NO: 299418 - protein, 8 aa, Influenza virus
APNRASFF

SEQ ID NO: 299419 - protein, 8 aa, Influenza virus
PNRASFFR

SEQ ID NO: 299420 - protein, 8 aa, Influenza virus
NRASFFRG

SEQ ID NO: 299421 - protein, 8 aa, Influenza virus
RASFFKGE

SEQ ID NO: 299422 - protein, 8 aa, Influenza virus
CYHSGGTI

SEQ ID NO: 299423 - protein, 8 aa, Influenza virus
GGTIISSL

SEQ ID NO: 299424 - protein, 8 aa, Influenza virus
GTIISSLP

SEQ ID NO: 299425 - protein, 8 aa, Influenza virus
TIISSLPF

SEQ ID NO: 299426 - protein, 8 aa, Influenza virus
IISSLPFQ

SEQ ID NO: 299427 - protein, 8 aa, Influenza virus
VSSLPFQS

SEQ ID NO: 299428 - protein, 8 aa, Influenza virus
SLPFQNIS

SEQ ID NO: 299429 - protein, 8 aa, Influenza virus
LPFQNISP

SEQ ID NO: 299430 - protein, 8 aa, Influenza virus
PFQNINPK

SEQ ID NO: 299431 - protein, 8 aa, Influenza virus
FQNINSRA

SEQ ID NO: 299432 - protein, 8 aa, Influenza virus
RAVGKCPR

SEQ ID NO: 299433 - protein, 8 aa, Influenza virus
AVGKCPRY

SEQ ID NO: 299434 - protein, 8 aa, Influenza virus
VGKCPKYV

SEQ ID NO: 299435 - protein, 8 aa, Influenza virus
GKCPKYVK

SEQ ID NO: 299436 - protein, 8 aa, Influenza virus
KCPKYVKQ

SEQ ID NO: 299437 - protein, 8 aa, Influenza virus
CPRYVKQE

SEQ ID NO: 299438 - protein, 8 aa, Influenza virus
PRYVKQES

SEQ ID NO: 299439 - protein, 8 aa, Influenza virus
VKQESLLL

SEQ ID NO: 299440 - protein, 8 aa, Influenza virus
KQESLLLA

SEQ ID NO: 299441 - protein, 8 aa, Influenza virus
QESLLLAT

SEQ ID NO: 299442 - protein, 8 aa, Influenza virus
ESLLLATG

SEQ ID NO: 299443 - protein, 8 aa, Influenza virus
LMLATGMK

SEQ ID NO: 299444 - protein, 8 aa, Influenza virus
MLATGMKN

SEQ ID NO: 299445 - protein, 8 aa, Influenza virus
LATGMRNI

SEQ ID NO: 299446 - protein, 8 aa, Influenza virus
ATGMRNIP

SEQ ID NO: 299447 - protein, 8 aa, Influenza virus
TGMRNIPE

SEQ ID NO: 299448 - protein, 8 aa, Influenza virus
GMKNVPEI

SEQ ID NO: 299449 - protein, 8 aa, Influenza virus
MKNVPEIP

SEQ ID NO: 299450 - protein, 8 aa, Influenza virus
KNVPEIPK

SEQ ID NO: 299451 - protein, 8 aa, Influenza virus
PKTRGLFG

SEQ ID NO: 299452 - protein, 8 aa, Influenza virus
KTRGLFGA

SEQ ID NO: 299453 - protein, 8 aa, Influenza virus
TRGLFGAI

SEQ ID NO: 299454 - protein, 8 aa, Influenza virus
NGWEGLVD

SEQ ID NO: 299455 - protein, 8 aa, Influenza virus
GWEGLVDG

SEQ ID NO: 299456 - protein, 8 aa, Influenza virus
WEGLVDGW

SEQ ID NO: 299457 - protein, 8 aa, Influenza virus
EGLVDGWY

SEQ ID NO: 299458 - protein, 8 aa, Influenza virus
GLVDGWYG

SEQ ID NO: 299459 - protein, 8 aa, Influenza virus
LVDGWYGF

SEQ ID NO: 299460 - protein, 8 aa, Influenza virus
VDGWYGFR

SEQ ID NO: 299461 - protein, 8 aa, Influenza virus
GKLNRLIS

SEQ ID NO: 299462 - protein, 8 aa, Influenza virus
KLNRLISK

SEQ ID NO: 299463 - protein, 8 aa, Influenza virus
LNRLISKT

SEQ ID NO: 299464 - protein, 8 aa, Influenza virus
NRLIEKTN

SEQ ID NO: 299465 - protein, 8 aa, Influenza virus
RLISKTNQ

SEQ ID NO: 299466 - protein, 8 aa, Influenza virus
LIEKTNQQ

SEQ ID NO: 299467 - protein, 8 aa, Influenza virus
ISKTNQQF

SEQ ID NO: 299468 - protein, 8 aa, Influenza virus
SKTNQQFE

SEQ ID NO: 299469 - protein, 8 aa, Influenza virus
NQQFEMID

SEQ ID NO: 299470 - protein, 8 aa, Influenza virus
QQFELIDH

SEQ ID NO: 299471 - protein, 8 aa, Influenza virus
RFELIDNE

SEQ ID NO: 299472 - protein, 8 aa, Influenza virus
FEMIDNEF

SEQ ID NO: 299473 - protein, 8 aa, Influenza virus
ELIDNEFT

SEQ ID NO: 299474 - protein, 8 aa, Influenza virus
LIDNEFTE

SEQ ID NO: 299475 - protein, 8 aa, Influenza virus
NEFTEVEK

SEQ ID NO: 299476 - protein, 8 aa, Influenza virus
EFTEVEKQ

SEQ ID NO: 299477 - protein, 8 aa, Influenza virus
FTEVEKQI

SEQ ID NO: 299478 - protein, 8 aa, Influenza virus
TEVEKQIG

SEQ ID NO: 299479 - protein, 8 aa, Influenza virus
EVEKQIGN

SEQ ID NO: 299480 - protein, 8 aa, Influenza virus
VEKQIGNV

SEQ ID NO: 299481 - protein, 8 aa, Influenza virus
VINWTRDS

SEQ ID NO: 299482 - protein, 8 aa, Influenza virus
INWTRDSM

SEQ ID NO: 299483 - protein, 8 aa, Influenza virus
NWTRDSMT

SEQ ID NO: 299484 - protein, 8 aa, Influenza virus
WTRDSMTE

SEQ ID NO: 299485 - protein, 8 aa, Influenza virus
TRDSMTEV

SEQ ID NO: 299486 - protein, 8 aa, Influenza virus
RDSMTEVW

SEQ ID NO: 299487 - protein, 8 aa, Influenza virus
DSMTEVWS

SEQ ID NO: 299488 - protein, 8 aa, Influenza virus
SMTEVWSY

SEQ ID NO: 299489 - protein, 8 aa, Influenza virus
ITEVWSYN

SEQ ID NO: 299490 - protein, 8 aa, Influenza virus
VAIENQHT

SEQ ID NO: 299491 - protein, 8 aa, Influenza virus
AIENQHTI

SEQ ID NO: 299492 - protein, 8 aa, Influenza virus
DLTDSEMS

SEQ ID NO: 299493 - protein, 8 aa, Influenza virus
LTDSEMSK

SEQ ID NO: 299494 - protein, 8 aa, Influenza virus
TDSEMSKL

SEQ ID NO: 299495 - protein, 8 aa, Influenza virus
DSEMKKLY

SEQ ID NO: 299496 - protein, 8 aa, Influenza virus
SEMKKLYE

SEQ ID NO: 299497 - protein, 8 aa, Influenza virus
EMKKLYER

SEQ ID NO: 299498 - protein, 8 aa, Influenza virus
MKKLYERV

SEQ ID NO: 299499 - protein, 8 aa, Influenza virus
NKLYERVR

SEQ ID NO: 299500 - protein, 8 aa, Influenza virus
KLYERVRR

SEQ ID NO: 299501 - protein, 8 aa, Influenza virus
LYERVRRQ

SEQ ID NO: 299502 - protein, 8 aa, Influenza virus
YERVRRQL

SEQ ID NO: 299503 - protein, 8 aa, Influenza virus
ERVRRQLR

SEQ ID NO: 299504 - protein, 8 aa, Influenza virus
RVRRQLRE

SEQ ID NO: 299505 - protein, 8 aa, Influenza virus
VRRQLREN

SEQ ID NO: 299506 - protein, 8 aa, Influenza virus
RRQLRENA

SEQ ID NO: 299507 - protein, 8 aa, Influenza virus
IFHKCDDD

SEQ ID NO: 299508 - protein, 8 aa, Influenza virus
FHKCDDDC

SEQ ID NO: 299509 - protein, 8 aa, Influenza virus
HKCDDDCM

SEQ ID NO: 299510 - protein, 8 aa, Influenza virus
KCDDDCMA

SEQ ID NO: 299511 - protein, 8 aa, Influenza virus
CDDDCMAS

SEQ ID NO: 299512 - protein, 8 aa, Influenza virus
DDDCMASI

SEQ ID NO: 299513 - protein, 8 aa, Influenza virus
DDCMASIR

SEQ ID NO: 299514 - protein, 8 aa, Influenza virus
DCMASIRN

SEQ ID NO: 299515 - protein, 8 aa, Influenza virus
RNNTYNHT

SEQ ID NO: 299516 - protein, 8 aa, Influenza virus
NNTYNHTQ

SEQ ID NO: 299517 - protein, 8 aa, Influenza virus
NTYDHTKY

SEQ ID NO: 299518 - protein, 8 aa, Influenza virus
TYNHTQYR

SEQ ID NO: 299519 - protein, 8 aa, Influenza virus
YDHTKYRT

SEQ ID NO: 299520 - protein, 8 aa, Influenza virus
HTKYRTES

SEQ ID NO: 299521 - protein, 8 aa, Influenza virus
TKYRTESL

SEQ ID NO: 299522 - protein, 8 aa, Influenza virus
KYRTESLQ

SEQ ID NO: 299523 - protein, 8 aa, Influenza virus
EEAMQNRL

SEQ ID NO: 299524 - protein, 8 aa, Influenza virus
QNRIQIDQ

SEQ ID NO: 299525 - protein, 8 aa, Influenza virus
NRIQIDQV

SEQ ID NO: 299526 - protein, 8 aa, Influenza virus
RIQIDQVK

SEQ ID NO: 299527 - protein, 8 aa, Influenza virus
IQIDQVKL

SEQ ID NO: 299528 - protein, 8 aa, Influenza virus
QIDQVKLS

SEQ ID NO: 299529 - protein, 8 aa, Influenza virus
IDQVKLSS

SEQ ID NO: 299530 - protein, 8 aa, Influenza virus
DQVKLSSG

SEQ ID NO: 299531 - protein, 8 aa, Influenza virus
QVKLSSGY

SEQ ID NO: 299532 - protein, 8 aa, Influenza virus
LSGGYKDI

SEQ ID NO: 299533 - protein, 8 aa, Influenza virus
SGGYKDII

SEQ ID NO: 299534 - protein, 8 aa, Influenza virus
GGYKDIIL

SEQ ID NO: 299535 - protein, 8 aa, Influenza virus
SCFLLLAV

SEQ ID NO: 299536 - protein, 8 aa, Influenza virus
CFLLLAIV

SEQ ID NO: 299537 - protein, 8 aa, Influenza virus
LLAVVMGL

SEQ ID NO: 299538 - protein, 8 aa, Influenza virus
LAVVMGLV

SEQ ID NO: 299539 - protein, 8 aa, Influenza virus
AVVMGLVF

SEQ ID NO: 299540 - protein, 8 aa, Influenza virus
IAMGLVFM

SEQ ID NO: 299541 - protein, 8 aa, Influenza virus
AMGLVFMC

SEQ ID NO: 299542 - protein, 8 aa, Influenza virus
MGLVFICV

SEQ ID NO: 299543 - protein, 8 aa, Influenza virus
GLVFICVK

SEQ ID NO: 299544 - protein, 8 aa, Influenza virus
LVFICVKN

SEQ ID NO: 299545 - protein, 8 aa, Influenza virus
VFICVKNG

SEQ ID NO: 299546 - protein, 8 aa, Influenza virus
FMCVKNGN

SEQ ID NO: 299547 - protein, 8 aa, Influenza virus
MCVKNGNM

SEQ ID NO: 299548 - protein, 8 aa, Influenza virus
CVKNGNMR

SEQ ID NO: 299549 - protein, 8 aa, Influenza virus
VKNGNMRC

SEQ ID NO: 299550 - protein, 8 aa, Influenza virus
GSVSLIIA

SEQ ID NO: 299551 - protein, 8 aa, Influenza virus
SVSLTIAI

SEQ ID NO: 299552 - protein, 8 aa, Influenza virus
TVCFFMQI

SEQ ID NO: 299553 - protein, 8 aa, Influenza virus
ICFLMQIA

SEQ ID NO: 299554 - protein, 8 aa, Influenza virus
CFLMQIAT

SEQ ID NO: 299555 - protein, 8 aa, Influenza virus
FLMQIATL

SEQ ID NO: 299556 - protein, 8 aa, Influenza virus
KRNITEIV

SEQ ID NO: 299557 - protein, 8 aa, Influenza virus
RNVTETLY

SEQ ID NO: 299558 - protein, 8 aa, Influenza virus
NITKIVYL

SEQ ID NO: 299559 - protein, 8 aa, Influenza virus
ITKIVYLN

SEQ ID NO: 299560 - protein, 8 aa, Influenza virus
TETLYLNH

SEQ ID NO: 299561 - protein, 8 aa, Influenza virus
KIVYLNST

SEQ ID NO: 299562 - protein, 8 aa, Influenza virus
YRDWSKPQ

SEQ ID NO: 299563 - protein, 8 aa, Influenza virus
RDWSKPQC

SEQ ID NO: 299564 - protein, 8 aa, Influenza virus
DWSKPQCQ

SEQ ID NO: 299565 - protein, 8 aa, Influenza virus
SKPQCQII

SEQ ID NO: 299566 - protein, 8 aa, Influenza virus
KPQCQIIG

SEQ ID NO: 299567 - protein, 8 aa, Influenza virus
QCQIIGFA

SEQ ID NO: 299568 - protein, 8 aa, Influenza virus
CQIIGFAP

SEQ ID NO: 299569 - protein, 8 aa, Influenza virus
PFSKDNSV

SEQ ID NO: 299570 - protein, 8 aa, Influenza virus
FSKDNSVR

SEQ ID NO: 299571 - protein, 8 aa, Influenza virus
SKDNSVRL

SEQ ID NO: 299572 - protein, 8 aa, Influenza virus
IRLSAGGN

SEQ ID NO: 299573 - protein, 8 aa, Influenza virus
RLSAGGNI

SEQ ID NO: 299574 - protein, 8 aa, Influenza virus
LSASGDIW

SEQ ID NO: 299575 - protein, 8 aa, Influenza virus
SAGGDIWV

SEQ ID NO: 299576 - protein, 8 aa, Influenza virus
AGGDIWVT

SEQ ID NO: 299577 - protein, 8 aa, Influenza virus
GGDIWVTR

SEQ ID NO: 299578 - protein, 8 aa, Influenza virus
GDIWVTRE

SEQ ID NO: 299579 - protein, 8 aa, Influenza virus
DIWVTREP

SEQ ID NO: 299580 - protein, 8 aa, Influenza virus
REPYVSCG

SEQ ID NO: 299581 - protein, 8 aa, Influenza virus
EPYVSCSL

SEQ ID NO: 299582 - protein, 8 aa, Influenza virus
GKCYQFAL

SEQ ID NO: 299583 - protein, 8 aa, Influenza virus
LGQGTTLE

SEQ ID NO: 299584 - protein, 8 aa, Influenza virus
GQGTTLEN

SEQ ID NO: 299585 - protein, 8 aa, Influenza virus
QGTTLYNK

SEQ ID NO: 299586 - protein, 8 aa, Influenza virus
GTTLYNKH

SEQ ID NO: 299587 - protein, 8 aa, Influenza virus
TTLYNKHS

SEQ ID NO: 299588 - protein, 8 aa, Influenza virus
TLYNKHSN

SEQ ID NO: 299589 - protein, 8 aa, Influenza virus
LYNKHSNG

SEQ ID NO: 299590 - protein, 8 aa, Influenza virus
YNKHSNGT

SEQ ID NO: 299591 - protein, 8 aa, Influenza virus
NEHSNGTT

SEQ ID NO: 299592 - protein, 8 aa, Influenza virus
EHSNGTTH

SEQ ID NO: 299593 - protein, 8 aa, Influenza virus
NGTTHDRI

SEQ ID NO: 299594 - protein, 8 aa, Influenza virus
HDRTSHRT

SEQ ID NO: 299595 - protein, 8 aa, Influenza virus
DRTSHRTL

SEQ ID NO: 299596 - protein, 8 aa, Influenza virus
RTSHRTLL

SEQ ID NO: 299597 - protein, 8 aa, Influenza virus
TSHRTLLM

SEQ ID NO: 299598 - protein, 8 aa, Influenza virus
GTKQVCMA

SEQ ID NO: 299599 - protein, 8 aa, Influenza virus
TKQVCMAW

SEQ ID NO: 299600 - protein, 8 aa, Influenza virus
KAWLHICV

SEQ ID NO: 299601 - protein, 8 aa, Influenza virus
AWLHVCIT

SEQ ID NO: 299602 - protein, 8 aa, Influenza virus
WLHICVTG

SEQ ID NO: 299603 - protein, 8 aa, Influenza virus
LHVCITGD

SEQ ID NO: 299604 - protein, 8 aa, Influenza virus
HICVTGDD

SEQ ID NO: 299605 - protein, 8 aa, Influenza virus
VCVTGDDK

SEQ ID NO: 299606 - protein, 8 aa, Influenza virus
CVTGDDKN

SEQ ID NO: 299607 - protein, 8 aa, Influenza virus
VTGDDKNA

SEQ ID NO: 299608 - protein, 8 aa, Influenza virus
DRNATASL

SEQ ID NO: 299609 - protein, 8 aa, Influenza virus
RNATASLI

SEQ ID NO: 299610 - protein, 8 aa, Influenza virus
ATASLIYD

SEQ ID NO: 299611 - protein, 8 aa, Influenza virus
TASFIYGG

SEQ ID NO: 299612 - protein, 8 aa, Influenza virus
LIDSIGSW

SEQ ID NO: 299613 - protein, 8 aa, Influenza virus
IDSIGSWS

SEQ ID NO: 299614 - protein, 8 aa, Influenza virus
VCINGSCA

SEQ ID NO: 299615 - protein, 8 aa, Influenza virus
CINGSCAV

SEQ ID NO: 299616 - protein, 8 aa, Influenza virus
INGSCAVV

SEQ ID NO: 299617 - protein, 8 aa, Influenza virus
NGSCAVVM

SEQ ID NO: 299618 - protein, 8 aa, Influenza virus
GTCAVVMT

SEQ ID NO: 299619 - protein, 8 aa, Influenza virus
TCAVVMTD

SEQ ID NO: 299620 - protein, 8 aa, Influenza virus
AVVMTDGS

SEQ ID NO: 299621 - protein, 8 aa, Influenza virus
TDGSASGR

SEQ ID NO: 299622 - protein, 8 aa, Influenza virus
DGSASGRA

SEQ ID NO: 299623 - protein, 8 aa, Influenza virus
GSASGKAE

SEQ ID NO: 299624 - protein, 8 aa, Influenza virus
SASGKAET

SEQ ID NO: 299625 - protein, 8 aa, Influenza virus
ASGRADTR

SEQ ID NO: 299626 - protein, 8 aa, Influenza virus
SGRADTRI

SEQ ID NO: 299627 - protein, 8 aa, Influenza virus
AETRILFV

SEQ ID NO: 299628 - protein, 8 aa, Influenza virus
ILFIREGK

SEQ ID NO: 299629 - protein, 8 aa, Influenza virus
LFVKEGKV

SEQ ID NO: 299630 - protein, 8 aa, Influenza virus
EGKIAHIS

SEQ ID NO: 299631 - protein, 8 aa, Influenza virus
GKIAHISP

SEQ ID NO: 299632 - protein, 8 aa, Influenza virus
KIAHISPL

SEQ ID NO: 299633 - protein, 8 aa, Influenza virus
IAHISPLS

SEQ ID NO: 299634 - protein, 8 aa, Influenza virus
AHISPLSG

SEQ ID NO: 299635 - protein, 8 aa, Influenza virus
SCYPRYPD

SEQ ID NO: 299636 - protein, 8 aa, Influenza virus
CYPRYPDV

SEQ ID NO: 299637 - protein, 8 aa, Influenza virus
YPRYPDVR

SEQ ID NO: 299638 - protein, 8 aa, Influenza virus
PRYPDVRC

SEQ ID NO: 299639 - protein, 8 aa, Influenza virus
RYPDVRCV

SEQ ID NO: 299640 - protein, 8 aa, Influenza virus
KGSNRPVV

SEQ ID NO: 299641 - protein, 8 aa, Influenza virus
GSNRPVVD

SEQ ID NO: 299642 - protein, 8 aa, Influenza virus
SNRPIIDI

SEQ ID NO: 299643 - protein, 8 aa, Influenza virus
NRPIIDIN

SEQ ID NO: 299644 - protein, 8 aa, Influenza virus
RPIIDINM

SEQ ID NO: 299645 - protein, 8 aa, Influenza virus
DYSINSSY

SEQ ID NO: 299646 - protein, 8 aa, Influenza virus
IDSSYLCS

SEQ ID NO: 299647 - protein, 8 aa, Influenza virus
DSGYVCSG

SEQ ID NO: 299648 - protein, 8 aa, Influenza virus
DTPRNDDS

SEQ ID NO: 299649 - protein, 8 aa, Influenza virus
TPRNDDSS

SEQ ID NO: 299650 - protein, 8 aa, Influenza virus
PRNDDSSS

SEQ ID NO: 299651 - protein, 8 aa, Influenza virus
RNDDSSSS

SEQ ID NO: 299652 - protein, 8 aa, Influenza virus
NDDSSSSS

SEQ ID NO: 299653 - protein, 8 aa, Influenza virus
DDSSSSSN

SEQ ID NO: 299654 - protein, 8 aa, Influenza virus
DSSSNSNC

SEQ ID NO: 299655 - protein, 8 aa, Influenza virus
SNSNCKDP

SEQ ID NO: 299656 - protein, 8 aa, Influenza virus
NSNCRDPN

SEQ ID NO: 299657 - protein, 8 aa, Influenza virus
SNCRDPND

SEQ ID NO: 299658 - protein, 8 aa, Influenza virus
NCRDPNDE

SEQ ID NO: 299659 - protein, 8 aa, Influenza virus
DPNNERGN

SEQ ID NO: 299660 - protein, 8 aa, Influenza virus
PNNERGNP

SEQ ID NO: 299661 - protein, 8 aa, Influenza virus
NNERGNPG

SEQ ID NO: 299662 - protein, 8 aa, Influenza virus
NERGNPGV

SEQ ID NO: 299663 - protein, 8 aa, Influenza virus
ERGSPGVK

SEQ ID NO: 299664 - protein, 8 aa, Influenza virus
RGSPGVKG

SEQ ID NO: 299665 - protein, 8 aa, Influenza virus
VKGWAFDY

SEQ ID NO: 299666 - protein, 8 aa, Influenza virus
KGWAFDYG

SEQ ID NO: 299667 - protein, 8 aa, Influenza virus
GWAFDYGN

SEQ ID NO: 299668 - protein, 8 aa, Influenza virus
WAFDYGND

SEQ ID NO: 299669 - protein, 8 aa, Influenza virus
YGNDVWMG

SEQ ID NO: 299670 - protein, 8 aa, Influenza virus
EDDVWMGR

SEQ ID NO: 299671 - protein, 8 aa, Influenza virus
WMGRTISM

SEQ ID NO: 299672 - protein, 8 aa, Influenza virus
MGRTISMD

SEQ ID NO: 299673 - protein, 8 aa, Influenza virus
GRTISMDS

SEQ ID NO: 299674 - protein, 8 aa, Influenza virus
RTISMDSR

SEQ ID NO: 299675 - protein, 8 aa, Influenza virus
TISMDSRS

SEQ ID NO: 299676 - protein, 8 aa, Influenza virus
ISMDSRSG

SEQ ID NO: 299677 - protein, 8 aa, Influenza virus
SMDSRSGY

SEQ ID NO: 299678 - protein, 8 aa, Influenza virus
MDSRSGYE

SEQ ID NO: 299679 - protein, 8 aa, Influenza virus
YETFRVID

SEQ ID NO: 299680 - protein, 8 aa, Influenza virus
ETFRVIDG

SEQ ID NO: 299681 - protein, 8 aa, Influenza virus
TFRVIDGW

SEQ ID NO: 299682 - protein, 8 aa, Influenza virus
FRVISGWT

SEQ ID NO: 299683 - protein, 8 aa, Influenza virus
VIGGWTIA

SEQ ID NO: 299684 - protein, 8 aa, Influenza virus
IGGWTIAN

SEQ ID NO: 299685 - protein, 8 aa, Influenza virus
GGWTIANS

SEQ ID NO: 299686 - protein, 8 aa, Influenza virus
GWTIANSK

SEQ ID NO: 299687 - protein, 8 aa, Influenza virus
WTIANSKS

SEQ ID NO: 299688 - protein, 8 aa, Influenza virus
TIANSKSQ

SEQ ID NO: 299689 - protein, 8 aa, Influenza virus
TANSKSQV

SEQ ID NO: 299690 - protein, 8 aa, Influenza virus
RQIIVDNN

SEQ ID NO: 299691 - protein, 8 aa, Influenza virus
QIIVDNNN

SEQ ID NO: 299692 - protein, 8 aa, Influenza virus
IIVDNNNW

SEQ ID NO: 299693 - protein, 8 aa, Influenza virus
IVDNSNWS

SEQ ID NO: 299694 - protein, 8 aa, Influenza virus
VDNSNWSG

SEQ ID NO: 299695 - protein, 8 aa, Influenza virus
DNSNWSGY

SEQ ID NO: 299696 - protein, 8 aa, Influenza virus
NSNWSGYS

SEQ ID NO: 299697 - protein, 8 aa, Influenza virus
SNWSGYSG

SEQ ID NO: 299698 - protein, 8 aa, Influenza virus
NWSGYSGV

SEQ ID NO: 299699 - protein, 8 aa, Influenza virus
GIFSVEGK

SEQ ID NO: 299700 - protein, 8 aa, Influenza virus
KRCINRCF

SEQ ID NO: 299701 - protein, 8 aa, Influenza virus
RCINRCFY

SEQ ID NO: 299702 - protein, 8 aa, Influenza virus
ELIRGMPQ

SEQ ID NO: 299703 - protein, 8 aa, Influenza virus
LIRGMPQE

SEQ ID NO: 299704 - protein, 8 aa, Influenza virus
IRGMPQET

SEQ ID NO: 299705 - protein, 8 aa, Influenza virus
PQENRVWW

SEQ ID NO: 299706 - protein, 8 aa, Influenza virus
QENRVWWT

SEQ ID NO: 299707 - protein, 8 aa, Influenza virus
ETTVWWTS

SEQ ID NO: 299708 - protein, 8 aa, Influenza virus
DRVWWTSN

SEQ ID NO: 299709 - protein, 8 aa, Influenza virus
WPDGANID

SEQ ID NO: 299710 - protein, 8 aa, Influenza virus
PDGANIDF

SEQ ID NO: 299711 - protein, 8 aa, Influenza virus
DGANIDFV

SEQ ID NO: 299712 - protein, 8 aa, Influenza virus
GANIDFVP

SEQ ID NO: 299713 - protein, 8 aa, Influenza virus
RGYKMNTR

SEQ ID NO: 299714 - protein, 8 aa, Influenza virus
GYKMNNQI

SEQ ID NO: 299715 - protein, 8 aa, Influenza virus
YKMNTRIL

SEQ ID NO: 299716 - protein, 8 aa, Influenza virus
KMNNQILI

SEQ ID NO: 299717 - protein, 8 aa, Influenza virus
CLGHHAVP

SEQ ID NO: 299718 - protein, 8 aa, Influenza virus
LGHHAVPN

SEQ ID NO: 299719 - protein, 8 aa, Influenza virus
GHHAVPNG

SEQ ID NO: 299720 - protein, 8 aa, Influenza virus
HHAVPNGT

SEQ ID NO: 299721 - protein, 8 aa, Influenza virus
HAVPNGTK

SEQ ID NO: 299722 - protein, 8 aa, Influenza virus
AVPNGTKV

SEQ ID NO: 299723 - protein, 8 aa, Influenza virus
NGTKVDTL

SEQ ID NO: 299724 - protein, 8 aa, Influenza virus
GTKVDTLT

SEQ ID NO: 299725 - protein, 8 aa, Influenza virus
TKVDTLTE

SEQ ID NO: 299726 - protein, 8 aa, Influenza virus
VDTLTEKG

SEQ ID NO: 299727 - protein, 8 aa, Influenza virus
NTLTEKGI

SEQ ID NO: 299728 - protein, 8 aa, Influenza virus
TLTEKGIE

SEQ ID NO: 299729 - protein, 8 aa, Influenza virus
LTEKGIEV

SEQ ID NO: 299730 - protein, 8 aa, Influenza virus
TEKGIEVV

SEQ ID NO: 299731 - protein, 8 aa, Influenza virus
EKGIEVVN

SEQ ID NO: 299732 - protein, 8 aa, Influenza virus
KGIEVVNA

SEQ ID NO: 299733 - protein, 8 aa, Influenza virus
GVEVVDAT

SEQ ID NO: 299734 - protein, 8 aa, Influenza virus
VEVVDATE

SEQ ID NO: 299735 - protein, 8 aa, Influenza virus
DATETVER

SEQ ID NO: 299736 - protein, 8 aa, Influenza virus
IDLGQCGL

SEQ ID NO: 299737 - protein, 8 aa, Influenza virus
DMGQCGLL

SEQ ID NO: 299738 - protein, 8 aa, Influenza virus
MGQCGLLG

SEQ ID NO: 299739 - protein, 8 aa, Influenza virus
GQCGLLGI

SEQ ID NO: 299740 - protein, 8 aa, Influenza virus
QCGLLGTV

SEQ ID NO: 299741 - protein, 8 aa, Influenza virus
CGLLGTVT

SEQ ID NO: 299742 - protein, 8 aa, Influenza virus
GLLGTVTG

SEQ ID NO: 299743 - protein, 8 aa, Influenza virus
LLGTVTGP

SEQ ID NO: 299744 - protein, 8 aa, Influenza virus
LGTVTGPP

SEQ ID NO: 299745 - protein, 8 aa, Influenza virus
GTVTGPPQ

SEQ ID NO: 299746 - protein, 8 aa, Influenza virus
TVTGPPQC

SEQ ID NO: 299747 - protein, 8 aa, Influenza virus
VTGPPQCD

SEQ ID NO: 299748 - protein, 8 aa, Influenza virus
IGPPQCDL

SEQ ID NO: 299749 - protein, 8 aa, Influenza virus
GPPQCDRF

SEQ ID NO: 299750 - protein, 8 aa, Influenza virus
PPQCDRFL

SEQ ID NO: 299751 - protein, 8 aa, Influenza virus
PQCDRFLE

SEQ ID NO: 299752 - protein, 8 aa, Influenza virus
QCDRFLEF

SEQ ID NO: 299753 - protein, 8 aa, Influenza virus
SDLIVERQ

SEQ ID NO: 299754 - protein, 8 aa, Influenza virus
DLIVERQE

SEQ ID NO: 299755 - protein, 8 aa, Influenza virus
LIVERQDG

SEQ ID NO: 299756 - protein, 8 aa, Influenza virus
GSDVCYPG

SEQ ID NO: 299757 - protein, 8 aa, Influenza virus
VCYPGKFA

SEQ ID NO: 299758 - protein, 8 aa, Influenza virus
CYPGKFAN

SEQ ID NO: 299759 - protein, 8 aa, Influenza virus
EALRQVLR

SEQ ID NO: 299760 - protein, 8 aa, Influenza virus
LRQILRRS

SEQ ID NO: 299761 - protein, 8 aa, Influenza virus
RQILRRSG

SEQ ID NO: 299762 - protein, 8 aa, Influenza virus
QILRRSGG

SEQ ID NO: 299763 - protein, 8 aa, Influenza virus
ILRRSGGI

SEQ ID NO: 299764 - protein, 8 aa, Influenza virus
KETIGFTY

SEQ ID NO: 299765 - protein, 8 aa, Influenza virus
GFTYSGMR

SEQ ID NO: 299766 - protein, 8 aa, Influenza virus
FTYSGMRT

SEQ ID NO: 299767 - protein, 8 aa, Influenza virus
GPSFYAEM

SEQ ID NO: 299768 - protein, 8 aa, Influenza virus
MKWLLSNN

SEQ ID NO: 299769 - protein, 8 aa, Influenza virus
KWLLSNND

SEQ ID NO: 299770 - protein, 8 aa, Influenza virus
WLLSNNDN

SEQ ID NO: 299771 - protein, 8 aa, Influenza virus
FPQMTQSY

SEQ ID NO: 299772 - protein, 8 aa, Influenza virus
PALIVWGI

SEQ ID NO: 299773 - protein, 8 aa, Influenza virus
ALIVWGIH

SEQ ID NO: 299774 - protein, 8 aa, Influenza virus
LIVWGIHH

SEQ ID NO: 299775 - protein, 8 aa, Influenza virus
IVWGIHHS

SEQ ID NO: 299776 - protein, 8 aa, Influenza virus
WGIHHSVS

SEQ ID NO: 299777 - protein, 8 aa, Influenza virus
EQAKLYGS

SEQ ID NO: 299778 - protein, 8 aa, Influenza virus
QAKLYGSG

SEQ ID NO: 299779 - protein, 8 aa, Influenza virus
KLYGSGAK

SEQ ID NO: 299780 - protein, 8 aa, Influenza virus
LYGSGSKL

SEQ ID NO: 299781 - protein, 8 aa, Influenza virus
YGSGSKLI

SEQ ID NO: 299782 - protein, 8 aa, Influenza virus
GSGSKLIT

SEQ ID NO: 299783 - protein, 8 aa, Influenza virus
SGSKLITV

SEQ ID NO: 299784 - protein, 8 aa, Influenza virus
KLVTVGSS

SEQ ID NO: 299785 - protein, 8 aa, Influenza virus
SSNYHQSF

SEQ ID NO: 299786 - protein, 8 aa, Influenza virus
SNYHQSFV

SEQ ID NO: 299787 - protein, 8 aa, Influenza virus
NYHQSFVP

SEQ ID NO: 299788 - protein, 8 aa, Influenza virus
YHQSFVPS

SEQ ID NO: 299789 - protein, 8 aa, Influenza virus
HQSFVPSP

SEQ ID NO: 299790 - protein, 8 aa, Influenza virus
SFVPSPGV

SEQ ID NO: 299791 - protein, 8 aa, Influenza virus
FVPSPGVR

SEQ ID NO: 299792 - protein, 8 aa, Influenza virus
QVNGQTGR

SEQ ID NO: 299793 - protein, 8 aa, Influenza virus
VNGQTGRI

SEQ ID NO: 299794 - protein, 8 aa, Influenza virus
NGQSGRIN

SEQ ID NO: 299795 - protein, 8 aa, Influenza virus
GQSGRINF

SEQ ID NO: 299796 - protein, 8 aa, Influenza virus
QTGRIDFH

SEQ ID NO: 299797 - protein, 8 aa, Influenza virus
TGRIDFHW

SEQ ID NO: 299798 - protein, 8 aa, Influenza virus
GRIDFHWM

SEQ ID NO: 299799 - protein, 8 aa, Influenza virus
FHWLILNP

SEQ ID NO: 299800 - protein, 8 aa, Influenza virus
HWLILNPN

SEQ ID NO: 299801 - protein, 8 aa, Influenza virus
WLILNPND

SEQ ID NO: 299802 - protein, 8 aa, Influenza virus
LILNPNDT

SEQ ID NO: 299803 - protein, 8 aa, Influenza virus
ILNPNDTV

SEQ ID NO: 299804 - protein, 8 aa, Influenza virus
LNPNDTIT

SEQ ID NO: 299805 - protein, 8 aa, Influenza virus
NPNDTVIF

SEQ ID NO: 299806 - protein, 8 aa, Influenza virus
NDTVIFSF

SEQ ID NO: 299807 - protein, 8 aa, Influenza virus
DTVIFSFN

SEQ ID NO: 299808 - protein, 8 aa, Influenza virus
TVIFSFNG

SEQ ID NO: 299809 - protein, 8 aa, Influenza virus
IFSFNGAF

SEQ ID NO: 299810 - protein, 8 aa, Influenza virus
FSFNGAFV

SEQ ID NO: 299811 - protein, 8 aa, Influenza virus
SFNGAFVA

SEQ ID NO: 299812 - protein, 8 aa, Influenza virus
AFVAPDRV

SEQ ID NO: 299813 - protein, 8 aa, Influenza virus
FIAPDRAT

SEQ ID NO: 299814 - protein, 8 aa, Influenza virus
IAPDRATF

SEQ ID NO: 299815 - protein, 8 aa, Influenza virus
APDRVSFL

SEQ ID NO: 299816 - protein, 8 aa, Influenza virus
CYHNGGTI

SEQ ID NO: 299817 - protein, 8 aa, Influenza virus
GGTITSPL

SEQ ID NO: 299818 - protein, 8 aa, Influenza virus
GTITSPLP

SEQ ID NO: 299819 - protein, 8 aa, Influenza virus
TITSPLPF

SEQ ID NO: 299820 - protein, 8 aa, Influenza virus
ITSPLPFQ

SEQ ID NO: 299821 - protein, 8 aa, Influenza virus
TSPLPFQN

SEQ ID NO: 299822 - protein, 8 aa, Influenza virus
SPLPFQNI

SEQ ID NO: 299823 - protein, 8 aa, Influenza virus
PLPFQNIN

SEQ ID NO: 299824 - protein, 8 aa, Influenza virus
LPFQNVNS

SEQ ID NO: 299825 - protein, 8 aa, Influenza virus
PFQNVNSR

SEQ ID NO: 299826 - protein, 8 aa, Influenza virus
FQNINSRT

SEQ ID NO: 299827 - protein, 8 aa, Influenza virus
VGRCPRYV

SEQ ID NO: 299828 - protein, 8 aa, Influenza virus
GRCPRYVK

SEQ ID NO: 299829 - protein, 8 aa, Influenza virus
RCPRYVKQ

SEQ ID NO: 299830 - protein, 8 aa, Influenza virus
LMLATGMK

SEQ ID NO: 299831 - protein, 8 aa, Influenza virus
MLATGMKN

SEQ ID NO: 299832 - protein, 8 aa, Influenza virus
GMKNVPET

SEQ ID NO: 299833 - protein, 8 aa, Influenza virus
MKNVPETP

SEQ ID NO: 299834 - protein, 8 aa, Influenza virus
KNVPETPK

SEQ ID NO: 299835 - protein, 8 aa, Influenza virus
SPLSRCRK

SEQ ID NO: 299836 - protein, 8 aa, Influenza virus
LSRCRKTR

SEQ ID NO: 299837 - protein, 8 aa, Influenza virus
SRCRKTRG

SEQ ID NO: 299838 - protein, 8 aa, Influenza virus
RCRKTRGL

SEQ ID NO: 299839 - protein, 8 aa, Influenza virus
CRKTRGLF

SEQ ID NO: 299840 - protein, 8 aa, Influenza virus
RKTRGLFG

SEQ ID NO: 299841 - protein, 8 aa, Influenza virus
KTRGLFGA

SEQ ID NO: 299842 - protein, 8 aa, Influenza virus
PRGLFGAI

SEQ ID NO: 299843 - protein, 8 aa, Influenza virus
NGWEGLIN

SEQ ID NO: 299844 - protein, 8 aa, Influenza virus
GWEGLING

SEQ ID NO: 299845 - protein, 8 aa, Influenza virus
WEGLINGW

SEQ ID NO: 299846 - protein, 8 aa, Influenza virus
EGLINGWY

SEQ ID NO: 299847 - protein, 8 aa, Influenza virus
GLINGWYG

SEQ ID NO: 299848 - protein, 8 aa, Influenza virus
LINGWYGF

SEQ ID NO: 299849 - protein, 8 aa, Influenza virus
INGWYGFR

SEQ ID NO: 299850 - protein, 8 aa, Influenza virus
DGWYGFKH

SEQ ID NO: 299851 - protein, 8 aa, Influenza virus
YKSTPSAI

SEQ ID NO: 299852 - protein, 8 aa, Influenza virus
KSTQSAVD

SEQ ID NO: 299853 - protein, 8 aa, Influenza virus
STQSAVDQ

SEQ ID NO: 299854 - protein, 8 aa, Influenza virus
TQSAVDQI

SEQ ID NO: 299855 - protein, 8 aa, Influenza virus
QSAVDQIT

SEQ ID NO: 299856 - protein, 8 aa, Influenza virus
SAVDQITG

SEQ ID NO: 299857 - protein, 8 aa, Influenza virus
AVDQITGK

SEQ ID NO: 299858 - protein, 8 aa, Influenza virus
VDQITGKL

SEQ ID NO: 299859 - protein, 8 aa, Influenza virus
GKLNRIIE

SEQ ID NO: 299860 - protein, 8 aa, Influenza virus
KLNRIIEK

SEQ ID NO: 299861 - protein, 8 aa, Influenza virus
LNRIIEKT

SEQ ID NO: 299862 - protein, 8 aa, Influenza virus
NRIIEKTN

SEQ ID NO: 299863 - protein, 8 aa, Influenza virus
RIIEKTNQ

SEQ ID NO: 299864 - protein, 8 aa, Influenza virus
IIEKTNQQ

SEQ ID NO: 299865 - protein, 8 aa, Influenza virus
IDRTNHQF

SEQ ID NO: 299866 - protein, 8 aa, Influenza virus
EKTNQQFK

SEQ ID NO: 299867 - protein, 8 aa, Influenza virus
KTNQQFKL

SEQ ID NO: 299868 - protein, 8 aa, Influenza virus
TNQQFKLI

SEQ ID NO: 299869 - protein, 8 aa, Influenza virus
NQQFKLID

SEQ ID NO: 299870 - protein, 8 aa, Influenza virus
QQFKLIDN

SEQ ID NO: 299871 - protein, 8 aa, Influenza virus
QFKLIDNE

SEQ ID NO: 299872 - protein, 8 aa, Influenza virus
FKLIDNEF

SEQ ID NO: 299873 - protein, 8 aa, Influenza virus
MIDNEFNE

SEQ ID NO: 299874 - protein, 8 aa, Influenza virus
IDNEFSEI

SEQ ID NO: 299875 - protein, 8 aa, Influenza virus
DNEFSEIE

SEQ ID NO: 299876 - protein, 8 aa, Influenza virus
FSEIEQQI

SEQ ID NO: 299877 - protein, 8 aa, Influenza virus
SEIEQQIG

SEQ ID NO: 299878 - protein, 8 aa, Influenza virus
VERQIGNV

SEQ ID NO: 299879 - protein, 8 aa, Influenza virus
ERQIGNVI

SEQ ID NO: 299880 - protein, 8 aa, Influenza virus
RQIGNVIN

SEQ ID NO: 299881 - protein, 8 aa, Influenza virus
INWTRDSV

SEQ ID NO: 299882 - protein, 8 aa, Influenza virus
NWTRDSVT

SEQ ID NO: 299883 - protein, 8 aa, Influenza virus
WTRDSVTE

SEQ ID NO: 299884 - protein, 8 aa, Influenza virus
TRDSITEV

SEQ ID NO: 299885 - protein, 8 aa, Influenza virus
RDSITEVW

SEQ ID NO: 299886 - protein, 8 aa, Influenza virus
DSITEVWS

SEQ ID NO: 299887 - protein, 8 aa, Influenza virus
SITEVWSY

SEQ ID NO: 299888 - protein, 8 aa, Influenza virus
ITEVWSYN

SEQ ID NO: 299889 - protein, 8 aa, Influenza virus
TELWSYNA

SEQ ID NO: 299890 - protein, 8 aa, Influenza virus
ELWSYNAE

SEQ ID NO: 299891 - protein, 8 aa, Influenza virus
LWSYNAEL

SEQ ID NO: 299892 - protein, 8 aa, Influenza virus
DQADSEMN

SEQ ID NO: 299893 - protein, 8 aa, Influenza virus
LANSEMNK

SEQ ID NO: 299894 - protein, 8 aa, Influenza virus
ADSEMNNL

SEQ ID NO: 299895 - protein, 8 aa, Influenza virus
DSEMSKLY

SEQ ID NO: 299896 - protein, 8 aa, Influenza virus
SEMDKLYT

SEQ ID NO: 299897 - protein, 8 aa, Influenza virus
EMSKLYER

SEQ ID NO: 299898 - protein, 8 aa, Influenza virus
MSKLYERV

SEQ ID NO: 299899 - protein, 8 aa, Influenza virus
KLYERVKR

SEQ ID NO: 299900 - protein, 8 aa, Influenza virus
LYERVKRQ

SEQ ID NO: 299901 - protein, 8 aa, Influenza virus
YERVKRQL

SEQ ID NO: 299902 - protein, 8 aa, Influenza virus
ERVKRQLR

SEQ ID NO: 299903 - protein, 8 aa, Influenza virus
RVKRQLRE

SEQ ID NO: 299904 - protein, 8 aa, Influenza virus
VKRQLREN

SEQ ID NO: 299905 - protein, 8 aa, Influenza virus
KRQLRENA

SEQ ID NO: 299906 - protein, 8 aa, Influenza virus
NCMASIRN

SEQ ID NO: 299907 - protein, 8 aa, Influenza virus
CMASIRNS

SEQ ID NO: 299908 - protein, 8 aa, Influenza virus
MASIRNST

SEQ ID NO: 299909 - protein, 8 aa, Influenza virus
ASIRNSTY

SEQ ID NO: 299910 - protein, 8 aa, Influenza virus
RNSTYDHS

SEQ ID NO: 299911 - protein, 8 aa, Influenza virus
TYDHSRYR

SEQ ID NO: 299912 - protein, 8 aa, Influenza virus
RYREEAMQ

SEQ ID NO: 299913 - protein, 8 aa, Influenza virus
YRAESLQN

SEQ ID NO: 299914 - protein, 8 aa, Influenza virus
RAESLQNR

SEQ ID NO: 299915 - protein, 8 aa, Influenza virus
AESLQNRI

SEQ ID NO: 299916 - protein, 8 aa, Influenza virus
ESLQNRIR

SEQ ID NO: 299917 - protein, 8 aa, Influenza virus
SLQNRIRI

SEQ ID NO: 299918 - protein, 8 aa, Influenza virus
QNRIRIDP

SEQ ID NO: 299919 - protein, 8 aa, Influenza virus
NRIRIDPV

SEQ ID NO: 299920 - protein, 8 aa, Influenza virus
RIRIDPVK

SEQ ID NO: 299921 - protein, 8 aa, Influenza virus
IRIDPVKL

SEQ ID NO: 299922 - protein, 8 aa, Influenza virus
DPVKLSGG

SEQ ID NO: 299923 - protein, 8 aa, Influenza virus
PVKLSNGY

SEQ ID NO: 299924 - protein, 8 aa, Influenza virus
VKLSNGYK

SEQ ID NO: 299925 - protein, 8 aa, Influenza virus
KLSGGYKD

SEQ ID NO: 299926 - protein, 8 aa, Influenza virus
SSGYKEVI

SEQ ID NO: 299927 - protein, 8 aa, Influenza virus
SGYKEVIL

SEQ ID NO: 299928 - protein, 8 aa, Influenza virus
GYKEVILW

SEQ ID NO: 299929 - protein, 8 aa, Influenza virus
YKEVILWF

SEQ ID NO: 299930 - protein, 8 aa, Influenza virus
KEVILWFS

SEQ ID NO: 299931 - protein, 8 aa, Influenza virus
EVILWFSF

SEQ ID NO: 299932 - protein, 8 aa, Influenza virus
FGASCFLF

SEQ ID NO: 299933 - protein, 8 aa, Influenza virus
GASCFLLI

SEQ ID NO: 299934 - protein, 8 aa, Influenza virus
ASCFLLIA

SEQ ID NO: 299935 - protein, 8 aa, Influenza virus
SCFLLIAI

SEQ ID NO: 299936 - protein, 8 aa, Influenza virus
FMCVKNGN

SEQ ID NO: 299937 - protein, 8 aa, Influenza virus
MCVKNGNM

SEQ ID NO: 299938 - protein, 8 aa, Influenza virus
CVKNGNHA

SEQ ID NO: 299939 - protein, 8 aa, Influenza virus
VKNGNHAV

SEQ ID NO: 299940 - protein, 8 aa, Influenza virus
GAVNTTLS

SEQ ID NO: 299941 - protein, 8 aa, Influenza virus
AVNTTLST

SEQ ID NO: 299942 - protein, 8 aa, Influenza virus
VNTILSTK

SEQ ID NO: 299943 - protein, 8 aa, Influenza virus
NTILSTKA

SEQ ID NO: 299944 - protein, 8 aa, Influenza virus
TILSTKAL

SEQ ID NO: 299945 - protein, 8 aa, Influenza virus
TLSTIALF

SEQ ID NO: 299946 - protein, 8 aa, Influenza virus
LSTIALFI

SEQ ID NO: 299947 - protein, 8 aa, Influenza virus
STIALFIG

SEQ ID NO: 299948 - protein, 8 aa, Influenza virus
TIALIIGV

SEQ ID NO: 299949 - protein, 8 aa, Influenza virus
IALIIGVG

SEQ ID NO: 299950 - protein, 8 aa, Influenza virus
ALIIGVGN

SEQ ID NO: 299951 - protein, 8 aa, Influenza virus
LIIGVGNL

SEQ ID NO: 299952 - protein, 8 aa, Influenza virus
IGIGNLVF

SEQ ID NO: 299953 - protein, 8 aa, Influenza virus
GIGNLVFN

SEQ ID NO: 299954 - protein, 8 aa, Influenza virus
IGNLVFNT

SEQ ID NO: 299955 - protein, 8 aa, Influenza virus
GNLAFNAV

SEQ ID NO: 299956 - protein, 8 aa, Influenza virus
NLAFNTVI

SEQ ID NO: 299957 - protein, 8 aa, Influenza virus
LAFNAVIH

SEQ ID NO: 299958 - protein, 8 aa, Influenza virus
IFNTVIHE

SEQ ID NO: 299959 - protein, 8 aa, Influenza virus
FNTVIHER

SEQ ID NO: 299960 - protein, 8 aa, Influenza virus
ITYNNTVV

SEQ ID NO: 299961 - protein, 8 aa, Influenza virus
TYNNTVVN

SEQ ID NO: 299962 - protein, 8 aa, Influenza virus
YNNTVVNN

SEQ ID NO: 299963 - protein, 8 aa, Influenza virus
NNTVVNNI

SEQ ID NO: 299964 - protein, 8 aa, Influenza virus
NTVVNNIT

SEQ ID NO: 299965 - protein, 8 aa, Influenza virus
TTINNITN

SEQ ID NO: 299966 - protein, 8 aa, Influenza virus
VINNMTTT

SEQ ID NO: 299967 - protein, 8 aa, Influenza virus
INNITNVV

SEQ ID NO: 299968 - protein, 8 aa, Influenza virus
NNITTTIT

SEQ ID NO: 299969 - protein, 8 aa, Influenza virus
NITTTIIA

SEQ ID NO: 299970 - protein, 8 aa, Influenza virus
FKPPLPLC

SEQ ID NO: 299971 - protein, 8 aa, Influenza virus
KPPLPLCP

SEQ ID NO: 299972 - protein, 8 aa, Influenza virus
PPLPLCPF

SEQ ID NO: 299973 - protein, 8 aa, Influenza virus
SLPLCPFQ

SEQ ID NO: 299974 - protein, 8 aa, Influenza virus
LPLCPFKG

SEQ ID NO: 299975 - protein, 8 aa, Influenza virus
PLCPFKGF

SEQ ID NO: 299976 - protein, 8 aa, Influenza virus
LCPFKGFF

SEQ ID NO: 299977 - protein, 8 aa, Influenza virus
CPFKGFFP

SEQ ID NO: 299978 - protein, 8 aa, Influenza virus
PFKGFFPF

SEQ ID NO: 299979 - protein, 8 aa, Influenza virus
FKGFFPFH

SEQ ID NO: 299980 - protein, 8 aa, Influenza virus
KGFFPFHK

SEQ ID NO: 299981 - protein, 8 aa, Influenza virus
HKDNALRL

SEQ ID NO: 299982 - protein, 8 aa, Influenza virus
KDNAIRPG

SEQ ID NO: 299983 - protein, 8 aa, Influenza virus
DNAIRPGE

SEQ ID NO: 299984 - protein, 8 aa, Influenza virus
NALRLAEN

SEQ ID NO: 299985 - protein, 8 aa, Influenza virus
AIRLGENR

SEQ ID NO: 299986 - protein, 8 aa, Influenza virus
GVIVTREP

SEQ ID NO: 299987 - protein, 8 aa, Influenza virus
VIVTREPC

SEQ ID NO: 299988 - protein, 8 aa, Influenza virus
IITREPYV

SEQ ID NO: 299989 - protein, 8 aa, Influenza virus
ITREPYVS

SEQ ID NO: 299990 - protein, 8 aa, Influenza virus
EPYISCDN

SEQ ID NO: 299991 - protein, 8 aa, Influenza virus
HCWSFALA

SEQ ID NO: 299992 - protein, 8 aa, Influenza virus
ALAQGVLL

SEQ ID NO: 299993 - protein, 8 aa, Influenza virus
LAQGVLLG

SEQ ID NO: 299994 - protein, 8 aa, Influenza virus
AQGVLLGT

SEQ ID NO: 299995 - protein, 8 aa, Influenza virus
QGALLGTN

SEQ ID NO: 299996 - protein, 8 aa, Influenza virus
GALVGTKH

SEQ ID NO: 299997 - protein, 8 aa, Influenza virus
ALLGTNHS

SEQ ID NO: 299998 - protein, 8 aa, Influenza virus
LLGTNHSN

SEQ ID NO: 299999 - protein, 8 aa, Influenza virus
VGTKHSNG

SEQ ID NO: 300000 - protein, 8 aa, Influenza virus
GTRHSNGT

SEQ ID NO: 300001 - protein, 8 aa, Influenza virus
HSNGTNKD

SEQ ID NO: 300002 - protein, 8 aa, Influenza virus
SNGTIEDR

SEQ ID NO: 300003 - protein, 8 aa, Influenza virus
KDRAPYRS

SEQ ID NO: 300004 - protein, 8 aa, Influenza virus
DKTPYRSL

SEQ ID NO: 300005 - protein, 8 aa, Influenza virus
KTPYRSLI

SEQ ID NO: 300006 - protein, 8 aa, Influenza virus
TSYRSLIR

SEQ ID NO: 300007 - protein, 8 aa, Influenza virus
SYRSLIRF

SEQ ID NO: 300008 - protein, 8 aa, Influenza virus
RSLIQFPI

SEQ ID NO: 300009 - protein, 8 aa, Influenza virus
SLIQFPMG

SEQ ID NO: 300010 - protein, 8 aa, Influenza virus
LIQFPIGT

SEQ ID NO: 300011 - protein, 8 aa, Influenza virus
IQFPIGTA

SEQ ID NO: 300012 - protein, 8 aa, Influenza virus
QFPMGTAP

SEQ ID NO: 300013 - protein, 8 aa, Influenza virus
FPMGTAPV

SEQ ID NO: 300014 - protein, 8 aa, Influenza virus
PMGTAPVL

SEQ ID NO: 300015 - protein, 8 aa, Influenza virus
MGTAPVLG

SEQ ID NO: 300016 - protein, 8 aa, Influenza virus
GTAPILGN

SEQ ID NO: 300017 - protein, 8 aa, Influenza virus
TAPILGNY

SEQ ID NO: 300018 - protein, 8 aa, Influenza virus
APILGNYK

SEQ ID NO: 300019 - protein, 8 aa, Influenza virus
PILGNYKE

SEQ ID NO: 300020 - protein, 8 aa, Influenza virus
ILGNYKEI

SEQ ID NO: 300021 - protein, 8 aa, Influenza virus
LGNYKEIR

SEQ ID NO: 300022 - protein, 8 aa, Influenza virus
GNYREICI

SEQ ID NO: 300023 - protein, 8 aa, Influenza virus
NYREICIA

SEQ ID NO: 300024 - protein, 8 aa, Influenza virus
YREICIAW

SEQ ID NO: 300025 - protein, 8 aa, Influenza virus
REICIAWS

SEQ ID NO: 300026 - protein, 8 aa, Influenza virus
EIRIAWSS

SEQ ID NO: 300027 - protein, 8 aa, Influenza virus
ICVAWSST

SEQ ID NO: 300028 - protein, 8 aa, Influenza virus
CVAWSSTS

SEQ ID NO: 300029 - protein, 8 aa, Influenza virus
VAWSSTSC

SEQ ID NO: 300030 - protein, 8 aa, Influenza virus
GKEWLHVC

SEQ ID NO: 300031 - protein, 8 aa, Influenza virus
KEWMHICM

SEQ ID NO: 300032 - protein, 8 aa, Influenza virus
EWMHICMT

SEQ ID NO: 300033 - protein, 8 aa, Influenza virus
WMHICMTG

SEQ ID NO: 300034 - protein, 8 aa, Influenza virus
HVCMAGND

SEQ ID NO: 300035 - protein, 8 aa, Influenza virus
GRMSDSIK

SEQ ID NO: 300036 - protein, 8 aa, Influenza virus
KMRDSIKS

SEQ ID NO: 300037 - protein, 8 aa, Influenza virus
VTDSIKSW

SEQ ID NO: 300038 - protein, 8 aa, Influenza virus
RDSIKSWR

SEQ ID NO: 300039 - protein, 8 aa, Influenza virus
QESECQCL

SEQ ID NO: 300040 - protein, 8 aa, Influenza virus
ESECQCIS

SEQ ID NO: 300041 - protein, 8 aa, Influenza virus
SECQCISG

SEQ ID NO: 300042 - protein, 8 aa, Influenza virus
GICVVAVT

SEQ ID NO: 300043 - protein, 8 aa, Influenza virus
ICVVAVTD

SEQ ID NO: 300044 - protein, 8 aa, Influenza virus
CIVAVTDG

SEQ ID NO: 300045 - protein, 8 aa, Influenza virus
IVAVTDGP

SEQ ID NO: 300046 - protein, 8 aa, Influenza virus
AVTDGPAD

SEQ ID NO: 300047 - protein, 8 aa, Influenza virus
GPADNKAD

SEQ ID NO: 300048 - protein, 8 aa, Influenza virus
PADNKADH

SEQ ID NO: 300049 - protein, 8 aa, Influenza virus
AANSAHHR

SEQ ID NO: 300050 - protein, 8 aa, Influenza virus
ANNADHRI

SEQ ID NO: 300051 - protein, 8 aa, Influenza virus
NNADHRIY

SEQ ID NO: 300052 - protein, 8 aa, Influenza virus
NADHRIYW

SEQ ID NO: 300053 - protein, 8 aa, Influenza virus
DHRIYWIK

SEQ ID NO: 300054 - protein, 8 aa, Influenza virus
HRIYWIRK

SEQ ID NO: 300055 - protein, 8 aa, Influenza virus
RIYWIRKG

SEQ ID NO: 300056 - protein, 8 aa, Influenza virus
IYWIRKGR

SEQ ID NO: 300057 - protein, 8 aa, Influenza virus
RIQHLEEC

SEQ ID NO: 300058 - protein, 8 aa, Influenza virus
IRHLEECS

SEQ ID NO: 300059 - protein, 8 aa, Influenza virus
RHLEECSC

SEQ ID NO: 300060 - protein, 8 aa, Influenza virus
SEECSCYV

SEQ ID NO: 300061 - protein, 8 aa, Influenza virus
ECSCYVDT

SEQ ID NO: 300062 - protein, 8 aa, Influenza virus
CSCYVDVD

SEQ ID NO: 300063 - protein, 8 aa, Influenza virus
SCYMDIDV

SEQ ID NO: 300064 - protein, 8 aa, Influenza virus
CYMDIDVY

SEQ ID NO: 300065 - protein, 8 aa, Influenza virus
YMDIDVYC

SEQ ID NO: 300066 - protein, 8 aa, Influenza virus
DIDVYCVC

SEQ ID NO: 300067 - protein, 8 aa, Influenza virus
IDVYCVCR

SEQ ID NO: 300068 - protein, 8 aa, Influenza virus
DVYCVCRD

SEQ ID NO: 300069 - protein, 8 aa, Influenza virus
VYCVCRDN

SEQ ID NO: 300070 - protein, 8 aa, Influenza virus
KGSNRPWV

SEQ ID NO: 300071 - protein, 8 aa, Influenza virus
GSNRPWVR

SEQ ID NO: 300072 - protein, 8 aa, Influenza virus
SNRPWVRI

SEQ ID NO: 300073 - protein, 8 aa, Influenza virus
NRPWMRIS

SEQ ID NO: 300074 - protein, 8 aa, Influenza virus
RPWMRISN

SEQ ID NO: 300075 - protein, 8 aa, Influenza virus
PWMRISNE

SEQ ID NO: 300076 - protein, 8 aa, Influenza virus
WMRISNET

SEQ ID NO: 300077 - protein, 8 aa, Influenza virus
MRISNETI

SEQ ID NO: 300078 - protein, 8 aa, Influenza virus
RINNETIV

SEQ ID NO: 300079 - protein, 8 aa, Influenza virus
MNNETILE

SEQ ID NO: 300080 - protein, 8 aa, Influenza virus
TIVETGYV

SEQ ID NO: 300081 - protein, 8 aa, Influenza virus
ILETRYVC

SEQ ID NO: 300082 - protein, 8 aa, Influenza virus
VETGYVCS

SEQ ID NO: 300083 - protein, 8 aa, Influenza virus
HSDTPRPV

SEQ ID NO: 300084 - protein, 8 aa, Influenza virus
SDTPRPTD

SEQ ID NO: 300085 - protein, 8 aa, Influenza virus
DTPRPTDP

SEQ ID NO: 300086 - protein, 8 aa, Influenza virus
TPRPVDPS

SEQ ID NO: 300087 - protein, 8 aa, Influenza virus
DPSTISCD

SEQ ID NO: 300088 - protein, 8 aa, Influenza virus
PSTISCDS

SEQ ID NO: 300089 - protein, 8 aa, Influenza virus
STISCDSP

SEQ ID NO: 300090 - protein, 8 aa, Influenza virus
TISCDSPS

SEQ ID NO: 300091 - protein, 8 aa, Influenza virus
ISCDSPSN

SEQ ID NO: 300092 - protein, 8 aa, Influenza virus
SCSSPSGI

SEQ ID NO: 300093 - protein, 8 aa, Influenza virus
CDSPSNVK

SEQ ID NO: 300094 - protein, 8 aa, Influenza virus
DSPSNVKG

SEQ ID NO: 300095 - protein, 8 aa, Influenza virus
SPSNINGE

SEQ ID NO: 300096 - protein, 8 aa, Influenza virus
NGEPGVKG

SEQ ID NO: 300097 - protein, 8 aa, Influenza virus
GEPGVKGF

SEQ ID NO: 300098 - protein, 8 aa, Influenza virus
EPGVKGFG

SEQ ID NO: 300099 - protein, 8 aa, Influenza virus
VKGFGFKK

SEQ ID NO: 300100 - protein, 8 aa, Influenza virus
KGFGFKKG

SEQ ID NO: 300101 - protein, 8 aa, Influenza virus
GSDVWLGR

SEQ ID NO: 300102 - protein, 8 aa, Influenza virus
SDVWLGRT

SEQ ID NO: 300103 - protein, 8 aa, Influenza virus
WLGRTVSI

SEQ ID NO: 300104 - protein, 8 aa, Influenza virus
LGRTVSIS

SEQ ID NO: 300105 - protein, 8 aa, Influenza virus
GRTVSING

SEQ ID NO: 300106 - protein, 8 aa, Influenza virus
RTVSISGR

SEQ ID NO: 300107 - protein, 8 aa, Influenza virus
TVSINGRS

SEQ ID NO: 300108 - protein, 8 aa, Influenza virus
NGRSGFEV

SEQ ID NO: 300109 - protein, 8 aa, Influenza virus
SRSGFEVI

SEQ ID NO: 300110 - protein, 8 aa, Influenza virus
RSGFEVIR

SEQ ID NO: 300111 - protein, 8 aa, Influenza virus
SGFEIIRV

SEQ ID NO: 300112 - protein, 8 aa, Influenza virus
IKVTDGWI

SEQ ID NO: 300113 - protein, 8 aa, Influenza virus
VTEGWIDS

SEQ ID NO: 300114 - protein, 8 aa, Influenza virus
TDGWINSP

SEQ ID NO: 300115 - protein, 8 aa, Influenza virus
DGWINSPN

SEQ ID NO: 300116 - protein, 8 aa, Influenza virus
GWIDSPNH

SEQ ID NO: 300117 - protein, 8 aa, Influenza virus
WINSPSQA

SEQ ID NO: 300118 - protein, 8 aa, Influenza virus
INSPSQAK

SEQ ID NO: 300119 - protein, 8 aa, Influenza virus
NSPSQAKS

SEQ ID NO: 300120 - protein, 8 aa, Influenza virus
VKSITQTL

SEQ ID NO: 300121 - protein, 8 aa, Influenza virus
KAATQTLV

SEQ ID NO: 300122 - protein, 8 aa, Influenza virus
SLTQTLVS

SEQ ID NO: 300123 - protein, 8 aa, Influenza virus
ATQTLVSN

SEQ ID NO: 300124 - protein, 8 aa, Influenza virus
GYSGSFTV

SEQ ID NO: 300125 - protein, 8 aa, Influenza virus
GGCFQPCF

SEQ ID NO: 300126 - protein, 8 aa, Influenza virus
SCFYVELI

SEQ ID NO: 300127 - protein, 8 aa, Influenza virus
YIELIRGK

SEQ ID NO: 300128 - protein, 8 aa, Influenza virus
IELIRGKP

SEQ ID NO: 300129 - protein, 8 aa, Influenza virus
ELIRGRLN

SEQ ID NO: 300130 - protein, 8 aa, Influenza virus
NDEVSWTS

SEQ ID NO: 300131 - protein, 8 aa, Influenza virus
DEVSWTSN

SEQ ID NO: 300132 - protein, 8 aa, Influenza virus
EVSWTSNS

SEQ ID NO: 300133 - protein, 8 aa, Influenza virus
DNEPGSGK

SEQ ID NO: 300134 - protein, 8 aa, Influenza virus
GNWPDGAN

SEQ ID NO: 300135 - protein, 8 aa, Influenza virus
NWPDGANI

SEQ ID NO: 300136 - protein, 8 aa, Influenza virus
RGYKMNIQ

SEQ ID NO: 300137 - protein, 8 aa, Influenza virus
GYKMNTKI

SEQ ID NO: 300138 - protein, 8 aa, Influenza virus
YKMNTKIL

SEQ ID NO: 300139 - protein, 8 aa, Influenza virus
KMNTQILI

SEQ ID NO: 300140 - protein, 8 aa, Influenza virus
KGDKICLG

SEQ ID NO: 300141 - protein, 8 aa, Influenza virus
ADKICLGR

SEQ ID NO: 300142 - protein, 8 aa, Influenza virus
ICLGHHAA

SEQ ID NO: 300143 - protein, 8 aa, Influenza virus
NGIKVDTL

SEQ ID NO: 300144 - protein, 8 aa, Influenza virus
GAKVNTLT

SEQ ID NO: 300145 - protein, 8 aa, Influenza virus
AKVNTLTE

SEQ ID NO: 300146 - protein, 8 aa, Influenza virus
KVNTLTEK

SEQ ID NO: 300147 - protein, 8 aa, Influenza virus
VNTLTEKG

SEQ ID NO: 300148 - protein, 8 aa, Influenza virus
NTLTERGI

SEQ ID NO: 300149 - protein, 8 aa, Influenza virus
TLTERGIE

SEQ ID NO: 300150 - protein, 8 aa, Influenza virus
LTERGIEV

SEQ ID NO: 300151 - protein, 8 aa, Influenza virus
TERGIEVV

SEQ ID NO: 300152 - protein, 8 aa, Influenza virus
ERGIEVVN

SEQ ID NO: 300153 - protein, 8 aa, Influenza virus
RGIEVVNA

SEQ ID NO: 300154 - protein, 8 aa, Influenza virus
EVEVVNAT

SEQ ID NO: 300155 - protein, 8 aa, Influenza virus
NATETVET

SEQ ID NO: 300156 - protein, 8 aa, Influenza virus
DLSQCGLL

SEQ ID NO: 300157 - protein, 8 aa, Influenza virus
LGRCGLLG

SEQ ID NO: 300158 - protein, 8 aa, Influenza virus
GQCGFLGT

SEQ ID NO: 300159 - protein, 8 aa, Influenza virus
LIGPPQCD

SEQ ID NO: 300160 - protein, 8 aa, Influenza virus
TGPPQCDL

SEQ ID NO: 300161 - protein, 8 aa, Influenza virus
NLIVERRE

SEQ ID NO: 300162 - protein, 8 aa, Influenza virus
LIIERRDG

SEQ ID NO: 300163 - protein, 8 aa, Influenza virus
DVCYPGKI

SEQ ID NO: 300164 - protein, 8 aa, Influenza virus
EESLRQIL

SEQ ID NO: 300165 - protein, 8 aa, Influenza virus
ESLRQILR

SEQ ID NO: 300166 - protein, 8 aa, Influenza virus
LRQILRGS

SEQ ID NO: 300167 - protein, 8 aa, Influenza virus
RQILRGSG

SEQ ID NO: 300168 - protein, 8 aa, Influenza virus
QILRGSGG

SEQ ID NO: 300169 - protein, 8 aa, Influenza virus
ILRGSGGI

SEQ ID NO: 300170 - protein, 8 aa, Influenza virus
TGFTYSGI

SEQ ID NO: 300171 - protein, 8 aa, Influenza virus
RFTYSGIR

SEQ ID NO: 300172 - protein, 8 aa, Influenza virus
TYSGIRTD

SEQ ID NO: 300173 - protein, 8 aa, Influenza virus
YSGIRTDG

SEQ ID NO: 300174 - protein, 8 aa, Influenza virus
RSGPSFYA

SEQ ID NO: 300175 - protein, 8 aa, Influenza virus
SESSFYAE

SEQ ID NO: 300176 - protein, 8 aa, Influenza virus
GPSFYAEM

SEQ ID NO: 300177 - protein, 8 aa, Influenza virus
PSFYAEMK

SEQ ID NO: 300178 - protein, 8 aa, Influenza virus
EMEWLLSN

SEQ ID NO: 300179 - protein, 8 aa, Influenza virus
FPQMTRSY

SEQ ID NO: 300180 - protein, 8 aa, Influenza virus
PQMTKSYR

SEQ ID NO: 300181 - protein, 8 aa, Influenza virus
QMTKSYRN

SEQ ID NO: 300182 - protein, 8 aa, Influenza virus
TKSYRNPR

SEQ ID NO: 300183 - protein, 8 aa, Influenza virus
PALIIWGV

SEQ ID NO: 300184 - protein, 8 aa, Influenza virus
ALIIWGVH

SEQ ID NO: 300185 - protein, 8 aa, Influenza virus
LIIWGVHH

SEQ ID NO: 300186 - protein, 8 aa, Influenza virus
WGIHHPGS

SEQ ID NO: 300187 - protein, 8 aa, Influenza virus
EQIKLYGS

SEQ ID NO: 300188 - protein, 8 aa, Influenza virus
QIKLYGSG

SEQ ID NO: 300189 - protein, 8 aa, Influenza virus
LYGSGDKL

SEQ ID NO: 300190 - protein, 8 aa, Influenza virus
ITVWSSKY

SEQ ID NO: 300191 - protein, 8 aa, Influenza virus
TVGSSKYQ

SEQ ID NO: 300192 - protein, 8 aa, Influenza virus
VWSSKYQQ

SEQ ID NO: 300193 - protein, 8 aa, Influenza virus
WSSKYQQS

SEQ ID NO: 300194 - protein, 8 aa, Influenza virus
SSKYQRSF

SEQ ID NO: 300195 - protein, 8 aa, Influenza virus
RPQMNGQS

SEQ ID NO: 300196 - protein, 8 aa, Influenza virus
PQMNGQSG

SEQ ID NO: 300197 - protein, 8 aa, Influenza virus
QMNGQSGR

SEQ ID NO: 300198 - protein, 8 aa, Influenza virus
MNGQSGRI

SEQ ID NO: 300199 - protein, 8 aa, Influenza virus
GRIDFHWM

SEQ ID NO: 300200 - protein, 8 aa, Influenza virus
NDTITFSF

SEQ ID NO: 300201 - protein, 8 aa, Influenza virus
DTITFSFN

SEQ ID NO: 300202 - protein, 8 aa, Influenza virus
TITFSFNG

SEQ ID NO: 300203 - protein, 8 aa, Influenza virus
ITFSFNGA

SEQ ID NO: 300204 - protein, 8 aa, Influenza virus
NFSFNGAF

SEQ ID NO: 300205 - protein, 8 aa, Influenza virus
FSFNGAFV

SEQ ID NO: 300206 - protein, 8 aa, Influenza virus
SFNGAFVA

SEQ ID NO: 300207 - protein, 8 aa, Influenza virus
NGAFIAPN

SEQ ID NO: 300208 - protein, 8 aa, Influenza virus
GAFIAPNR

SEQ ID NO: 300209 - protein, 8 aa, Influenza virus
AFIAPNRA

SEQ ID NO: 300210 - protein, 8 aa, Influenza virus
FIAPNRAS

SEQ ID NO: 300211 - protein, 8 aa, Influenza virus
IAPNRASF

SEQ ID NO: 300212 - protein, 8 aa, Influenza virus
CYHIGGTI

SEQ ID NO: 300213 - protein, 8 aa, Influenza virus
SNLPFQNV

SEQ ID NO: 300214 - protein, 8 aa, Influenza virus
NLPFQNVN

SEQ ID NO: 300215 - protein, 8 aa, Influenza virus
LPFQNVNS

SEQ ID NO: 300216 - protein, 8 aa, Influenza virus
PFQNVNSR

SEQ ID NO: 300217 - protein, 8 aa, Influenza virus
FQNINPRT

SEQ ID NO: 300218 - protein, 8 aa, Influenza virus
VGKCPKYV

SEQ ID NO: 300219 - protein, 8 aa, Influenza virus
GRCPRYVK

SEQ ID NO: 300220 - protein, 8 aa, Influenza virus
RCPRYVKQ

SEQ ID NO: 300221 - protein, 8 aa, Influenza virus
LLLATGMR

SEQ ID NO: 300222 - protein, 8 aa, Influenza virus
LLATGMRN

SEQ ID NO: 300223 - protein, 8 aa, Influenza virus
KKKKKKRG

SEQ ID NO: 300224 - protein, 8 aa, Influenza virus
KKRKKRGL

SEQ ID NO: 300225 - protein, 8 aa, Influenza virus
KKKKRGLF

SEQ ID NO: 300226 - protein, 8 aa, Influenza virus
KKRRKRGL

SEQ ID NO: 300227 - protein, 8 aa, Influenza virus
RKRGLFGA

SEQ ID NO: 300228 - protein, 8 aa, Influenza virus
LIDGWYGY

SEQ ID NO: 300229 - protein, 8 aa, Influenza virus
IDGWYGYR

SEQ ID NO: 300230 - protein, 8 aa, Influenza virus
DGWYGYKH

SEQ ID NO: 300231 - protein, 8 aa, Influenza virus
GWYGYKHQ

SEQ ID NO: 300232 - protein, 8 aa, Influenza virus
WYGYKHQN

SEQ ID NO: 300233 - protein, 8 aa, Influenza virus
YGFRHQNS

SEQ ID NO: 300234 - protein, 8 aa, Influenza virus
GYKHQNAQ

SEQ ID NO: 300235 - protein, 8 aa, Influenza virus
FRHQNSQG

SEQ ID NO: 300236 - protein, 8 aa, Influenza virus
RHQNSQGE

SEQ ID NO: 300237 - protein, 8 aa, Influenza virus
QNAQGEGI

SEQ ID NO: 300238 - protein, 8 aa, Influenza virus
NAQGEGIA

SEQ ID NO: 300239 - protein, 8 aa, Influenza virus
KSTQAAID

SEQ ID NO: 300240 - protein, 8 aa, Influenza virus
STQAAIDQ

SEQ ID NO: 300241 - protein, 8 aa, Influenza virus
TQAAIDQI

SEQ ID NO: 300242 - protein, 8 aa, Influenza virus
QSAVNQIT

SEQ ID NO: 300243 - protein, 8 aa, Influenza virus
AAIDQITG

SEQ ID NO: 300244 - protein, 8 aa, Influenza virus
AIDQITGT

SEQ ID NO: 300245 - protein, 8 aa, Influenza virus
IDQITGTL

SEQ ID NO: 300246 - protein, 8 aa, Influenza virus
DQITGTLN

SEQ ID NO: 300247 - protein, 8 aa, Influenza virus
GTLNRLID

SEQ ID NO: 300248 - protein, 8 aa, Influenza virus
KLNRLIER

SEQ ID NO: 300249 - protein, 8 aa, Influenza virus
LNRLIERT

SEQ ID NO: 300250 - protein, 8 aa, Influenza virus
NRLIERTN

SEQ ID NO: 300251 - protein, 8 aa, Influenza virus
RLIERTNQ

SEQ ID NO: 300252 - protein, 8 aa, Influenza virus
LIERTNQQ

SEQ ID NO: 300253 - protein, 8 aa, Influenza virus
IERTNQQF

SEQ ID NO: 300254 - protein, 8 aa, Influenza virus
ERTNQQFE

SEQ ID NO: 300255 - protein, 8 aa, Influenza virus
KTNQQFEM

SEQ ID NO: 300256 - protein, 8 aa, Influenza virus
QFELIDNK

SEQ ID NO: 300257 - protein, 8 aa, Influenza virus
FELIDNKF

SEQ ID NO: 300258 - protein, 8 aa, Influenza virus
ELIDNEFS

SEQ ID NO: 300259 - protein, 8 aa, Influenza virus
LIDNEFSE

SEQ ID NO: 300260 - protein, 8 aa, Influenza virus
IDNEFSEI

SEQ ID NO: 300261 - protein, 8 aa, Influenza virus
DNEFSEIE

SEQ ID NO: 300262 - protein, 8 aa, Influenza virus
EIEQQIGN

SEQ ID NO: 300263 - protein, 8 aa, Influenza virus
IEQQIGNV

SEQ ID NO: 300264 - protein, 8 aa, Influenza virus
ERQIGNVI

SEQ ID NO: 300265 - protein, 8 aa, Influenza virus
RQIGNVIN

SEQ ID NO: 300266 - protein, 8 aa, Influenza virus
INWTRDSL

SEQ ID NO: 300267 - protein, 8 aa, Influenza virus
NWTRDSII

SEQ ID NO: 300268 - protein, 8 aa, Influenza virus
WTRDSIIE

SEQ ID NO: 300269 - protein, 8 aa, Influenza virus
IEIWSYNA

SEQ ID NO: 300270 - protein, 8 aa, Influenza virus
EMWSYNAE

SEQ ID NO: 300271 - protein, 8 aa, Influenza virus
IWSYNAEF

SEQ ID NO: 300272 - protein, 8 aa, Influenza virus
WSYNADLL

SEQ ID NO: 300273 - protein, 8 aa, Influenza virus
SYNADLLV

SEQ ID NO: 300274 - protein, 8 aa, Influenza virus
YNADLLVA

SEQ ID NO: 300275 - protein, 8 aa, Influenza virus
NAELLIAM

SEQ ID NO: 300276 - protein, 8 aa, Influenza virus
AELLIAME

SEQ ID NO: 300277 - protein, 8 aa, Influenza virus
DLLVAMEN

SEQ ID NO: 300278 - protein, 8 aa, Influenza virus
LLIAMENQ

SEQ ID NO: 300279 - protein, 8 aa, Influenza virus
LIAMENQH

SEQ ID NO: 300280 - protein, 8 aa, Influenza virus
IAMENQHT

SEQ ID NO: 300281 - protein, 8 aa, Influenza virus
NQHIIDLA

SEQ ID NO: 300282 - protein, 8 aa, Influenza virus
QHTIDLTN

SEQ ID NO: 300283 - protein, 8 aa, Influenza virus
HTIDLAES

SEQ ID NO: 300284 - protein, 8 aa, Influenza virus
TIDLTNSE

SEQ ID NO: 300285 - protein, 8 aa, Influenza virus
IDLAESEM

SEQ ID NO: 300286 - protein, 8 aa, Influenza virus
DLTNSEMN

SEQ ID NO: 300287 - protein, 8 aa, Influenza virus
STDSEMNK

SEQ ID NO: 300288 - protein, 8 aa, Influenza virus
TNSEMNKL

SEQ ID NO: 300289 - protein, 8 aa, Influenza virus
NKLYEKVR

SEQ ID NO: 300290 - protein, 8 aa, Influenza virus
KLYEKVRR

SEQ ID NO: 300291 - protein, 8 aa, Influenza virus
LYEKVRRQ

SEQ ID NO: 300292 - protein, 8 aa, Influenza virus
YEKVRRQL

SEQ ID NO: 300293 - protein, 8 aa, Influenza virus
EKVRRQLR

SEQ ID NO: 300294 - protein, 8 aa, Influenza virus
KVRRQLRE

SEQ ID NO: 300295 - protein, 8 aa, Influenza virus
VRKQLREN

SEQ ID NO: 300296 - protein, 8 aa, Influenza virus
RKQLRENA

SEQ ID NO: 300297 - protein, 8 aa, Influenza virus
ENAEEDCT

SEQ ID NO: 300298 - protein, 8 aa, Influenza virus
NAEEDCTG

SEQ ID NO: 300299 - protein, 8 aa, Influenza virus
AEEDCTGC

SEQ ID NO: 300300 - protein, 8 aa, Influenza virus
EEDCTGCF

SEQ ID NO: 300301 - protein, 8 aa, Influenza virus
EDCTGCFE

SEQ ID NO: 300302 - protein, 8 aa, Influenza virus
DCTGCFEI

SEQ ID NO: 300303 - protein, 8 aa, Influenza virus
CTGCFEIF

SEQ ID NO: 300304 - protein, 8 aa, Influenza virus
TGCFELFH

SEQ ID NO: 300305 - protein, 8 aa, Influenza virus
GCFELFHK

SEQ ID NO: 300306 - protein, 8 aa, Influenza virus
IFHKCDDQ

SEQ ID NO: 300307 - protein, 8 aa, Influenza virus
FHKCDDQC

SEQ ID NO: 300308 - protein, 8 aa, Influenza virus
HKCDDQCM

SEQ ID NO: 300309 - protein, 8 aa, Influenza virus
CMANIRNN

SEQ ID NO: 300310 - protein, 8 aa, Influenza virus
MTSIRNNT

SEQ ID NO: 300311 - protein, 8 aa, Influenza virus
TSIRNNTY

SEQ ID NO: 300312 - protein, 8 aa, Influenza virus
RNNTYDHT

SEQ ID NO: 300313 - protein, 8 aa, Influenza virus
NNTYDHTQ

SEQ ID NO: 300314 - protein, 8 aa, Influenza virus
NTYDHTQY

SEQ ID NO: 300315 - protein, 8 aa, Influenza virus
TYDHTQYR

SEQ ID NO: 300316 - protein, 8 aa, Influenza virus
SLQNRIQI

SEQ ID NO: 300317 - protein, 8 aa, Influenza virus
QNRVKIDP

SEQ ID NO: 300318 - protein, 8 aa, Influenza virus
NRVKIDPV

SEQ ID NO: 300319 - protein, 8 aa, Influenza virus
IQINPVKL

SEQ ID NO: 300320 - protein, 8 aa, Influenza virus
QINPVKLS

SEQ ID NO: 300321 - protein, 8 aa, Influenza virus
INPVKLSS

SEQ ID NO: 300322 - protein, 8 aa, Influenza virus
NPVKLSSG

SEQ ID NO: 300323 - protein, 8 aa, Influenza virus
PVELSSGY

SEQ ID NO: 300324 - protein, 8 aa, Influenza virus
VELSSGYK

SEQ ID NO: 300325 - protein, 8 aa, Influenza virus
KLSGGYKD

SEQ ID NO: 300326 - protein, 8 aa, Influenza virus
LSSGYKEV

SEQ ID NO: 300327 - protein, 8 aa, Influenza virus
SSGYKEVI

SEQ ID NO: 300328 - protein, 8 aa, Influenza virus
GGYKDVIL

SEQ ID NO: 300329 - protein, 8 aa, Influenza virus
GYKEVILW

SEQ ID NO: 300330 - protein, 8 aa, Influenza virus
YKEVILWF

SEQ ID NO: 300331 - protein, 8 aa, Influenza virus
KEVILWFS

SEQ ID NO: 300332 - protein, 8 aa, Influenza virus
EVILWFSF

SEQ ID NO: 300333 - protein, 8 aa, Influenza virus
VILWFSLG

SEQ ID NO: 300334 - protein, 8 aa, Influenza virus
SFGASCFT

SEQ ID NO: 300335 - protein, 8 aa, Influenza virus
FGASCFLF

SEQ ID NO: 300336 - protein, 8 aa, Influenza virus
GASCFLFL

SEQ ID NO: 300337 - protein, 8 aa, Influenza virus
ASCFLFLA

SEQ ID NO: 300338 - protein, 8 aa, Influenza virus
SCFLFLAI

SEQ ID NO: 300339 - protein, 8 aa, Influenza virus
LAFICIKN

SEQ ID NO: 300340 - protein, 8 aa, Influenza virus
VFICIKNG

SEQ ID NO: 300341 - protein, 8 aa, Influenza virus
FICIKNGN

SEQ ID NO: 300342 - protein, 8 aa, Influenza virus
ICIKNGNM

SEQ ID NO: 300343 - protein, 8 aa, Influenza virus
CVKNGNMQ

SEQ ID NO: 300344 - protein, 8 aa, Influenza virus
VKNGNMQC

SEQ ID NO: 300345 - protein, 8 aa, Influenza virus
KNGNHAVH

SEQ ID NO: 300346 - protein, 8 aa, Influenza virus
NGNMRGTN

SEQ ID NO: 300347 - protein, 8 aa, Influenza virus
GNMRCTSC

SEQ ID NO: 300348 - protein, 8 aa, Influenza virus
NHAVHYCI

SEQ ID NO: 300349 - protein, 8 aa, Influenza virus
NPNQKLFT

SEQ ID NO: 300350 - protein, 8 aa, Influenza virus
PSQKLFAL

SEQ ID NO: 300351 - protein, 8 aa, Influenza virus
SQKLFALS

SEQ ID NO: 300352 - protein, 8 aa, Influenza virus
QKLFTLSG

SEQ ID NO: 300353 - protein, 8 aa, Influenza virus
KLFTLSGV

SEQ ID NO: 300354 - protein, 8 aa, Influenza virus
LFTLSGVA

SEQ ID NO: 300355 - protein, 8 aa, Influenza virus
FTLSGVAI

SEQ ID NO: 300356 - protein, 8 aa, Influenza virus
ASSGIAIA

SEQ ID NO: 300357 - protein, 8 aa, Influenza virus
SSGIAIAL

SEQ ID NO: 300358 - protein, 8 aa, Influenza virus
SGIAIALG

SEQ ID NO: 300359 - protein, 8 aa, Influenza virus
GIAIVLGI

SEQ ID NO: 300360 - protein, 8 aa, Influenza virus
IAIVLGII

SEQ ID NO: 300361 - protein, 8 aa, Influenza virus
AIVLGIIN

SEQ ID NO: 300362 - protein, 8 aa, Influenza virus
IVLGIINL

SEQ ID NO: 300363 - protein, 8 aa, Influenza virus
VLGIINLL

SEQ ID NO: 300364 - protein, 8 aa, Influenza virus
LGIINLLI

SEQ ID NO: 300365 - protein, 8 aa, Influenza virus
GIINLLIG

SEQ ID NO: 300366 - protein, 8 aa, Influenza virus
IINLLIGI

SEQ ID NO: 300367 - protein, 8 aa, Influenza virus
LNLLIGVS

SEQ ID NO: 300368 - protein, 8 aa, Influenza virus
LLIGVSNV

SEQ ID NO: 300369 - protein, 8 aa, Influenza virus
LIGVSNVG

SEQ ID NO: 300370 - protein, 8 aa, Influenza virus
IGVSNVGL

SEQ ID NO: 300371 - protein, 8 aa, Influenza virus
GVSNVGLN

SEQ ID NO: 300372 - protein, 8 aa, Influenza virus
SNVVLNVS

SEQ ID NO: 300373 - protein, 8 aa, Influenza virus
NVVLNVSL

SEQ ID NO: 300374 - protein, 8 aa, Influenza virus
VVLNVSLH

SEQ ID NO: 300375 - protein, 8 aa, Influenza virus
VLNVSLHL

SEQ ID NO: 300376 - protein, 8 aa, Influenza virus
LNMSLHLK

SEQ ID NO: 300377 - protein, 8 aa, Influenza virus
ENKYVNNT

SEQ ID NO: 300378 - protein, 8 aa, Influenza virus
NTYINNTT

SEQ ID NO: 300379 - protein, 8 aa, Influenza virus
TYINNATI

SEQ ID NO: 300380 - protein, 8 aa, Influenza virus
YINNATII

SEQ ID NO: 300381 - protein, 8 aa, Influenza virus
GYLLLNKS

SEQ ID NO: 300382 - protein, 8 aa, Influenza virus
LLNKSLCS

SEQ ID NO: 300383 - protein, 8 aa, Influenza virus
LNKSLCSV

SEQ ID NO: 300384 - protein, 8 aa, Influenza virus
NKSLCSVE

SEQ ID NO: 300385 - protein, 8 aa, Influenza virus
KSLCSVEG

SEQ ID NO: 300386 - protein, 8 aa, Influenza virus
SLCSVEGW

SEQ ID NO: 300387 - protein, 8 aa, Influenza virus
LCSVEGWV

SEQ ID NO: 300388 - protein, 8 aa, Influenza virus
CSVEGWVV

SEQ ID NO: 300389 - protein, 8 aa, Influenza virus
NVEGWVVV

SEQ ID NO: 300390 - protein, 8 aa, Influenza virus
IEGWVVVA

SEQ ID NO: 300391 - protein, 8 aa, Influenza virus
EGWVVIAQ

SEQ ID NO: 300392 - protein, 8 aa, Influenza virus
GWVVIEKD

SEQ ID NO: 300393 - protein, 8 aa, Influenza virus
WVVIAQDN

SEQ ID NO: 300394 - protein, 8 aa, Influenza virus
VVIAQDNA

SEQ ID NO: 300395 - protein, 8 aa, Influenza virus
VIAKDNAI

SEQ ID NO: 300396 - protein, 8 aa, Influenza virus
IAKDNAIR

SEQ ID NO: 300397 - protein, 8 aa, Influenza virus
AQDNAIRF

SEQ ID NO: 300398 - protein, 8 aa, Influenza virus
QDNAIRFG

SEQ ID NO: 300399 - protein, 8 aa, Influenza virus
FGESEQIV

SEQ ID NO: 300400 - protein, 8 aa, Influenza virus
GESEQIVV

SEQ ID NO: 300401 - protein, 8 aa, Influenza virus
ESEQIVVT

SEQ ID NO: 300402 - protein, 8 aa, Influenza virus
SEQIVVTR

SEQ ID NO: 300403 - protein, 8 aa, Influenza virus
EQIVVTRE

SEQ ID NO: 300404 - protein, 8 aa, Influenza virus
QIVVTREP

SEQ ID NO: 300405 - protein, 8 aa, Influenza virus
IVVTREPY

SEQ ID NO: 300406 - protein, 8 aa, Influenza virus
PYVSCDPS

SEQ ID NO: 300407 - protein, 8 aa, Influenza virus
GCRMYALH

SEQ ID NO: 300408 - protein, 8 aa, Influenza virus
NKHSNGTT

SEQ ID NO: 300409 - protein, 8 aa, Influenza virus
KHSNGTTH

SEQ ID NO: 300410 - protein, 8 aa, Influenza virus
HSNGTTHD

SEQ ID NO: 300411 - protein, 8 aa, Influenza virus
SNGTTHDR

SEQ ID NO: 300412 - protein, 8 aa, Influenza virus
NGTTHDRT

SEQ ID NO: 300413 - protein, 8 aa, Influenza virus
GTTHDRTA

SEQ ID NO: 300414 - protein, 8 aa, Influenza virus
TIHDRTTF

SEQ ID NO: 300415 - protein, 8 aa, Influenza virus
IHDRTTFR

SEQ ID NO: 300416 - protein, 8 aa, Influenza virus
HDRAAFRG

SEQ ID NO: 300417 - protein, 8 aa, Influenza virus
DRAAFRGL

SEQ ID NO: 300418 - protein, 8 aa, Influenza virus
RAAFRGLI

SEQ ID NO: 300419 - protein, 8 aa, Influenza virus
TTFRGLIS

SEQ ID NO: 300420 - protein, 8 aa, Influenza virus
TFRGLLST

SEQ ID NO: 300421 - protein, 8 aa, Influenza virus
FRGLISTQ

SEQ ID NO: 300422 - protein, 8 aa, Influenza virus
RGLISTQL

SEQ ID NO: 300423 - protein, 8 aa, Influenza virus
GLISTQLG

SEQ ID NO: 300424 - protein, 8 aa, Influenza virus
SNSDFLCV

SEQ ID NO: 300425 - protein, 8 aa, Influenza virus
NSDFLCVG

SEQ ID NO: 300426 - protein, 8 aa, Influenza virus
SDFLCVGW

SEQ ID NO: 300427 - protein, 8 aa, Influenza virus
DFLCVGWS

SEQ ID NO: 300428 - protein, 8 aa, Influenza virus
FLCVGWSS

SEQ ID NO: 300429 - protein, 8 aa, Influenza virus
LCVGWSST

SEQ ID NO: 300430 - protein, 8 aa, Influenza virus
STSCHDGV

SEQ ID NO: 300431 - protein, 8 aa, Influenza virus
CHDGIARM

SEQ ID NO: 300432 - protein, 8 aa, Influenza virus
HDGIARMT

SEQ ID NO: 300433 - protein, 8 aa, Influenza virus
DGIARMTI

SEQ ID NO: 300434 - protein, 8 aa, Influenza virus
GIARMTIC

SEQ ID NO: 300435 - protein, 8 aa, Influenza virus
ARMTICIQ

SEQ ID NO: 300436 - protein, 8 aa, Influenza virus
MTICVQGD

SEQ ID NO: 300437 - protein, 8 aa, Influenza virus
TICVQGDN

SEQ ID NO: 300438 - protein, 8 aa, Influenza virus
QGNNNNAT

SEQ ID NO: 300439 - protein, 8 aa, Influenza virus
GNNNNATA

SEQ ID NO: 300440 - protein, 8 aa, Influenza virus
NNNNATAT

SEQ ID NO: 300441 - protein, 8 aa, Influenza virus
NNNATATV

SEQ ID NO: 300442 - protein, 8 aa, Influenza virus
NNATATVY

SEQ ID NO: 300443 - protein, 8 aa, Influenza virus
TATVYYNK

SEQ ID NO: 300444 - protein, 8 aa, Influenza virus
ATVYYNKR

SEQ ID NO: 300445 - protein, 8 aa, Influenza virus
TVYYNKRL

SEQ ID NO: 300446 - protein, 8 aa, Influenza virus
VYYNKRLT

SEQ ID NO: 300447 - protein, 8 aa, Influenza virus
YYNKRLTT

SEQ ID NO: 300448 - protein, 8 aa, Influenza virus
YNKRLTTT

SEQ ID NO: 300449 - protein, 8 aa, Influenza virus
NKRLTTTI

SEQ ID NO: 300450 - protein, 8 aa, Influenza virus
GRLTTTIK

SEQ ID NO: 300451 - protein, 8 aa, Influenza virus
RLTTTVKT

SEQ ID NO: 300452 - protein, 8 aa, Influenza virus
LTTTVKTW

SEQ ID NO: 300453 - protein, 8 aa, Influenza virus
TTTIRTWA

SEQ ID NO: 300454 - protein, 8 aa, Influenza virus
TTIKTWAG

SEQ ID NO: 300455 - protein, 8 aa, Influenza virus
TIKTWAGN

SEQ ID NO: 300456 - protein, 8 aa, Influenza virus
IKTWAGNI

SEQ ID NO: 300457 - protein, 8 aa, Influenza virus
KTWAGNIL

SEQ ID NO: 300458 - protein, 8 aa, Influenza virus
TWAGNILR

SEQ ID NO: 300459 - protein, 8 aa, Influenza virus
WAGNILRT

SEQ ID NO: 300460 - protein, 8 aa, Influenza virus
AGNILRTQ

SEQ ID NO: 300461 - protein, 8 aa, Influenza virus
GNILRTQE

SEQ ID NO: 300462 - protein, 8 aa, Influenza virus
TQDSECVS

SEQ ID NO: 300463 - protein, 8 aa, Influenza virus
QDSECVSH

SEQ ID NO: 300464 - protein, 8 aa, Influenza virus
DSECVSHN

SEQ ID NO: 300465 - protein, 8 aa, Influenza virus
SECVRHNG

SEQ ID NO: 300466 - protein, 8 aa, Influenza virus
ECVRHNGT

SEQ ID NO: 300467 - protein, 8 aa, Influenza virus
CVSHNGTW

SEQ ID NO: 300468 - protein, 8 aa, Influenza virus
VCHNSTCV

SEQ ID NO: 300469 - protein, 8 aa, Influenza virus
CHNSTCVV

SEQ ID NO: 300470 - protein, 8 aa, Influenza virus
HNGTCVVI

SEQ ID NO: 300471 - protein, 8 aa, Influenza virus
NGTCVVIM

SEQ ID NO: 300472 - protein, 8 aa, Influenza virus
GTCVVIMT

SEQ ID NO: 300473 - protein, 8 aa, Influenza virus
TCVVIMTD

SEQ ID NO: 300474 - protein, 8 aa, Influenza virus
CVVIMTDG

SEQ ID NO: 300475 - protein, 8 aa, Influenza virus
VVIMTDGS

SEQ ID NO: 300476 - protein, 8 aa, Influenza virus
VIMTDGSA

SEQ ID NO: 300477 - protein, 8 aa, Influenza virus
IMTDGSAS

SEQ ID NO: 300478 - protein, 8 aa, Influenza virus
MTDGPASS

SEQ ID NO: 300479 - protein, 8 aa, Influenza virus
TDGPASSQ

SEQ ID NO: 300480 - protein, 8 aa, Influenza virus
DGPASSQA

SEQ ID NO: 300481 - protein, 8 aa, Influenza virus
ASSQAHTK

SEQ ID NO: 300482 - protein, 8 aa, Influenza virus
LRGSARHI

SEQ ID NO: 300483 - protein, 8 aa, Influenza virus
RGSARHIE

SEQ ID NO: 300484 - protein, 8 aa, Influenza virus
SARHIEEW

SEQ ID NO: 300485 - protein, 8 aa, Influenza virus
ARHIEEWS

SEQ ID NO: 300486 - protein, 8 aa, Influenza virus
RHIEEWSC

SEQ ID NO: 300487 - protein, 8 aa, Influenza virus
ECSCYGHD

SEQ ID NO: 300488 - protein, 8 aa, Influenza virus
ITCVCRDN

SEQ ID NO: 300489 - protein, 8 aa, Influenza virus
TCGCRDNW

SEQ ID NO: 300490 - protein, 8 aa, Influenza virus
PIIEIDMT

SEQ ID NO: 300491 - protein, 8 aa, Influenza virus
MEHTSQYL

SEQ ID NO: 300492 - protein, 8 aa, Influenza virus
EHTSQYLC

SEQ ID NO: 300493 - protein, 8 aa, Influenza virus
HTSRYICT

SEQ ID NO: 300494 - protein, 8 aa, Influenza virus
TSQYLCTG

SEQ ID NO: 300495 - protein, 8 aa, Influenza virus
YICTGVLT

SEQ ID NO: 300496 - protein, 8 aa, Influenza virus
ICTGVLTD

SEQ ID NO: 300497 - protein, 8 aa, Influenza virus
LTDTSRPK

SEQ ID NO: 300498 - protein, 8 aa, Influenza virus
TDTSRPKD

SEQ ID NO: 300499 - protein, 8 aa, Influenza virus
DTSRPKDK

SEQ ID NO: 300500 - protein, 8 aa, Influenza virus
GECFNPIT

SEQ ID NO: 300501 - protein, 8 aa, Influenza virus
ECFNPITG

SEQ ID NO: 300502 - protein, 8 aa, Influenza virus
CFNPITGS

SEQ ID NO: 300503 - protein, 8 aa, Influenza virus
FNPITGSP

SEQ ID NO: 300504 - protein, 8 aa, Influenza virus
PITGSPGS

SEQ ID NO: 300505 - protein, 8 aa, Influenza virus
ITGSPCAP

SEQ ID NO: 300506 - protein, 8 aa, Influenza virus
TGSPGSPG

SEQ ID NO: 300507 - protein, 8 aa, Influenza virus
VPGVKGFG

SEQ ID NO: 300508 - protein, 8 aa, Influenza virus
PGTKGFGF

SEQ ID NO: 300509 - protein, 8 aa, Influenza virus
GTKGFGFL

SEQ ID NO: 300510 - protein, 8 aa, Influenza virus
IKGFGFLN

SEQ ID NO: 300511 - protein, 8 aa, Influenza virus
KGFGFLNE

SEQ ID NO: 300512 - protein, 8 aa, Influenza virus
SNTWLGRT

SEQ ID NO: 300513 - protein, 8 aa, Influenza virus
GRTISPKL

SEQ ID NO: 300514 - protein, 8 aa, Influenza virus
RTISPKLR

SEQ ID NO: 300515 - protein, 8 aa, Influenza virus
TISPKLRS

SEQ ID NO: 300516 - protein, 8 aa, Influenza virus
ISPKLRSG

SEQ ID NO: 300517 - protein, 8 aa, Influenza virus
SPKLRSGF

SEQ ID NO: 300518 - protein, 8 aa, Influenza virus
PKLRSGFE

SEQ ID NO: 300519 - protein, 8 aa, Influenza virus
KLRSGFEM

SEQ ID NO: 300520 - protein, 8 aa, Influenza virus
SRNGFEML

SEQ ID NO: 300521 - protein, 8 aa, Influenza virus
RNGFEMLK

SEQ ID NO: 300522 - protein, 8 aa, Influenza virus
SGFEMLRI

SEQ ID NO: 300523 - protein, 8 aa, Influenza virus
GFEMLRIP

SEQ ID NO: 300524 - protein, 8 aa, Influenza virus
FEMLRIPN

SEQ ID NO: 300525 - protein, 8 aa, Influenza virus
EMLRIPNA

SEQ ID NO: 300526 - protein, 8 aa, Influenza virus
MLKIHNAG

SEQ ID NO: 300527 - protein, 8 aa, Influenza virus
LKIPNAGI

SEQ ID NO: 300528 - protein, 8 aa, Influenza virus
KIPNAGID

SEQ ID NO: 300529 - protein, 8 aa, Influenza virus
IPNAETDP

SEQ ID NO: 300530 - protein, 8 aa, Influenza virus
NAETDPNS

SEQ ID NO: 300531 - protein, 8 aa, Influenza virus
ERQEIVGN

SEQ ID NO: 300532 - protein, 8 aa, Influenza virus
RQEIVGND

SEQ ID NO: 300533 - protein, 8 aa, Influenza virus
QEIVGNDN

SEQ ID NO: 300534 - protein, 8 aa, Influenza virus
EIVGNDNW

SEQ ID NO: 300535 - protein, 8 aa, Influenza virus
IVGNDNWS

SEQ ID NO: 300536 - protein, 8 aa, Influenza virus
VGNDNWSG

SEQ ID NO: 300537 - protein, 8 aa, Influenza virus
GNDNWSGY

SEQ ID NO: 300538 - protein, 8 aa, Influenza virus
NKNWSGYS

SEQ ID NO: 300539 - protein, 8 aa, Influenza virus
KNWSGYSG

SEQ ID NO: 300540 - protein, 8 aa, Influenza virus
SFIDYWDD

SEQ ID NO: 300541 - protein, 8 aa, Influenza virus
EAKYVWWA

SEQ ID NO: 300542 - protein, 8 aa, Influenza virus
AKYVWWAS

SEQ ID NO: 300543 - protein, 8 aa, Influenza virus
KYVWWASN

SEQ ID NO: 300544 - protein, 8 aa, Influenza virus
YVWWASNS

SEQ ID NO: 300545 - protein, 8 aa, Influenza virus
VWWASNSL

SEQ ID NO: 300546 - protein, 8 aa, Influenza virus
EWTSNSLI

SEQ ID NO: 300547 - protein, 8 aa, Influenza virus
WASNSLIA

SEQ ID NO: 300548 - protein, 8 aa, Influenza virus
ASNSLIAL

SEQ ID NO: 300549 - protein, 8 aa, Influenza virus
PVGPGSFP

SEQ ID NO: 300550 - protein, 8 aa, Influenza virus
IGSGFFPD

SEQ ID NO: 300551 - protein, 8 aa, Influenza virus
GSGFFPDG

SEQ ID NO: 300552 - protein, 8 aa, Influenza virus
SGFFPDGP

SEQ ID NO: 300553 - protein, 8 aa, Influenza virus
FPDGPQIQ

SEQ ID NO: 300554 - protein, 8 aa, Influenza virus
PDGPQIQY

SEQ ID NO: 300555 - protein, 8 aa, Influenza virus
DGPQIQYF

SEQ ID NO: 300556 - protein, 8 aa, Influenza virus
GPQIQYFS

SEQ ID NO: 300557 - protein, 8 aa, Influenza virus
MLLMSTNA

SEQ ID NO: 300558 - protein, 8 aa, Influenza virus
ILVSTNAY

SEQ ID NO: 300559 - protein, 8 aa, Influenza virus
LMSTNAYD

SEQ ID NO: 300560 - protein, 8 aa, Influenza virus
MSTNAYDR

SEQ ID NO: 300561 - protein, 8 aa, Influenza virus
NNSTNTVN

SEQ ID NO: 300562 - protein, 8 aa, Influenza virus
NSTNTVNT

SEQ ID NO: 300563 - protein, 8 aa, Influenza virus
STNTVNTL

SEQ ID NO: 300564 - protein, 8 aa, Influenza virus
TDTVDTLI

SEQ ID NO: 300565 - protein, 8 aa, Influenza virus
DTVDTLIE

SEQ ID NO: 300566 - protein, 8 aa, Influenza virus
TVDTLIEQ

SEQ ID NO: 300567 - protein, 8 aa, Influenza virus
VNTLIEQK

SEQ ID NO: 300568 - protein, 8 aa, Influenza virus
TLTEQNVP

SEQ ID NO: 300569 - protein, 8 aa, Influenza virus
LTEQNVPV

SEQ ID NO: 300570 - protein, 8 aa, Influenza virus
IEQKVPVT

SEQ ID NO: 300571 - protein, 8 aa, Influenza virus
EQKVPVTQ

SEQ ID NO: 300572 - protein, 8 aa, Influenza virus
QKVPVTQT

SEQ ID NO: 300573 - protein, 8 aa, Influenza virus
NIPVTQTM

SEQ ID NO: 300574 - protein, 8 aa, Influenza virus
IPVTQTME

SEQ ID NO: 300575 - protein, 8 aa, Influenza virus
QAMELVEA

SEQ ID NO: 300576 - protein, 8 aa, Influenza virus
TMELVETK

SEQ ID NO: 300577 - protein, 8 aa, Influenza virus
MELVETKK

SEQ ID NO: 300578 - protein, 8 aa, Influenza virus
ELVETKKH

SEQ ID NO: 300579 - protein, 8 aa, Influenza virus
KKHPAYCN

SEQ ID NO: 300580 - protein, 8 aa, Influenza virus
KHLAYCNT

SEQ ID NO: 300581 - protein, 8 aa, Influenza virus
HLAYCNTD

SEQ ID NO: 300582 - protein, 8 aa, Influenza virus
LAYCNTDL

SEQ ID NO: 300583 - protein, 8 aa, Influenza virus
YCNTDLGS

SEQ ID NO: 300584 - protein, 8 aa, Influenza virus
CNTDLGSP

SEQ ID NO: 300585 - protein, 8 aa, Influenza virus
NTDLGSPL

SEQ ID NO: 300586 - protein, 8 aa, Influenza virus
TDLGSPLE

SEQ ID NO: 300587 - protein, 8 aa, Influenza virus
DLGSPLEL

SEQ ID NO: 300588 - protein, 8 aa, Influenza virus
LGSPLELR

SEQ ID NO: 300589 - protein, 8 aa, Influenza virus
GSPLELRD

SEQ ID NO: 300590 - protein, 8 aa, Influenza virus
SPLELRDC

SEQ ID NO: 300591 - protein, 8 aa, Influenza virus
YGNPKCDT

SEQ ID NO: 300592 - protein, 8 aa, Influenza virus
GNPKCDTH

SEQ ID NO: 300593 - protein, 8 aa, Influenza virus
NPKCDTHL

SEQ ID NO: 300594 - protein, 8 aa, Influenza virus
PKCDTHLK

SEQ ID NO: 300595 - protein, 8 aa, Influenza virus
KCDTHLKD

SEQ ID NO: 300596 - protein, 8 aa, Influenza virus
CDTHLKDQ

SEQ ID NO: 300597 - protein, 8 aa, Influenza virus
HLKDQSWS

SEQ ID NO: 300598 - protein, 8 aa, Influenza virus
LKDQDWSY

SEQ ID NO: 300599 - protein, 8 aa, Influenza virus
KDQDWSYI

SEQ ID NO: 300600 - protein, 8 aa, Influenza virus
DQDWSYIV

SEQ ID NO: 300601 - protein, 8 aa, Influenza virus
QDWSYIVE

SEQ ID NO: 300602 - protein, 8 aa, Influenza virus
DWSYIVER

SEQ ID NO: 300603 - protein, 8 aa, Influenza virus
GMCYPGFV

SEQ ID NO: 300604 - protein, 8 aa, Influenza virus
MCYPGFVE

SEQ ID NO: 300605 - protein, 8 aa, Influenza virus
CYPGFVEN

SEQ ID NO: 300606 - protein, 8 aa, Influenza virus
YPGFVENL

SEQ ID NO: 300607 - protein, 8 aa, Influenza virus
PGFVENLE

SEQ ID NO: 300608 - protein, 8 aa, Influenza virus
GFVENLEE

SEQ ID NO: 300609 - protein, 8 aa, Influenza virus
FVENLEEL

SEQ ID NO: 300610 - protein, 8 aa, Influenza virus
ELRFVFSI

SEQ ID NO: 300611 - protein, 8 aa, Influenza virus
LRFVFSIA

SEQ ID NO: 300612 - protein, 8 aa, Influenza virus
RFVFSIAA

SEQ ID NO: 300613 - protein, 8 aa, Influenza virus
FVFSIAAS

SEQ ID NO: 300614 - protein, 8 aa, Influenza virus
VFSIAASY

SEQ ID NO: 300615 - protein, 8 aa, Influenza virus
FSIAASYK

SEQ ID NO: 300616 - protein, 8 aa, Influenza virus
SIAASYKR

SEQ ID NO: 300617 - protein, 8 aa, Influenza virus
IAASYKRI

SEQ ID NO: 300618 - protein, 8 aa, Influenza virus
IRLFDYSG

SEQ ID NO: 300619 - protein, 8 aa, Influenza virus
RLFDYSGW

SEQ ID NO: 300620 - protein, 8 aa, Influenza virus
LFDYSGWN

SEQ ID NO: 300621 - protein, 8 aa, Influenza virus
FDYSGWNV

SEQ ID NO: 300622 - protein, 8 aa, Influenza virus
DYSKWNVS

SEQ ID NO: 300623 - protein, 8 aa, Influenza virus
WNVSSSGT

SEQ ID NO: 300624 - protein, 8 aa, Influenza virus
NVSSSGTS

SEQ ID NO: 300625 - protein, 8 aa, Influenza virus
VSSSGTSK

SEQ ID NO: 300626 - protein, 8 aa, Influenza virus
SSSGTSKA

SEQ ID NO: 300627 - protein, 8 aa, Influenza virus
TSKACNAL

SEQ ID NO: 300628 - protein, 8 aa, Influenza virus
SKACNALT

SEQ ID NO: 300629 - protein, 8 aa, Influenza virus
KACNALTG

SEQ ID NO: 300630 - protein, 8 aa, Influenza virus
ACNALTGG

SEQ ID NO: 300631 - protein, 8 aa, Influenza virus
CNALTGGQ

SEQ ID NO: 300632 - protein, 8 aa, Influenza virus
SASTGGQS

SEQ ID NO: 300633 - protein, 8 aa, Influenza virus
ALTGGQSF

SEQ ID NO: 300634 - protein, 8 aa, Influenza virus
LTGGQSFY

SEQ ID NO: 300635 - protein, 8 aa, Influenza virus
TGAQSFYR

SEQ ID NO: 300636 - protein, 8 aa, Influenza virus
GAQSFYRS

SEQ ID NO: 300637 - protein, 8 aa, Influenza virus
AQSFYRSI

SEQ ID NO: 300638 - protein, 8 aa, Influenza virus
NWLTKKEP

SEQ ID NO: 300639 - protein, 8 aa, Influenza virus
WLTKKEPD

SEQ ID NO: 300640 - protein, 8 aa, Influenza virus
LTKKKPDI

SEQ ID NO: 300641 - protein, 8 aa, Influenza virus
TKKEPDTY

SEQ ID NO: 300642 - protein, 8 aa, Influenza virus
KKKPDIYD

SEQ ID NO: 300643 - protein, 8 aa, Influenza virus
KKPDIYDF

SEQ ID NO: 300644 - protein, 8 aa, Influenza virus
KPDIYDFN

SEQ ID NO: 300645 - protein, 8 aa, Influenza virus
PDIYDFNE

SEQ ID NO: 300646 - protein, 8 aa, Influenza virus
DIYDFNEG

SEQ ID NO: 300647 - protein, 8 aa, Influenza virus
TYDFNEGA

SEQ ID NO: 300648 - protein, 8 aa, Influenza virus
YDFNEGAY

SEQ ID NO: 300649 - protein, 8 aa, Influenza virus
FNEGTYIN

SEQ ID NO: 300650 - protein, 8 aa, Influenza virus
NEGTYVNN

SEQ ID NO: 300651 - protein, 8 aa, Influenza virus
NNKDGDII

SEQ ID NO: 300652 - protein, 8 aa, Influenza virus
NKDGDIIF

SEQ ID NO: 300653 - protein, 8 aa, Influenza virus
KDGDIIFL

SEQ ID NO: 300654 - protein, 8 aa, Influenza virus
NGDIIFLW

SEQ ID NO: 300655 - protein, 8 aa, Influenza virus
GIHHPPNT

SEQ ID NO: 300656 - protein, 8 aa, Influenza virus
IHHPPNTK

SEQ ID NO: 300657 - protein, 8 aa, Influenza virus
HHPPNTKE

SEQ ID NO: 300658 - protein, 8 aa, Influenza virus
HPPNTKEQ

SEQ ID NO: 300659 - protein, 8 aa, Influenza virus
PPNTKEQT

SEQ ID NO: 300660 - protein, 8 aa, Influenza virus
AKEQTALY

SEQ ID NO: 300661 - protein, 8 aa, Influenza virus
TEQTKLYK

SEQ ID NO: 300662 - protein, 8 aa, Influenza virus
EQTKLYKN

SEQ ID NO: 300663 - protein, 8 aa, Influenza virus
QTKLYKNT

SEQ ID NO: 300664 - protein, 8 aa, Influenza virus
TKLYKNTN

SEQ ID NO: 300665 - protein, 8 aa, Influenza virus
KLYKNTNT

SEQ ID NO: 300666 - protein, 8 aa, Influenza virus
YKNANTLT

SEQ ID NO: 300667 - protein, 8 aa, Influenza virus
KNANTLTS

SEQ ID NO: 300668 - protein, 8 aa, Influenza virus
NANTLTSV

SEQ ID NO: 300669 - protein, 8 aa, Influenza virus
TNTLSSVT

SEQ ID NO: 300670 - protein, 8 aa, Influenza virus
NTLTSVTT

SEQ ID NO: 300671 - protein, 8 aa, Influenza virus
TLTSVTTN

SEQ ID NO: 300672 - protein, 8 aa, Influenza virus
LTSVTTNT

SEQ ID NO: 300673 - protein, 8 aa, Influenza virus
TSVTTNTI

SEQ ID NO: 300674 - protein, 8 aa, Influenza virus
NTNTINRS

SEQ ID NO: 300675 - protein, 8 aa, Influenza virus
TNTINRNF

SEQ ID NO: 300676 - protein, 8 aa, Influenza virus
NTINRIFQ

SEQ ID NO: 300677 - protein, 8 aa, Influenza virus
TINRIFQP

SEQ ID NO: 300678 - protein, 8 aa, Influenza virus
INRIFQPN

SEQ ID NO: 300679 - protein, 8 aa, Influenza virus
NRIFQPNI

SEQ ID NO: 300680 - protein, 8 aa, Influenza virus
RIFQPNIG

SEQ ID NO: 300681 - protein, 8 aa, Influenza virus
SFRPNIGP

SEQ ID NO: 300682 - protein, 8 aa, Influenza virus
QPNIGPRA

SEQ ID NO: 300683 - protein, 8 aa, Influenza virus
GPRPLVRE

SEQ ID NO: 300684 - protein, 8 aa, Influenza virus
PRPLVREQ

SEQ ID NO: 300685 - protein, 8 aa, Influenza virus
RPLVREQQ

SEQ ID NO: 300686 - protein, 8 aa, Influenza virus
PLVREQQG

SEQ ID NO: 300687 - protein, 8 aa, Influenza virus
LVRGQQGW

SEQ ID NO: 300688 - protein, 8 aa, Influenza virus
VRGQQGWM

SEQ ID NO: 300689 - protein, 8 aa, Influenza virus
RGQQGWMD

SEQ ID NO: 300690 - protein, 8 aa, Influenza virus
GQQGWMDY

SEQ ID NO: 300691 - protein, 8 aa, Influenza virus
QQGWMDYY

SEQ ID NO: 300692 - protein, 8 aa, Influenza virus
QGTMDYYW

SEQ ID NO: 300693 - protein, 8 aa, Influenza virus
GTMDYYWG

SEQ ID NO: 300694 - protein, 8 aa, Influenza virus
TMDYYWGI

SEQ ID NO: 300695 - protein, 8 aa, Influenza virus
YLLRGESH

SEQ ID NO: 300696 - protein, 8 aa, Influenza virus
LLRGESHG

SEQ ID NO: 300697 - protein, 8 aa, Influenza virus
LRGESHGR

SEQ ID NO: 300698 - protein, 8 aa, Influenza virus
GESHGKII

SEQ ID NO: 300699 - protein, 8 aa, Influenza virus
ESHGRTIQ

SEQ ID NO: 300700 - protein, 8 aa, Influenza virus
SHGRTIQN

SEQ ID NO: 300701 - protein, 8 aa, Influenza virus
HGKIIQNE

SEQ ID NO: 300702 - protein, 8 aa, Influenza virus
GKIIQNED

SEQ ID NO: 300703 - protein, 8 aa, Influenza virus
RTIQNEDI

SEQ ID NO: 300704 - protein, 8 aa, Influenza virus
NEDIPIEN

SEQ ID NO: 300705 - protein, 8 aa, Influenza virus
EDIPIENC

SEQ ID NO: 300706 - protein, 8 aa, Influenza virus
SCHTKCQT

SEQ ID NO: 300707 - protein, 8 aa, Influenza virus
CKTKCQTY

SEQ ID NO: 300708 - protein, 8 aa, Influenza virus
KTKCQTYA

SEQ ID NO: 300709 - protein, 8 aa, Influenza virus
CQTYAGAV

SEQ ID NO: 300710 - protein, 8 aa, Influenza virus
QTYAGAVN

SEQ ID NO: 300711 - protein, 8 aa, Influenza virus
TYAGAVNS

SEQ ID NO: 300712 - protein, 8 aa, Influenza virus
YAGAVNSS

SEQ ID NO: 300713 - protein, 8 aa, Influenza virus
TGAINSSK

SEQ ID NO: 300714 - protein, 8 aa, Influenza virus
GAVNSSKP

SEQ ID NO: 300715 - protein, 8 aa, Influenza virus
AVNSSKPF

SEQ ID NO: 300716 - protein, 8 aa, Influenza virus
INSSKPLQ

SEQ ID NO: 300717 - protein, 8 aa, Influenza virus
NSSKPLQN

SEQ ID NO: 300718 - protein, 8 aa, Influenza virus
SSKPFQNT

SEQ ID NO: 300719 - protein, 8 aa, Influenza virus
SKPFQNTS

SEQ ID NO: 300720 - protein, 8 aa, Influenza virus
KPFQNTSR

SEQ ID NO: 300721 - protein, 8 aa, Influenza virus
PLQNASRH

SEQ ID NO: 300722 - protein, 8 aa, Influenza virus
FQNASRYY

SEQ ID NO: 300723 - protein, 8 aa, Influenza virus
QNASRHHM

SEQ ID NO: 300724 - protein, 8 aa, Influenza virus
NASRYYMG

SEQ ID NO: 300725 - protein, 8 aa, Influenza virus
ASRYYMGE

SEQ ID NO: 300726 - protein, 8 aa, Influenza virus
SRHHMGEC

SEQ ID NO: 300727 - protein, 8 aa, Influenza virus
RHHMGECP

SEQ ID NO: 300728 - protein, 8 aa, Influenza virus
HYMGECPN

SEQ ID NO: 300729 - protein, 8 aa, Influenza virus
HMGECPKY

SEQ ID NO: 300730 - protein, 8 aa, Influenza virus
MGECPNYV

SEQ ID NO: 300731 - protein, 8 aa, Influenza virus
GECPNYVK

SEQ ID NO: 300732 - protein, 8 aa, Influenza virus
ECPNYVKK

SEQ ID NO: 300733 - protein, 8 aa, Influenza virus
YVRKASLR

SEQ ID NO: 300734 - protein, 8 aa, Influenza virus
VRKASLRL

SEQ ID NO: 300735 - protein, 8 aa, Influenza virus
RKASLRLA

SEQ ID NO: 300736 - protein, 8 aa, Influenza virus
KESLRLAL

SEQ ID NO: 300737 - protein, 8 aa, Influenza virus
ESLRLALG

SEQ ID NO: 300738 - protein, 8 aa, Influenza virus
SLRLAIGL

SEQ ID NO: 300739 - protein, 8 aa, Influenza virus
LRLAIGLR

SEQ ID NO: 300740 - protein, 8 aa, Influenza virus
RLAIGLRN

SEQ ID NO: 300741 - protein, 8 aa, Influenza virus
LAIGLRNT

SEQ ID NO: 300742 - protein, 8 aa, Influenza virus
AIGLRNTP

SEQ ID NO: 300743 - protein, 8 aa, Influenza virus
IGLRNTPS

SEQ ID NO: 300744 - protein, 8 aa, Influenza virus
LRNTPSID

SEQ ID NO: 300745 - protein, 8 aa, Influenza virus
RNTPSIDP

SEQ ID NO: 300746 - protein, 8 aa, Influenza virus
NTPSVEPR

SEQ ID NO: 300747 - protein, 8 aa, Influenza virus
TPSVEPKG

SEQ ID NO: 300748 - protein, 8 aa, Influenza virus
PSVEPKGL

SEQ ID NO: 300749 - protein, 8 aa, Influenza virus
SVEPRGLF

SEQ ID NO: 300750 - protein, 8 aa, Influenza virus
VEPRGLFG

SEQ ID NO: 300751 - protein, 8 aa, Influenza virus
DPKGLFGA

SEQ ID NO: 300752 - protein, 8 aa, Influenza virus
KSTQEAIG

SEQ ID NO: 300753 - protein, 8 aa, Influenza virus
STQEAIGK

SEQ ID NO: 300754 - protein, 8 aa, Influenza virus
TQEAIGKI

SEQ ID NO: 300755 - protein, 8 aa, Influenza virus
QEAIEKIT

SEQ ID NO: 300756 - protein, 8 aa, Influenza virus
EAINKITN

SEQ ID NO: 300757 - protein, 8 aa, Influenza virus
AINKITNK

SEQ ID NO: 300758 - protein, 8 aa, Influenza virus
INKITNKV

SEQ ID NO: 300759 - protein, 8 aa, Influenza virus
GKITNKVN

SEQ ID NO: 300760 - protein, 8 aa, Influenza virus
MNREFEVM

SEQ ID NO: 300761 - protein, 8 aa, Influenza virus
NREFEVMN

SEQ ID NO: 300762 - protein, 8 aa, Influenza virus
REFEVMNH

SEQ ID NO: 300763 - protein, 8 aa, Influenza virus
EFEVMNHE

SEQ ID NO: 300764 - protein, 8 aa, Influenza virus
FEVMNHEF

SEQ ID NO: 300765 - protein, 8 aa, Influenza virus
EVMNHEFS

SEQ ID NO: 300766 - protein, 8 aa, Influenza virus
VVDHEFSE

SEQ ID NO: 300767 - protein, 8 aa, Influenza virus
HEFSEIEK

SEQ ID NO: 300768 - protein, 8 aa, Influenza virus
EKRTNMIN

SEQ ID NO: 300769 - protein, 8 aa, Influenza virus
KRTNMIND

SEQ ID NO: 300770 - protein, 8 aa, Influenza virus
RTNMINDK

SEQ ID NO: 300771 - protein, 8 aa, Influenza virus
INMISDKI

SEQ ID NO: 300772 - protein, 8 aa, Influenza virus
NMISDKID

SEQ ID NO: 300773 - protein, 8 aa, Influenza virus
MISDKIDD

SEQ ID NO: 300774 - protein, 8 aa, Influenza virus
ISDKIDDQ

SEQ ID NO: 300775 - protein, 8 aa, Influenza virus
SDKIDDQI

SEQ ID NO: 300776 - protein, 8 aa, Influenza virus
KIDDQIEN

SEQ ID NO: 300777 - protein, 8 aa, Influenza virus
IDDQIENL

SEQ ID NO: 300778 - protein, 8 aa, Influenza virus
DDQIEGLW

SEQ ID NO: 300779 - protein, 8 aa, Influenza virus
DQIENLWA

SEQ ID NO: 300780 - protein, 8 aa, Influenza virus
QIEGLWAY

SEQ ID NO: 300781 - protein, 8 aa, Influenza virus
IEGLWAYN

SEQ ID NO: 300782 - protein, 8 aa, Influenza virus
ENLWAYNA

SEQ ID NO: 300783 - protein, 8 aa, Influenza virus
GLWAYNAE

SEQ ID NO: 300784 - protein, 8 aa, Influenza virus
ENQKTLDK

SEQ ID NO: 300785 - protein, 8 aa, Influenza virus
NQKTLDKH

SEQ ID NO: 300786 - protein, 8 aa, Influenza virus
QKILDEHD

SEQ ID NO: 300787 - protein, 8 aa, Influenza virus
KILDEHDS

SEQ ID NO: 300788 - protein, 8 aa, Influenza virus
ILDEHDSN

SEQ ID NO: 300789 - protein, 8 aa, Influenza virus
DEHDSNVE

SEQ ID NO: 300790 - protein, 8 aa, Influenza virus
KHDSNVKN

SEQ ID NO: 300791 - protein, 8 aa, Influenza virus
ENLFDEVR

SEQ ID NO: 300792 - protein, 8 aa, Influenza virus
EVRRRLSA

SEQ ID NO: 300793 - protein, 8 aa, Influenza virus
VRRRLSAN

SEQ ID NO: 300794 - protein, 8 aa, Influenza virus
RRRLSANA

SEQ ID NO: 300795 - protein, 8 aa, Influenza virus
RRLSTNAM

SEQ ID NO: 300796 - protein, 8 aa, Influenza virus
RLSTNAMD

SEQ ID NO: 300797 - protein, 8 aa, Influenza virus
NAMDAGNG

SEQ ID NO: 300798 - protein, 8 aa, Influenza virus
AMDAGNGC

SEQ ID NO: 300799 - protein, 8 aa, Influenza virus
MDAGNGCF

SEQ ID NO: 300800 - protein, 8 aa, Influenza virus
DTGKGCFD

SEQ ID NO: 300801 - protein, 8 aa, Influenza virus
TGKGCFDI

SEQ ID NO: 300802 - protein, 8 aa, Influenza virus
ILHKCDNK

SEQ ID NO: 300803 - protein, 8 aa, Influenza virus
LHKCDNKC

SEQ ID NO: 300804 - protein, 8 aa, Influenza virus
HKCDNKCM

SEQ ID NO: 300805 - protein, 8 aa, Influenza virus
KCDNKCME

SEQ ID NO: 300806 - protein, 8 aa, Influenza virus
CDNKCMET

SEQ ID NO: 300807 - protein, 8 aa, Influenza virus
DNKCMETI

SEQ ID NO: 300808 - protein, 8 aa, Influenza virus
IKNGTYNR

SEQ ID NO: 300809 - protein, 8 aa, Influenza virus
KNGTYNRK

SEQ ID NO: 300810 - protein, 8 aa, Influenza virus
NGTYNRKE

SEQ ID NO: 300811 - protein, 8 aa, Influenza virus
GTYNHKDY

SEQ ID NO: 300812 - protein, 8 aa, Influenza virus
TYNHKDYE

SEQ ID NO: 300813 - protein, 8 aa, Influenza virus
YDHKDYEE

SEQ ID NO: 300814 - protein, 8 aa, Influenza virus
NHKDYEEE

SEQ ID NO: 300815 - protein, 8 aa, Influenza virus
RKEYEEEA

SEQ ID NO: 300816 - protein, 8 aa, Influenza virus
LERSKINE

SEQ ID NO: 300817 - protein, 8 aa, Influenza virus
EKSRINGV

SEQ ID NO: 300818 - protein, 8 aa, Influenza virus
RSKINEVK

SEQ ID NO: 300819 - protein, 8 aa, Influenza virus
SKINGVRL

SEQ ID NO: 300820 - protein, 8 aa, Influenza virus
KINGVILE

SEQ ID NO: 300821 - protein, 8 aa, Influenza virus
INGVILEE

SEQ ID NO: 300822 - protein, 8 aa, Influenza virus
NEVKLEEN

SEQ ID NO: 300823 - protein, 8 aa, Influenza virus
GVRLEENT

SEQ ID NO: 300824 - protein, 8 aa, Influenza virus
VKLEENTS

SEQ ID NO: 300825 - protein, 8 aa, Influenza virus
KLEENTSY

SEQ ID NO: 300826 - protein, 8 aa, Influenza virus
LEENTSYK

SEQ ID NO: 300827 - protein, 8 aa, Influenza virus
EENTSYKI

SEQ ID NO: 300828 - protein, 8 aa, Influenza virus
ENTSYKIL

SEQ ID NO: 300829 - protein, 8 aa, Influenza virus
NTSYKILS

SEQ ID NO: 300830 - protein, 8 aa, Influenza virus
TSYKILSI

SEQ ID NO: 300831 - protein, 8 aa, Influenza virus
TYRILSIY

SEQ ID NO: 300832 - protein, 8 aa, Influenza virus
SLCLAILV

SEQ ID NO: 300833 - protein, 8 aa, Influenza virus
LCLAVLIA

SEQ ID NO: 300834 - protein, 8 aa, Influenza virus
CLAVLIAG

SEQ ID NO: 300835 - protein, 8 aa, Influenza virus
LAVLIAGG

SEQ ID NO: 300836 - protein, 8 aa, Influenza virus
AVLIAGGL

SEQ ID NO: 300837 - protein, 8 aa, Influenza virus
VLIAGGLI

SEQ ID NO: 300838 - protein, 8 aa, Influenza virus
GYLSTNST

SEQ ID NO: 300839 - protein, 8 aa, Influenza virus
YLSTNSTE

SEQ ID NO: 300840 - protein, 8 aa, Influenza virus
LSTNSTET

SEQ ID NO: 300841 - protein, 8 aa, Influenza virus
TNSTEAVD

SEQ ID NO: 300842 - protein, 8 aa, Influenza virus
NSTEAVDT

SEQ ID NO: 300843 - protein, 8 aa, Influenza virus
EHNGVLCA

SEQ ID NO: 300844 - protein, 8 aa, Influenza virus
HNGVLCAT

SEQ ID NO: 300845 - protein, 8 aa, Influenza virus
VEGLIYGN

SEQ ID NO: 300846 - protein, 8 aa, Influenza virus
GLVYGNPA

SEQ ID NO: 300847 - protein, 8 aa, Influenza virus
LVYGNPAC

SEQ ID NO: 300848 - protein, 8 aa, Influenza virus
VYGNPACD

SEQ ID NO: 300849 - protein, 8 aa, Influenza virus
DWSYIVER

SEQ ID NO: 300850 - protein, 8 aa, Influenza virus
SYIVERPT

SEQ ID NO: 300851 - protein, 8 aa, Influenza virus
YIVERPTA

SEQ ID NO: 300852 - protein, 8 aa, Influenza virus
TFYRNMRW

SEQ ID NO: 300853 - protein, 8 aa, Influenza virus
FYRGMRWL

SEQ ID NO: 300854 - protein, 8 aa, Influenza virus
YRGMRWLT

SEQ ID NO: 300855 - protein, 8 aa, Influenza virus
GRIDYYWA

SEQ ID NO: 300856 - protein, 8 aa, Influenza virus
SILKPGQT

SEQ ID NO: 300857 - protein, 8 aa, Influenza virus
VLRPGQTL

SEQ ID NO: 300858 - protein, 8 aa, Influenza virus
PGQTLRVK

SEQ ID NO: 300859 - protein, 8 aa, Influenza virus
GQTLRVKS

SEQ ID NO: 300860 - protein, 8 aa, Influenza virus
QTLRVRSD

SEQ ID NO: 300861 - protein, 8 aa, Influenza virus
TLRVRSDG

SEQ ID NO: 300862 - protein, 8 aa, Influenza virus
LRVRSDGN

SEQ ID NO: 300863 - protein, 8 aa, Influenza virus
RVRSDGNL

SEQ ID NO: 300864 - protein, 8 aa, Influenza virus
VRSDGNLI

SEQ ID NO: 300865 - protein, 8 aa, Influenza virus
KSNGNLIA

SEQ ID NO: 300866 - protein, 8 aa, Influenza virus
SNENLIAP

SEQ ID NO: 300867 - protein, 8 aa, Influenza virus
NGNLIAPL

SEQ ID NO: 300868 - protein, 8 aa, Influenza virus
GNLIAPLY

SEQ ID NO: 300869 - protein, 8 aa, Influenza virus
NLIAPLYG

SEQ ID NO: 300870 - protein, 8 aa, Influenza virus
LIAPWYGY

SEQ ID NO: 300871 - protein, 8 aa, Influenza virus
SGLNTTLP

SEQ ID NO: 300872 - protein, 8 aa, Influenza virus
GLNTILPF

SEQ ID NO: 300873 - protein, 8 aa, Influenza virus
LNSTLPFH

SEQ ID NO: 300874 - protein, 8 aa, Influenza virus
NSTLPFHN

SEQ ID NO: 300875 - protein, 8 aa, Influenza virus
TLPFHNIS

SEQ ID NO: 300876 - protein, 8 aa, Influenza virus
LPFHNISK

SEQ ID NO: 300877 - protein, 8 aa, Influenza virus
PFHNISKY

SEQ ID NO: 300878 - protein, 8 aa, Influenza virus
FHNISKYA

SEQ ID NO: 300879 - protein, 8 aa, Influenza virus
HNISKYAF

SEQ ID NO: 300880 - protein, 8 aa, Influenza virus
NVSRYAFG

SEQ ID NO: 300881 - protein, 8 aa, Influenza virus
ISKYAFGN

SEQ ID NO: 300882 - protein, 8 aa, Influenza virus
SKYAFGIC

SEQ ID NO: 300883 - protein, 8 aa, Influenza virus
KYAFGTCP

SEQ ID NO: 300884 - protein, 8 aa, Influenza virus
YAFGTCPK

SEQ ID NO: 300885 - protein, 8 aa, Influenza virus
AFGTCPKY

SEQ ID NO: 300886 - protein, 8 aa, Influenza virus
NSLKLAVG

SEQ ID NO: 300887 - protein, 8 aa, Influenza virus
SLKLAVGM

SEQ ID NO: 300888 - protein, 8 aa, Influenza virus
LKLAVGMR

SEQ ID NO: 300889 - protein, 8 aa, Influenza virus
KLAVGMRN

SEQ ID NO: 300890 - protein, 8 aa, Influenza virus
EGGWSGLI

SEQ ID NO: 300891 - protein, 8 aa, Influenza virus
GGWSGLIA

SEQ ID NO: 300892 - protein, 8 aa, Influenza virus
GWSGLIAG

SEQ ID NO: 300893 - protein, 8 aa, Influenza virus
WSGLIAGW

SEQ ID NO: 300894 - protein, 8 aa, Influenza virus
SGLIAGWY

SEQ ID NO: 300895 - protein, 8 aa, Influenza virus
YGFQHSNE

SEQ ID NO: 300896 - protein, 8 aa, Influenza virus
GFQHSNEQ

SEQ ID NO: 300897 - protein, 8 aa, Influenza virus
FQHSNEQG

SEQ ID NO: 300898 - protein, 8 aa, Influenza virus
QGVGIAAD

SEQ ID NO: 300899 - protein, 8 aa, Influenza virus
NKVDDQIQ

SEQ ID NO: 300900 - protein, 8 aa, Influenza virus
KIDDQIQN

SEQ ID NO: 300901 - protein, 8 aa, Influenza virus
DDQIQNIW

SEQ ID NO: 300902 - protein, 8 aa, Influenza virus
DQIQNIWA

SEQ ID NO: 300903 - protein, 8 aa, Influenza virus
QIQNIWAY

SEQ ID NO: 300904 - protein, 8 aa, Influenza virus
IQNIWAYN

SEQ ID NO: 300905 - protein, 8 aa, Influenza virus
QNIWAYNA

SEQ ID NO: 300906 - protein, 8 aa, Influenza virus
NIWAYNAE

SEQ ID NO: 300907 - protein, 8 aa, Influenza virus
LWAYNAEL

SEQ ID NO: 300908 - protein, 8 aa, Influenza virus
LLVLIENQ

SEQ ID NO: 300909 - protein, 8 aa, Influenza virus
LVLIENQK

SEQ ID NO: 300910 - protein, 8 aa, Influenza virus
VLIENQKT

SEQ ID NO: 300911 - protein, 8 aa, Influenza virus
LIENQKTL

SEQ ID NO: 300912 - protein, 8 aa, Influenza virus
IENQKTLD

SEQ ID NO: 300913 - protein, 8 aa, Influenza virus
QKILDEHD

SEQ ID NO: 300914 - protein, 8 aa, Influenza virus
KTLDEHVA

SEQ ID NO: 300915 - protein, 8 aa, Influenza virus
TLDEHDTN

SEQ ID NO: 300916 - protein, 8 aa, Influenza virus
LDEHDANA

SEQ ID NO: 300917 - protein, 8 aa, Influenza virus
DEHEANVN

SEQ ID NO: 300918 - protein, 8 aa, Influenza virus
NNLYKKVK

SEQ ID NO: 300919 - protein, 8 aa, Influenza virus
EDGKGCFD

SEQ ID NO: 300920 - protein, 8 aa, Influenza virus
DGKGCFDL

SEQ ID NO: 300921 - protein, 8 aa, Influenza virus
GKGCFDLY

SEQ ID NO: 300922 - protein, 8 aa, Influenza virus
KGCFDLYH

SEQ ID NO: 300923 - protein, 8 aa, Influenza virus
GCFELYHR

SEQ ID NO: 300924 - protein, 8 aa, Influenza virus
CFELYHRC

SEQ ID NO: 300925 - protein, 8 aa, Influenza virus
FELYHRCD

SEQ ID NO: 300926 - protein, 8 aa, Influenza virus
DLYHKCDN

SEQ ID NO: 300927 - protein, 8 aa, Influenza virus
CMGTIRNG

SEQ ID NO: 300928 - protein, 8 aa, Influenza virus
MGTIRNGT

SEQ ID NO: 300929 - protein, 8 aa, Influenza virus
GTIRNGTY

SEQ ID NO: 300930 - protein, 8 aa, Influenza virus
TIRNGTYS

SEQ ID NO: 300931 - protein, 8 aa, Influenza virus
EETYKILT

SEQ ID NO: 300932 - protein, 8 aa, Influenza virus
ETYKILTI

SEQ ID NO: 300933 - protein, 8 aa, Influenza virus
AYKILTIY

SEQ ID NO: 300934 - protein, 8 aa, Influenza virus
YSTVASSI

SEQ ID NO: 300935 - protein, 8 aa, Influenza virus
STVASSIV

SEQ ID NO: 300936 - protein, 8 aa, Influenza virus
AAFLFWVM

SEQ ID NO: 300937 - protein, 8 aa, Influenza virus
AFLFWTMS

SEQ ID NO: 300938 - protein, 8 aa, Influenza virus
GYLSTNST

SEQ ID NO: 300939 - protein, 8 aa, Influenza virus
YLSTNSTE

SEQ ID NO: 300940 - protein, 8 aa, Influenza virus
LSTNSTET

SEQ ID NO: 300941 - protein, 8 aa, Influenza virus
TNSTEAVD

SEQ ID NO: 300942 - protein, 8 aa, Influenza virus
NSTEAVDT

SEQ ID NO: 300943 - protein, 8 aa, Influenza virus
ELLNTEHN

SEQ ID NO: 300944 - protein, 8 aa, Influenza virus
EHNGVLCA

SEQ ID NO: 300945 - protein, 8 aa, Influenza virus
HNGVLCAT

SEQ ID NO: 300946 - protein, 8 aa, Influenza virus
VEGLIYGN

SEQ ID NO: 300947 - protein, 8 aa, Influenza virus
GLVYGNPA

SEQ ID NO: 300948 - protein, 8 aa, Influenza virus
LVYGNPAC

SEQ ID NO: 300949 - protein, 8 aa, Influenza virus
VYGNPACD

SEQ ID NO: 300950 - protein, 8 aa, Influenza virus
DWSYIVER

SEQ ID NO: 300951 - protein, 8 aa, Influenza virus
SYIVERPT

SEQ ID NO: 300952 - protein, 8 aa, Influenza virus
YIVERPTA

SEQ ID NO: 300953 - protein, 8 aa, Influenza virus
TFYRNMRW

SEQ ID NO: 300954 - protein, 8 aa, Influenza virus
FYRGMRWL

SEQ ID NO: 300955 - protein, 8 aa, Influenza virus
YRGMRWLT

SEQ ID NO: 300956 - protein, 8 aa, Influenza virus
GRIDYYWA

SEQ ID NO: 300957 - protein, 8 aa, Influenza virus
YYWAVLKP

SEQ ID NO: 300958 - protein, 8 aa, Influenza virus
SILKPGQT

SEQ ID NO: 300959 - protein, 8 aa, Influenza virus
VLRPGQTL

SEQ ID NO: 300960 - protein, 8 aa, Influenza virus
PGQTLRVK

SEQ ID NO: 300961 - protein, 8 aa, Influenza virus
GQTLRVKS

SEQ ID NO: 300962 - protein, 8 aa, Influenza virus
QTLRVRSD

SEQ ID NO: 300963 - protein, 8 aa, Influenza virus
TLRVRSDG

SEQ ID NO: 300964 - protein, 8 aa, Influenza virus
LRVRSDGN

SEQ ID NO: 300965 - protein, 8 aa, Influenza virus
RVRSDGNL

SEQ ID NO: 300966 - protein, 8 aa, Influenza virus
VRSDGNLI

SEQ ID NO: 300967 - protein, 8 aa, Influenza virus
KSNGNLIA

SEQ ID NO: 300968 - protein, 8 aa, Influenza virus
SNENLIAP

SEQ ID NO: 300969 - protein, 8 aa, Influenza virus
NGNLIAPL

SEQ ID NO: 300970 - protein, 8 aa, Influenza virus
GNLIAPLY

SEQ ID NO: 300971 - protein, 8 aa, Influenza virus
NLIAPLYG

SEQ ID NO: 300972 - protein, 8 aa, Influenza virus
LIAPLYGH

SEQ ID NO: 300973 - protein, 8 aa, Influenza virus
SGLNTTLP

SEQ ID NO: 300974 - protein, 8 aa, Influenza virus
GLNTILPF

SEQ ID NO: 300975 - protein, 8 aa, Influenza virus
LNSTLPFH

SEQ ID NO: 300976 - protein, 8 aa, Influenza virus
NSTLPFHN

SEQ ID NO: 300977 - protein, 8 aa, Influenza virus
TLPFHNIS

SEQ ID NO: 300978 - protein, 8 aa, Influenza virus
LPFHNISK

SEQ ID NO: 300979 - protein, 8 aa, Influenza virus
PFHNISKY

SEQ ID NO: 300980 - protein, 8 aa, Influenza virus
FHNISKYA

SEQ ID NO: 300981 - protein, 8 aa, Influenza virus
HNISKYAF

SEQ ID NO: 300982 - protein, 8 aa, Influenza virus
NVSRYAFG

SEQ ID NO: 300983 - protein, 8 aa, Influenza virus
ISKYAFGN

SEQ ID NO: 300984 - protein, 8 aa, Influenza virus
SKYAFGIC

SEQ ID NO: 300985 - protein, 8 aa, Influenza virus
KYAFGTCP

SEQ ID NO: 300986 - protein, 8 aa, Influenza virus
YAFGTCPK

SEQ ID NO: 300987 - protein, 8 aa, Influenza virus
AFGTCPKY

SEQ ID NO: 300988 - protein, 8 aa, Influenza virus
NSLKLAVG

SEQ ID NO: 300989 - protein, 8 aa, Influenza virus
SLKLAVGM

SEQ ID NO: 300990 - protein, 8 aa, Influenza virus
LKLAVGMR

SEQ ID NO: 300991 - protein, 8 aa, Influenza virus
KLAVGMRN

SEQ ID NO: 300992 - protein, 8 aa, Influenza virus
LAVGMRNV

SEQ ID NO: 300993 - protein, 8 aa, Influenza virus
EGGWSGLI

SEQ ID NO: 300994 - protein, 8 aa, Influenza virus
GGWSGLIA

SEQ ID NO: 300995 - protein, 8 aa, Influenza virus
GWSGLIAG

SEQ ID NO: 300996 - protein, 8 aa, Influenza virus
WSGLIAGW

SEQ ID NO: 300997 - protein, 8 aa, Influenza virus
SGLIAGWY

SEQ ID NO: 300998 - protein, 8 aa, Influenza virus
YGFQHSNE

SEQ ID NO: 300999 - protein, 8 aa, Influenza virus
GFQHSNEQ

SEQ ID NO: 301000 - protein, 8 aa, Influenza virus
FQHSNEQG

SEQ ID NO: 301001 - protein, 8 aa, Influenza virus
QGVGIAAD

SEQ ID NO: 301002 - protein, 8 aa, Influenza virus
KVNSIVDK

SEQ ID NO: 301003 - protein, 8 aa, Influenza virus
NKVDDQIQ

SEQ ID NO: 301004 - protein, 8 aa, Influenza virus
KIDDQIQN

SEQ ID NO: 301005 - protein, 8 aa, Influenza virus
DDQIQNIW

SEQ ID NO: 301006 - protein, 8 aa, Influenza virus
DQIQNIWA

SEQ ID NO: 301007 - protein, 8 aa, Influenza virus
QIQNIWAY

SEQ ID NO: 301008 - protein, 8 aa, Influenza virus
IQNIWAYN

SEQ ID NO: 301009 - protein, 8 aa, Influenza virus
QNIWAYNA

SEQ ID NO: 301010 - protein, 8 aa, Influenza virus
NIWAYNAE

SEQ ID NO: 301011 - protein, 8 aa, Influenza virus
LWAYNAEL

SEQ ID NO: 301012 - protein, 8 aa, Influenza virus
VLIENQKT

SEQ ID NO: 301013 - protein, 8 aa, Influenza virus
LIENQKTL

SEQ ID NO: 301014 - protein, 8 aa, Influenza virus
IENQKTLD

SEQ ID NO: 301015 - protein, 8 aa, Influenza virus
QKTLDEHV

SEQ ID NO: 301016 - protein, 8 aa, Influenza virus
KPLDEHDA

SEQ ID NO: 301017 - protein, 8 aa, Influenza virus
TLDEHDSN

SEQ ID NO: 301018 - protein, 8 aa, Influenza virus
LDEHVANV

SEQ ID NO: 301019 - protein, 8 aa, Influenza virus
DEHDANAN

SEQ ID NO: 301020 - protein, 8 aa, Influenza virus
DANANNLY

SEQ ID NO: 301021 - protein, 8 aa, Influenza virus
ANVHNLYN

SEQ ID NO: 301022 - protein, 8 aa, Influenza virus
VNNLYKKV

SEQ ID NO: 301023 - protein, 8 aa, Influenza virus
NNLYNRVK

SEQ ID NO: 301024 - protein, 8 aa, Influenza virus
EDGKGCFD

SEQ ID NO: 301025 - protein, 8 aa, Influenza virus
DGKGCFDL

SEQ ID NO: 301026 - protein, 8 aa, Influenza virus
GKGCFDLY

SEQ ID NO: 301027 - protein, 8 aa, Influenza virus
KGCFDLYH

SEQ ID NO: 301028 - protein, 8 aa, Influenza virus
GCFELYHR

SEQ ID NO: 301029 - protein, 8 aa, Influenza virus
CFELYHRC

SEQ ID NO: 301030 - protein, 8 aa, Influenza virus
FELYHRCD

SEQ ID NO: 301031 - protein, 8 aa, Influenza virus
DLYHKCDN

SEQ ID NO: 301032 - protein, 8 aa, Influenza virus
CMGTIRNG

SEQ ID NO: 301033 - protein, 8 aa, Influenza virus
MGTIRNGT

SEQ ID NO: 301034 - protein, 8 aa, Influenza virus
GTIRNGTY

SEQ ID NO: 301035 - protein, 8 aa, Influenza virus
TIRNGTYS

SEQ ID NO: 301036 - protein, 8 aa, Influenza virus
SEGIYKIL

SEQ ID NO: 301037 - protein, 8 aa, Influenza virus
EETYKILT

SEQ ID NO: 301038 - protein, 8 aa, Influenza virus
ETYKILTI

SEQ ID NO: 301039 - protein, 8 aa, Influenza virus
AYKILTIY

SEQ ID NO: 301040 - protein, 8 aa, Influenza virus
YSTVASSI

SEQ ID NO: 301041 - protein, 8 aa, Influenza virus
STVASSIV

SEQ ID NO: 301042 - protein, 8 aa, Influenza virus
AAFLFWVM

SEQ ID NO: 301043 - protein, 8 aa, Influenza virus
AFLFWTMS

SEQ ID NO: 301044 - protein, 8 aa, Influenza virus
WSKPQCLI

SEQ ID NO: 301045 - protein, 8 aa, Influenza virus
SKPQCLIT

SEQ ID NO: 301046 - protein, 8 aa, Influenza virus
KPQCQIAG

SEQ ID NO: 301047 - protein, 8 aa, Influenza virus
PQCQIAGF

SEQ ID NO: 301048 - protein, 8 aa, Influenza virus
QCQIAGFA

SEQ ID NO: 301049 - protein, 8 aa, Influenza virus
CLITGFAP

SEQ ID NO: 301050 - protein, 8 aa, Influenza virus
GFAPFTKD

SEQ ID NO: 301051 - protein, 8 aa, Influenza virus
SVRLSAGG

SEQ ID NO: 301052 - protein, 8 aa, Influenza virus
RLSAGGSI

SEQ ID NO: 301053 - protein, 8 aa, Influenza virus
LSAGGSIW

SEQ ID NO: 301054 - protein, 8 aa, Influenza virus
VNREPYVS

SEQ ID NO: 301055 - protein, 8 aa, Influenza virus
REPYVSCD

SEQ ID NO: 301056 - protein, 8 aa, Influenza virus
RCYQFALG

SEQ ID NO: 301057 - protein, 8 aa, Influenza virus
QFALGQGA

SEQ ID NO: 301058 - protein, 8 aa, Influenza virus
FALGQGAT

SEQ ID NO: 301059 - protein, 8 aa, Influenza virus
PHRTLLMS

SEQ ID NO: 301060 - protein, 8 aa, Influenza virus
HRTLLMSE

SEQ ID NO: 301061 - protein, 8 aa, Influenza virus
MNELGVPL

SEQ ID NO: 301062 - protein, 8 aa, Influenza virus
NELGVPLH

SEQ ID NO: 301063 - protein, 8 aa, Influenza virus
ELGVPFNL

SEQ ID NO: 301064 - protein, 8 aa, Influenza virus
TQQVCIAW

SEQ ID NO: 301065 - protein, 8 aa, Influenza virus
RQVCIAWS

SEQ ID NO: 301066 - protein, 8 aa, Influenza virus
VCIAWSSA

SEQ ID NO: 301067 - protein, 8 aa, Influenza virus
CIAWSSAS

SEQ ID NO: 301068 - protein, 8 aa, Influenza virus
IAWSSASC

SEQ ID NO: 301069 - protein, 8 aa, Influenza virus
AWSSASCH

SEQ ID NO: 301070 - protein, 8 aa, Influenza virus
WSSASCHD

SEQ ID NO: 301071 - protein, 8 aa, Influenza virus
SSASCHDG

SEQ ID NO: 301072 - protein, 8 aa, Influenza virus
SSSCYDGK

SEQ ID NO: 301073 - protein, 8 aa, Influenza virus
SSCYDGKA

SEQ ID NO: 301074 - protein, 8 aa, Influenza virus
SCYDGKAW

SEQ ID NO: 301075 - protein, 8 aa, Influenza virus
CYDGKAWL

SEQ ID NO: 301076 - protein, 8 aa, Influenza virus
YDGKAWLH

SEQ ID NO: 301077 - protein, 8 aa, Influenza virus
WLHVCITG

SEQ ID NO: 301078 - protein, 8 aa, Influenza virus
LHVCITGD

SEQ ID NO: 301079 - protein, 8 aa, Influenza virus
HVCITGDD

SEQ ID NO: 301080 - protein, 8 aa, Influenza virus
TILRTQES

SEQ ID NO: 301081 - protein, 8 aa, Influenza virus
ITQESECV

SEQ ID NO: 301082 - protein, 8 aa, Influenza virus
TQESECVG

SEQ ID NO: 301083 - protein, 8 aa, Influenza virus
QGSECVCI

SEQ ID NO: 301084 - protein, 8 aa, Influenza virus
ESECICIN

SEQ ID NO: 301085 - protein, 8 aa, Influenza virus
SECICING

SEQ ID NO: 301086 - protein, 8 aa, Influenza virus
ECICINGT

SEQ ID NO: 301087 - protein, 8 aa, Influenza virus
CICINGTC

SEQ ID NO: 301088 - protein, 8 aa, Influenza virus
ISGTCAVV

SEQ ID NO: 301089 - protein, 8 aa, Influenza virus
SGTCAVVM

SEQ ID NO: 301090 - protein, 8 aa, Influenza virus
GICTVVMT

SEQ ID NO: 301091 - protein, 8 aa, Influenza virus
ICTVVMTD

SEQ ID NO: 301092 - protein, 8 aa, Influenza virus
CTAVMTDG

SEQ ID NO: 301093 - protein, 8 aa, Influenza virus
TAVMTDGS

SEQ ID NO: 301094 - protein, 8 aa, Influenza virus
VVMTDGSS

SEQ ID NO: 301095 - protein, 8 aa, Influenza virus
VMTDGSAT

SEQ ID NO: 301096 - protein, 8 aa, Influenza virus
GNAQHVEE

SEQ ID NO: 301097 - protein, 8 aa, Influenza virus
NAQHVEEC

SEQ ID NO: 301098 - protein, 8 aa, Influenza virus
AKHVEECS

SEQ ID NO: 301099 - protein, 8 aa, Influenza virus
EECSCYPS

SEQ ID NO: 301100 - protein, 8 aa, Influenza virus
ECSCYPSY

SEQ ID NO: 301101 - protein, 8 aa, Influenza virus
CVYRDNWK

SEQ ID NO: 301102 - protein, 8 aa, Influenza virus
VYRDNWKG

SEQ ID NO: 301103 - protein, 8 aa, Influenza virus
YRDNWKGS

SEQ ID NO: 301104 - protein, 8 aa, Influenza virus
WKGSNRPI

SEQ ID NO: 301105 - protein, 8 aa, Influenza virus
YACSGLVG

SEQ ID NO: 301106 - protein, 8 aa, Influenza virus
LVGDTPRD

SEQ ID NO: 301107 - protein, 8 aa, Influenza virus
DLWMGRTI

SEQ ID NO: 301108 - protein, 8 aa, Influenza virus
YVELIRGK

SEQ ID NO: 301109 - protein, 8 aa, Influenza virus
VELIRGKP

SEQ ID NO: 301110 - protein, 8 aa, Influenza virus
RVWWTANS

SEQ ID NO: 301111 - protein, 8 aa, Influenza virus
VWWTSNSL

SEQ ID NO: 301112 - protein, 8 aa, Influenza virus
FCGTTGTY

SEQ ID NO: 301113 - protein, 8 aa, Influenza virus
CGTTGTYG

SEQ ID NO: 301114 - protein, 8 aa, Influenza virus
TPGTYGTG

SEQ ID NO: 301115 - protein, 8 aa, Influenza virus
GTYGAGSW

SEQ ID NO: 301116 - protein, 8 aa, Influenza virus
TYGAGSWP

SEQ ID NO: 301117 - protein, 8 aa, Influenza virus
HGTGSWPD

SEQ ID NO: 301118 - protein, 8 aa, Influenza virus
GTGSWPDE

SEQ ID NO: 301119 - protein, 8 aa, Influenza virus
TGSWADGA

SEQ ID NO: 301120 - protein, 8 aa, Influenza virus
GSWADGAN

SEQ ID NO: 301121 - protein, 8 aa, Influenza virus
SWPDGANV

SEQ ID NO: 301122 - protein, 8 aa, Influenza virus
ETYVLSVI

SEQ ID NO: 301123 - protein, 8 aa, Influenza virus
EIAQKLED

SEQ ID NO: 301124 - protein, 8 aa, Influenza virus
IAQKLEDV

SEQ ID NO: 301125 - protein, 8 aa, Influenza virus
AQKLEDVF

SEQ ID NO: 301126 - protein, 8 aa, Influenza virus
QKLEDVFA

SEQ ID NO: 301127 - protein, 8 aa, Influenza virus
KLEDVFAG

SEQ ID NO: 301128 - protein, 8 aa, Influenza virus
LEGVFAGK

SEQ ID NO: 301129 - protein, 8 aa, Influenza virus
EGVFAGKN

SEQ ID NO: 301130 - protein, 8 aa, Influenza virus
VFAGKNSD

SEQ ID NO: 301131 - protein, 8 aa, Influenza virus
FAGKNSDL

SEQ ID NO: 301132 - protein, 8 aa, Influenza virus
AGKNSDLE

SEQ ID NO: 301133 - protein, 8 aa, Influenza virus
GKNSDLEA

SEQ ID NO: 301134 - protein, 8 aa, Influenza virus
KNSDLEAL

SEQ ID NO: 301135 - protein, 8 aa, Influenza virus
NSDLEALM

SEQ ID NO: 301136 - protein, 8 aa, Influenza virus
SDLEALME

SEQ ID NO: 301137 - protein, 8 aa, Influenza virus
TKGVLGFV

SEQ ID NO: 301138 - protein, 8 aa, Influenza virus
RFIQNALN

SEQ ID NO: 301139 - protein, 8 aa, Influenza virus
FIQNALNG

SEQ ID NO: 301140 - protein, 8 aa, Influenza virus
IQNALNGN

SEQ ID NO: 301141 - protein, 8 aa, Influenza virus
DPSNMDRA

SEQ ID NO: 301142 - protein, 8 aa, Influenza virus
PSNMDRAV

SEQ ID NO: 301143 - protein, 8 aa, Influenza virus
SNMDRAVK

SEQ ID NO: 301144 - protein, 8 aa, Influenza virus
DKAVKLYR

SEQ ID NO: 301145 - protein, 8 aa, Influenza virus
KAVKLYRK

SEQ ID NO: 301146 - protein, 8 aa, Influenza virus
YKKLKREM

SEQ ID NO: 301147 - protein, 8 aa, Influenza virus
KKLKREMT

SEQ ID NO: 301148 - protein, 8 aa, Influenza virus
FHGAKEVS

SEQ ID NO: 301149 - protein, 8 aa, Influenza virus
HGAKEVSL

SEQ ID NO: 301150 - protein, 8 aa, Influenza virus
GAKEVSLS

SEQ ID NO: 301151 - protein, 8 aa, Influenza virus
AKEVSLSY

SEQ ID NO: 301152 - protein, 8 aa, Influenza virus
KEVSLSYS

SEQ ID NO: 301153 - protein, 8 aa, Influenza virus
EVSLSYST

SEQ ID NO: 301154 - protein, 8 aa, Influenza virus
VSLSYSTG

SEQ ID NO: 301155 - protein, 8 aa, Influenza virus
SLSYSTGA

SEQ ID NO: 301156 - protein, 8 aa, Influenza virus
LGYSTGAL

SEQ ID NO: 301157 - protein, 8 aa, Influenza virus
GYSTGALA

SEQ ID NO: 301158 - protein, 8 aa, Influenza virus
IYNRMGTI

SEQ ID NO: 301159 - protein, 8 aa, Influenza virus
YNRMGTVA

SEQ ID NO: 301160 - protein, 8 aa, Influenza virus
ALGLVCAT

SEQ ID NO: 301161 - protein, 8 aa, Influenza virus
LGLVCATC

SEQ ID NO: 301162 - protein, 8 aa, Influenza virus
CEQIADSH

SEQ ID NO: 301163 - protein, 8 aa, Influenza virus
EQIADSHH

SEQ ID NO: 301164 - protein, 8 aa, Influenza virus
QIADAQHR

SEQ ID NO: 301165 - protein, 8 aa, Influenza virus
IADAQHRS

SEQ ID NO: 301166 - protein, 8 aa, Influenza virus
ADAQHRSH

SEQ ID NO: 301167 - protein, 8 aa, Influenza virus
DAQHRSHR

SEQ ID NO: 301168 - protein, 8 aa, Influenza virus
AQHRSHRQ

SEQ ID NO: 301169 - protein, 8 aa, Influenza virus
HHRSHRQM

SEQ ID NO: 301170 - protein, 8 aa, Influenza virus
HKSHRQMV

SEQ ID NO: 301171 - protein, 8 aa, Influenza virus
TITNPLIR

SEQ ID NO: 301172 - protein, 8 aa, Influenza virus
ITNPLIRH

SEQ ID NO: 301173 - protein, 8 aa, Influenza virus
RHENRMVI

SEQ ID NO: 301174 - protein, 8 aa, Influenza virus
QAAEAIEV

SEQ ID NO: 301175 - protein, 8 aa, Influenza virus
AAEAIEVA

SEQ ID NO: 301176 - protein, 8 aa, Influenza virus
ARRMVQAM

SEQ ID NO: 301177 - protein, 8 aa, Influenza virus
RRMVQAMR

SEQ ID NO: 301178 - protein, 8 aa, Influenza virus
QMVQAMRA

SEQ ID NO: 301179 - protein, 8 aa, Influenza virus
MVQAMRAI

SEQ ID NO: 301180 - protein, 8 aa, Influenza virus
VQAMRAIG

SEQ ID NO: 301181 - protein, 8 aa, Influenza virus
QAMRAIGT

SEQ ID NO: 301182 - protein, 8 aa, Influenza virus
AMRTVGTH

SEQ ID NO: 301183 - protein, 8 aa, Influenza virus
MRTVGTHP

SEQ ID NO: 301184 - protein, 8 aa, Influenza virus
NDLLENLQ

SEQ ID NO: 301185 - protein, 8 aa, Influenza virus
NLLENLQA

SEQ ID NO: 301186 - protein, 8 aa, Influenza virus
LIENLQAY

SEQ ID NO: 301187 - protein, 8 aa, Influenza virus
IENLQAYQ

SEQ ID NO: 301188 - protein, 8 aa, Influenza virus
DNLQAYQK

SEQ ID NO: 301189 - protein, 8 aa, Influenza virus
AYQKRMGL

SEQ ID NO: 301190 - protein, 8 aa, Influenza virus
QKRMGVQI

SEQ ID NO: 301191 - protein, 8 aa, Influenza virus
KRMGVQIQ

SEQ ID NO: 301192 - protein, 8 aa, Influenza virus
RMGVQIQR

SEQ ID NO: 301193 - protein, 8 aa, Influenza virus
MGVQIQRF

SEQ ID NO: 301194 - protein, 8 aa, Influenza virus
GVQIQRFK

SEQ ID NO: 301195 - protein, 8 aa, Influenza virus
LLTEVETH

SEQ ID NO: 301196 - protein, 8 aa, Influenza virus
LTEVETLT

SEQ ID NO: 301197 - protein, 8 aa, Influenza virus
GVLHLILW

SEQ ID NO: 301198 - protein, 8 aa, Influenza virus
ILHLVLWI

SEQ ID NO: 301199 - protein, 8 aa, Influenza virus
GIPESMRE

SEQ ID NO: 301200 - protein, 8 aa, Influenza virus
IPESMREE

SEQ ID NO: 301201 - protein, 8 aa, Influenza virus
KSMREEYR

SEQ ID NO: 301202 - protein, 8 aa, Influenza virus
SMREEYRK

SEQ ID NO: 301203 - protein, 8 aa, Influenza virus
MREEYRKE

SEQ ID NO: 301204 - protein, 8 aa, Influenza virus
REEYRKEQ

SEQ ID NO: 301205 - protein, 8 aa, Influenza virus
MSDIEIMA

SEQ ID NO: 301206 - protein, 8 aa, Influenza virus
SDIEAMAT

SEQ ID NO: 301207 - protein, 8 aa, Influenza virus
DIEAMATQ

SEQ ID NO: 301208 - protein, 8 aa, Influenza virus
IGAMASQG

SEQ ID NO: 301209 - protein, 8 aa, Influenza virus
EIMASQGT

SEQ ID NO: 301210 - protein, 8 aa, Influenza virus
ASQGTKRP

SEQ ID NO: 301211 - protein, 8 aa, Influenza virus
LQGTKRSY

SEQ ID NO: 301212 - protein, 8 aa, Influenza virus
SYEQMETS

SEQ ID NO: 301213 - protein, 8 aa, Influenza virus
YEQMETSG

SEQ ID NO: 301214 - protein, 8 aa, Influenza virus
EQMETDGE

SEQ ID NO: 301215 - protein, 8 aa, Influenza virus
QMETDGER

SEQ ID NO: 301216 - protein, 8 aa, Influenza virus
METDGERQ

SEQ ID NO: 301217 - protein, 8 aa, Influenza virus
RQNANEIR

SEQ ID NO: 301218 - protein, 8 aa, Influenza virus
TTEIRASV

SEQ ID NO: 301219 - protein, 8 aa, Influenza virus
TEIRTSVG

SEQ ID NO: 301220 - protein, 8 aa, Influenza virus
EIRSSVGK

SEQ ID NO: 301221 - protein, 8 aa, Influenza virus
IRSSVGKM

SEQ ID NO: 301222 - protein, 8 aa, Influenza virus
RASVGKMI

SEQ ID NO: 301223 - protein, 8 aa, Influenza virus
SGIGRFYI

SEQ ID NO: 301224 - protein, 8 aa, Influenza virus
GIGKFYIQ

SEQ ID NO: 301225 - protein, 8 aa, Influenza virus
IGKFYIQM

SEQ ID NO: 301226 - protein, 8 aa, Influenza virus
GKFYIQMC

SEQ ID NO: 301227 - protein, 8 aa, Influenza virus
KFYIQMCT

SEQ ID NO: 301228 - protein, 8 aa, Influenza virus
IQMCTELQ

SEQ ID NO: 301229 - protein, 8 aa, Influenza virus
MCTELQLS

SEQ ID NO: 301230 - protein, 8 aa, Influenza virus
CTELQLSD

SEQ ID NO: 301231 - protein, 8 aa, Influenza virus
HEGRLIQN

SEQ ID NO: 301232 - protein, 8 aa, Influenza virus
GRLIQNSM

SEQ ID NO: 301233 - protein, 8 aa, Influenza virus
RLIQNSMT

SEQ ID NO: 301234 - protein, 8 aa, Influenza virus
LIQNSMTI

SEQ ID NO: 301235 - protein, 8 aa, Influenza virus
IQNSMTIE

SEQ ID NO: 301236 - protein, 8 aa, Influenza virus
QNSLTIER

SEQ ID NO: 301237 - protein, 8 aa, Influenza virus
NSLTIERM

SEQ ID NO: 301238 - protein, 8 aa, Influenza virus
TVERMVLS

SEQ ID NO: 301239 - protein, 8 aa, Influenza virus
VERMVLSA

SEQ ID NO: 301240 - protein, 8 aa, Influenza virus
KYLEEHPN

SEQ ID NO: 301241 - protein, 8 aa, Influenza virus
YLEEHPNA

SEQ ID NO: 301242 - protein, 8 aa, Influenza virus
LEEHPNAG

SEQ ID NO: 301243 - protein, 8 aa, Influenza virus
EEHPSTGK

SEQ ID NO: 301244 - protein, 8 aa, Influenza virus
EHPSTGKD

SEQ ID NO: 301245 - protein, 8 aa, Influenza virus
HPSTGKDP

SEQ ID NO: 301246 - protein, 8 aa, Influenza virus
PSTGKDPK

SEQ ID NO: 301247 - protein, 8 aa, Influenza virus
STGKDPKK

SEQ ID NO: 301248 - protein, 8 aa, Influenza virus
TGGPIYKK

SEQ ID NO: 301249 - protein, 8 aa, Influenza virus
RELILHDK

SEQ ID NO: 301250 - protein, 8 aa, Influenza virus
ELILYDKD

SEQ ID NO: 301251 - protein, 8 aa, Influenza virus
LILYDKDE

SEQ ID NO: 301252 - protein, 8 aa, Influenza virus
KDEIRRIW

SEQ ID NO: 301253 - protein, 8 aa, Influenza virus
EIMRIWRQ

SEQ ID NO: 301254 - protein, 8 aa, Influenza virus
IMRIWRQA

SEQ ID NO: 301255 - protein, 8 aa, Influenza virus
MRIWRQAN

SEQ ID NO: 301256 - protein, 8 aa, Influenza virus
NWRQANNG

SEQ ID NO: 301257 - protein, 8 aa, Influenza virus
RQANNGEE

SEQ ID NO: 301258 - protein, 8 aa, Influenza virus
QANNGEDS

SEQ ID NO: 301259 - protein, 8 aa, Influenza virus
AGLTHMMI

SEQ ID NO: 301260 - protein, 8 aa, Influenza virus
GLTHMMIW

SEQ ID NO: 301261 - protein, 8 aa, Influenza virus
LTHMMIWH

SEQ ID NO: 301262 - protein, 8 aa, Influenza virus
THMMIWHS

SEQ ID NO: 301263 - protein, 8 aa, Influenza virus
HMMIWHSN

SEQ ID NO: 301264 - protein, 8 aa, Influenza virus
MMIWHSNL

SEQ ID NO: 301265 - protein, 8 aa, Influenza virus
AGAAIKGV

SEQ ID NO: 301266 - protein, 8 aa, Influenza virus
GAAIKGVG

SEQ ID NO: 301267 - protein, 8 aa, Influenza virus
AAIKGVGT

SEQ ID NO: 301268 - protein, 8 aa, Influenza virus
AVKGIGTM

SEQ ID NO: 301269 - protein, 8 aa, Influenza virus
VMELIRMV

SEQ ID NO: 301270 - protein, 8 aa, Influenza virus
LELIRMIK

SEQ ID NO: 301271 - protein, 8 aa, Influenza virus
ELVRMIKR

SEQ ID NO: 301272 - protein, 8 aa, Influenza virus
LVRMIKRG

SEQ ID NO: 301273 - protein, 8 aa, Influenza virus
VRMIKRGI

SEQ ID NO: 301274 - protein, 8 aa, Influenza virus
RMIKRGVN

SEQ ID NO: 301275 - protein, 8 aa, Influenza virus
MIKRGVND

SEQ ID NO: 301276 - protein, 8 aa, Influenza virus
IKRGVNDR

SEQ ID NO: 301277 - protein, 8 aa, Influenza virus
WRGDNGRR

SEQ ID NO: 301278 - protein, 8 aa, Influenza virus
RGDNGRRT

SEQ ID NO: 301279 - protein, 8 aa, Influenza virus
GDNGRRTR

SEQ ID NO: 301280 - protein, 8 aa, Influenza virus
TRSAYERM

SEQ ID NO: 301281 - protein, 8 aa, Influenza virus
RSAYERMC

SEQ ID NO: 301282 - protein, 8 aa, Influenza virus
SAYERMCN

SEQ ID NO: 301283 - protein, 8 aa, Influenza virus
TAAQKAMM

SEQ ID NO: 301284 - protein, 8 aa, Influenza virus
AAQKAMMD

SEQ ID NO: 301285 - protein, 8 aa, Influenza virus
AQKAMMDQ

SEQ ID NO: 301286 - protein, 8 aa, Influenza virus
QKAMMDQV

SEQ ID NO: 301287 - protein, 8 aa, Influenza virus
KAMMDQVR

SEQ ID NO: 301288 - protein, 8 aa, Influenza virus
MMDQVREG

SEQ ID NO: 301289 - protein, 8 aa, Influenza virus
MDQVREGR

SEQ ID NO: 301290 - protein, 8 aa, Influenza virus
EIEDLIFS

SEQ ID NO: 301291 - protein, 8 aa, Influenza virus
IEDLIFSA

SEQ ID NO: 301292 - protein, 8 aa, Influenza virus
EDLIFSAR

SEQ ID NO: 301293 - protein, 8 aa, Influenza virus
DLIFSARS

SEQ ID NO: 301294 - protein, 8 aa, Influenza virus
LIFSARSA

SEQ ID NO: 301295 - protein, 8 aa, Influenza virus
IFSARSAL

SEQ ID NO: 301296 - protein, 8 aa, Influenza virus
FMARSALI

SEQ ID NO: 301297 - protein, 8 aa, Influenza virus
MARSALIL

SEQ ID NO: 301298 - protein, 8 aa, Influenza virus
ALILRGAV

SEQ ID NO: 301299 - protein, 8 aa, Influenza virus
LILRGAVA

SEQ ID NO: 301300 - protein, 8 aa, Influenza virus
ILRGAVAH

SEQ ID NO: 301301 - protein, 8 aa, Influenza virus
KSCLPACI

SEQ ID NO: 301302 - protein, 8 aa, Influenza virus
SCLPACIY

SEQ ID NO: 301303 - protein, 8 aa, Influenza virus
CLPACIYG

SEQ ID NO: 301304 - protein, 8 aa, Influenza virus
LPACAYGP

SEQ ID NO: 301305 - protein, 8 aa, Influenza virus
PACAYGPA

SEQ ID NO: 301306 - protein, 8 aa, Influenza virus
ACAYGPAV

SEQ ID NO: 301307 - protein, 8 aa, Influenza virus
SGYDFEKE

SEQ ID NO: 301308 - protein, 8 aa, Influenza virus
GYDFEKEG

SEQ ID NO: 301309 - protein, 8 aa, Influenza virus
YDFEKEGY

SEQ ID NO: 301310 - protein, 8 aa, Influenza virus
NFEKEGYS

SEQ ID NO: 301311 - protein, 8 aa, Influenza virus
LVGVDPFK

SEQ ID NO: 301312 - protein, 8 aa, Influenza virus
VGVDPFKL

SEQ ID NO: 301313 - protein, 8 aa, Influenza virus
GVDPFKLL

SEQ ID NO: 301314 - protein, 8 aa, Influenza virus
VDPFKLLQ

SEQ ID NO: 301315 - protein, 8 aa, Influenza virus
DPFKLLQT

SEQ ID NO: 301316 - protein, 8 aa, Influenza virus
PFKLLQTS

SEQ ID NO: 301317 - protein, 8 aa, Influenza virus
FKLLQTSQ

SEQ ID NO: 301318 - protein, 8 aa, Influenza virus
KLLQNSQI

SEQ ID NO: 301319 - protein, 8 aa, Influenza virus
SLIRPKEN

SEQ ID NO: 301320 - protein, 8 aa, Influenza virus
LIRPKENP

SEQ ID NO: 301321 - protein, 8 aa, Influenza virus
RPKENPAH

SEQ ID NO: 301322 - protein, 8 aa, Influenza virus
PKENPAHK

SEQ ID NO: 301323 - protein, 8 aa, Influenza virus
KENPAHKS

SEQ ID NO: 301324 - protein, 8 aa, Influenza virus
PAHKSQLI

SEQ ID NO: 301325 - protein, 8 aa, Influenza virus
AHKSQLIW

SEQ ID NO: 301326 - protein, 8 aa, Influenza virus
QLIWMACH

SEQ ID NO: 301327 - protein, 8 aa, Influenza virus
LIWMACHS

SEQ ID NO: 301328 - protein, 8 aa, Influenza virus
IWMACHSA

SEQ ID NO: 301329 - protein, 8 aa, Influenza virus
AAFEDLRI

SEQ ID NO: 301330 - protein, 8 aa, Influenza virus
AFEDLRVL

SEQ ID NO: 301331 - protein, 8 aa, Influenza virus
PRGQLATR

SEQ ID NO: 301332 - protein, 8 aa, Influenza virus
RGQLATRG

SEQ ID NO: 301333 - protein, 8 aa, Influenza virus
LSTRGIQI

SEQ ID NO: 301334 - protein, 8 aa, Influenza virus
STRGIQIA

SEQ ID NO: 301335 - protein, 8 aa, Influenza virus
TRGIQIAS

SEQ ID NO: 301336 - protein, 8 aa, Influenza virus
RGIQIASN

SEQ ID NO: 301337 - protein, 8 aa, Influenza virus
GIQIASNE

SEQ ID NO: 301338 - protein, 8 aa, Influenza virus
IQIASNEN

SEQ ID NO: 301339 - protein, 8 aa, Influenza virus
QVASNENM

SEQ ID NO: 301340 - protein, 8 aa, Influenza virus
SITLELRS

SEQ ID NO: 301341 - protein, 8 aa, Influenza virus
TLELRSKY

SEQ ID NO: 301342 - protein, 8 aa, Influenza virus
LELRSKYW

SEQ ID NO: 301343 - protein, 8 aa, Influenza virus
ELRSKYWA

SEQ ID NO: 301344 - protein, 8 aa, Influenza virus
LRSKYWAI

SEQ ID NO: 301345 - protein, 8 aa, Influenza virus
RSKYWAIR

SEQ ID NO: 301346 - protein, 8 aa, Influenza virus
SKYWAIRT

SEQ ID NO: 301347 - protein, 8 aa, Influenza virus
KYWAIRTR

SEQ ID NO: 301348 - protein, 8 aa, Influenza virus
TRSGGNNN

SEQ ID NO: 301349 - protein, 8 aa, Influenza virus
RSGGNNNQ

SEQ ID NO: 301350 - protein, 8 aa, Influenza virus
SGGNTNQH

SEQ ID NO: 301351 - protein, 8 aa, Influenza virus
QHRASAGQ

SEQ ID NO: 301352 - protein, 8 aa, Influenza virus
RASAGQTS

SEQ ID NO: 301353 - protein, 8 aa, Influenza virus
ASAGQIST

SEQ ID NO: 301354 - protein, 8 aa, Influenza virus
SAGQISTQ

SEQ ID NO: 301355 - protein, 8 aa, Influenza virus
AGQISTQP

SEQ ID NO: 301356 - protein, 8 aa, Influenza virus
SIQPTFSV

SEQ ID NO: 301357 - protein, 8 aa, Influenza virus
IQPTFSVQ

SEQ ID NO: 301358 - protein, 8 aa, Influenza virus
PTFSVQRS

SEQ ID NO: 301359 - protein, 8 aa, Influenza virus
TFSVQRSL

SEQ ID NO: 301360 - protein, 8 aa, Influenza virus
VQRSLPFE

SEQ ID NO: 301361 - protein, 8 aa, Influenza virus
QRNLPFDK

SEQ ID NO: 301362 - protein, 8 aa, Influenza virus
GNAEGRTS

SEQ ID NO: 301363 - protein, 8 aa, Influenza virus
NAEGRTSD

SEQ ID NO: 301364 - protein, 8 aa, Influenza virus
AEGRTSDM

SEQ ID NO: 301365 - protein, 8 aa, Influenza virus
TSDMRTEV

SEQ ID NO: 301366 - protein, 8 aa, Influenza virus
SDMRTEVI

SEQ ID NO: 301367 - protein, 8 aa, Influenza virus
DMRAEIIR

SEQ ID NO: 301368 - protein, 8 aa, Influenza virus
EVSFRGRG

SEQ ID NO: 301369 - protein, 8 aa, Influenza virus
VSFRGRGV

SEQ ID NO: 301370 - protein, 8 aa, Influenza virus
QGRGVFEF

SEQ ID NO: 301371 - protein, 8 aa, Influenza virus
VFEFSDER

SEQ ID NO: 301372 - protein, 8 aa, Influenza virus
FEFSDERA

SEQ ID NO: 301373 - protein, 8 aa, Influenza virus
ELSDEKAA

SEQ ID NO: 301374 - protein, 8 aa, Influenza virus
SDEKATSP

SEQ ID NO: 301375 - protein, 8 aa, Influenza virus
ATSPIVPS

SEQ ID NO: 301376 - protein, 8 aa, Influenza virus
TSPIVPSF

SEQ ID NO: 301377 - protein, 8 aa, Influenza virus
SPIVPSFD

SEQ ID NO: 301378 - protein, 8 aa, Influenza virus
PVVPSFDM

SEQ ID NO: 301379 - protein, 8 aa, Influenza virus
IVPSFEMS

SEQ ID NO: 301380 - protein, 8 aa, Influenza virus
VPSFEMSN

SEQ ID NO: 301381 - protein, 8 aa, Influenza virus
PSFEMSNE

SEQ ID NO: 301382 - protein, 8 aa, Influenza virus
SFEMSNEG

SEQ ID NO: 301383 - protein, 8 aa, Influenza virus
FEMSNEGS

SEQ ID NO: 301384 - protein, 8 aa, Influenza virus
EMSNEGSY

SEQ ID NO: 301385 - protein, 8 aa, Influenza virus
MSKEGSYF

SEQ ID NO: 301386 - protein, 8 aa, Influenza virus
SKEGSYFF

SEQ ID NO: 301387 - protein, 8 aa, Influenza virus
FFGDSAEE

SEQ ID NO: 301388 - protein, 8 aa, Influenza virus
FGDSAEEY

SEQ ID NO: 301389 - protein, 8 aa, Influenza virus
LSFQVDCF

SEQ ID NO: 301390 - protein, 8 aa, Influenza virus
QVDCFIWH

SEQ ID NO: 301391 - protein, 8 aa, Influenza virus
VDCYLWHI

SEQ ID NO: 301392 - protein, 8 aa, Influenza virus
DCYLWHIR

SEQ ID NO: 301393 - protein, 8 aa, Influenza virus
CDAPFDDR

SEQ ID NO: 301394 - protein, 8 aa, Influenza virus
DAPFLDRI

SEQ ID NO: 301395 - protein, 8 aa, Influenza virus
APFLDRIR

SEQ ID NO: 301396 - protein, 8 aa, Influenza virus
PFLDRIRR

SEQ ID NO: 301397 - protein, 8 aa, Influenza virus
FLDRIRRD

SEQ ID NO: 301398 - protein, 8 aa, Influenza virus
LDRIRRDQ

SEQ ID NO: 301399 - protein, 8 aa, Influenza virus
DRIRRDQK

SEQ ID NO: 301400 - protein, 8 aa, Influenza virus
RLRRDQKA

SEQ ID NO: 301401 - protein, 8 aa, Influenza virus
LRRDQKAL

SEQ ID NO: 301402 - protein, 8 aa, Influenza virus
RRDQRSLR

SEQ ID NO: 301403 - protein, 8 aa, Influenza virus
RDQRSLRG

SEQ ID NO: 301404 - protein, 8 aa, Influenza virus
DQRSLRGR

SEQ ID NO: 301405 - protein, 8 aa, Influenza virus
KMPASRYL

SEQ ID NO: 301406 - protein, 8 aa, Influenza virus
MPASRYLT

SEQ ID NO: 301407 - protein, 8 aa, Influenza virus
PASRYLTD

SEQ ID NO: 301408 - protein, 8 aa, Influenza virus
RGDQMAHC

SEQ ID NO: 301409 - protein, 8 aa, Influenza virus
ELSQKFEE

SEQ ID NO: 301410 - protein, 8 aa, Influenza virus
LGQKFEEV

SEQ ID NO: 301411 - protein, 8 aa, Influenza virus
QKFEEIKW

SEQ ID NO: 301412 - protein, 8 aa, Influenza virus
KFEEIKWL

SEQ ID NO: 301413 - protein, 8 aa, Influenza virus
FEEIKWLI

SEQ ID NO: 301414 - protein, 8 aa, Influenza virus
TFIQALQL

SEQ ID NO: 301415 - protein, 8 aa, Influenza virus
FIQALQLL

SEQ ID NO: 301416 - protein, 8 aa, Influenza virus
LQALQLLL

SEQ ID NO: 301417 - protein, 8 aa, Influenza virus
QLLLEVES

SEQ ID NO: 301418 - protein, 8 aa, Influenza virus
LLLEVESE

SEQ ID NO: 301419 - protein, 8 aa, Influenza virus
EVESEIRT

SEQ ID NO: 301420 - protein, 8 aa, Influenza virus
VESEIRTF

SEQ ID NO: 301421 - protein, 8 aa, Influenza virus
ESEIRTFS

SEQ ID NO: 301422 - protein, 8 aa, Influenza virus
SEIRTFSF

SEQ ID NO: 301423 - protein, 8 aa, Influenza virus
EMRTFSFQ

SEQ ID NO: 301424 - protein, 8 aa, Influenza virus
MRTFSFQL

SEQ ID NO: 301425 - protein, 8 aa, Influenza virus
RTFSFQFI

SEQ ID NO: 301426 - protein, 8 aa, Influenza virus
FSFQLILI

SEQ ID NO: 301427 - protein, 8 aa, Influenza virus
MEGFVRQC

SEQ ID NO: 301428 - protein, 8 aa, Influenza virus
EGFVRQCF

SEQ ID NO: 301429 - protein, 8 aa, Influenza virus
GFVRQCFN

SEQ ID NO: 301430 - protein, 8 aa, Influenza virus
RQCFNPMT

SEQ ID NO: 301431 - protein, 8 aa, Influenza virus
QCFNPMVV

SEQ ID NO: 301432 - protein, 8 aa, Influenza virus
CFNPMVVE

SEQ ID NO: 301433 - protein, 8 aa, Influenza virus
FNPMVVEL

SEQ ID NO: 301434 - protein, 8 aa, Influenza virus
NPMVVELA

SEQ ID NO: 301435 - protein, 8 aa, Influenza virus
PMVVELAE

SEQ ID NO: 301436 - protein, 8 aa, Influenza virus
MVVELAEK

SEQ ID NO: 301437 - protein, 8 aa, Influenza virus
IELAEKAM

SEQ ID NO: 301438 - protein, 8 aa, Influenza virus
ELAERAMK

SEQ ID NO: 301439 - protein, 8 aa, Influenza virus
AEKAMKEH

SEQ ID NO: 301440 - protein, 8 aa, Influenza virus
EKAMKEHG

SEQ ID NO: 301441 - protein, 8 aa, Influenza virus
KAMKEHGE

SEQ ID NO: 301442 - protein, 8 aa, Influenza virus
IETNKLAA

SEQ ID NO: 301443 - protein, 8 aa, Influenza virus
ETNKFASI

SEQ ID NO: 301444 - protein, 8 aa, Influenza virus
TNKFASIC

SEQ ID NO: 301445 - protein, 8 aa, Influenza virus
NKFASICT

SEQ ID NO: 301446 - protein, 8 aa, Influenza virus
KFASICTH

SEQ ID NO: 301447 - protein, 8 aa, Influenza virus
LAAICTHL

SEQ ID NO: 301448 - protein, 8 aa, Influenza virus
ASICTHLE

SEQ ID NO: 301449 - protein, 8 aa, Influenza virus
AICTHLEI

SEQ ID NO: 301450 - protein, 8 aa, Influenza virus
ICTHLEIC

SEQ ID NO: 301451 - protein, 8 aa, Influenza virus
CTHLEICF

SEQ ID NO: 301452 - protein, 8 aa, Influenza virus
THLEICFM

SEQ ID NO: 301453 - protein, 8 aa, Influenza virus
HLEICFMY

SEQ ID NO: 301454 - protein, 8 aa, Influenza virus
LEICFMYS

SEQ ID NO: 301455 - protein, 8 aa, Influenza virus
DFHFINER

SEQ ID NO: 301456 - protein, 8 aa, Influenza virus
DPNVLLKH

SEQ ID NO: 301457 - protein, 8 aa, Influenza virus
PNVLLKHR

SEQ ID NO: 301458 - protein, 8 aa, Influenza virus
IIEGRDRN

SEQ ID NO: 301459 - protein, 8 aa, Influenza virus
EGRDRNMA

SEQ ID NO: 301460 - protein, 8 aa, Influenza virus
GRDRNMAW

SEQ ID NO: 301461 - protein, 8 aa, Influenza virus
AWTMVNSI

SEQ ID NO: 301462 - protein, 8 aa, Influenza virus
WTMVNSIC

SEQ ID NO: 301463 - protein, 8 aa, Influenza virus
KPRYLPDL

SEQ ID NO: 301464 - protein, 8 aa, Influenza virus
PRYLPDLY

SEQ ID NO: 301465 - protein, 8 aa, Influenza virus
RYLPDLYD

SEQ ID NO: 301466 - protein, 8 aa, Influenza virus
SLPDLYDY

SEQ ID NO: 301467 - protein, 8 aa, Influenza virus
DLYDYKES

SEQ ID NO: 301468 - protein, 8 aa, Influenza virus
LYDYKESR

SEQ ID NO: 301469 - protein, 8 aa, Influenza virus
YDYKESRF

SEQ ID NO: 301470 - protein, 8 aa, Influenza virus
RFLEIGVT

SEQ ID NO: 301471 - protein, 8 aa, Influenza virus
FLEIGVTR

SEQ ID NO: 301472 - protein, 8 aa, Influenza virus
LEIGVTRR

SEQ ID NO: 301473 - protein, 8 aa, Influenza virus
VTRREVHV

SEQ ID NO: 301474 - protein, 8 aa, Influenza virus
TRREVHVY

SEQ ID NO: 301475 - protein, 8 aa, Influenza virus
RREVHVYY

SEQ ID NO: 301476 - protein, 8 aa, Influenza virus
REVHVYYL

SEQ ID NO: 301477 - protein, 8 aa, Influenza virus
EVHVYYLE

SEQ ID NO: 301478 - protein, 8 aa, Influenza virus
IHIYYLEK

SEQ ID NO: 301479 - protein, 8 aa, Influenza virus
HVYYLEKA

SEQ ID NO: 301480 - protein, 8 aa, Influenza virus
VYYLEKAN

SEQ ID NO: 301481 - protein, 8 aa, Influenza virus
EKASKIKS

SEQ ID NO: 301482 - protein, 8 aa, Influenza virus
KASKIKSE

SEQ ID NO: 301483 - protein, 8 aa, Influenza virus
EETHIHIF

SEQ ID NO: 301484 - protein, 8 aa, Influenza virus
ETHIHIFS

SEQ ID NO: 301485 - protein, 8 aa, Influenza virus
FTGEEMAS

SEQ ID NO: 301486 - protein, 8 aa, Influenza virus
NGEEMATK

SEQ ID NO: 301487 - protein, 8 aa, Influenza virus
GEEMASKA

SEQ ID NO: 301488 - protein, 8 aa, Influenza virus
EYTLDEES

SEQ ID NO: 301489 - protein, 8 aa, Influenza virus
TIRQEMAI

SEQ ID NO: 301490 - protein, 8 aa, Influenza virus
IRQEMAIR

SEQ ID NO: 301491 - protein, 8 aa, Influenza virus
KGLWDSFR

SEQ ID NO: 301492 - protein, 8 aa, Influenza virus
GLWDPFRQ

SEQ ID NO: 301493 - protein, 8 aa, Influenza virus
SERGEETV

SEQ ID NO: 301494 - protein, 8 aa, Influenza virus
ERGEETVE

SEQ ID NO: 301495 - protein, 8 aa, Influenza virus
RGEETVEE

SEQ ID NO: 301496 - protein, 8 aa, Influenza virus
GEDTIEER

SEQ ID NO: 301497 - protein, 8 aa, Influenza virus
EDTIEERF

SEQ ID NO: 301498 - protein, 8 aa, Influenza virus
DTIEERFE

SEQ ID NO: 301499 - protein, 8 aa, Influenza virus
TVEERFEI

SEQ ID NO: 301500 - protein, 8 aa, Influenza virus
RLANQSLP

SEQ ID NO: 301501 - protein, 8 aa, Influenza virus
LANYSLPP

SEQ ID NO: 301502 - protein, 8 aa, Influenza virus
ANYSLPPN

SEQ ID NO: 301503 - protein, 8 aa, Influenza virus
NYSLPPNF

SEQ ID NO: 301504 - protein, 8 aa, Influenza virus
SLPPNFPS

SEQ ID NO: 301505 - protein, 8 aa, Influenza virus
NFRTYVDG

SEQ ID NO: 301506 - protein, 8 aa, Influenza virus
FRTYVDGF

SEQ ID NO: 301507 - protein, 8 aa, Influenza virus
RVYVDGFE

SEQ ID NO: 301508 - protein, 8 aa, Influenza virus
VYVDGFEP

SEQ ID NO: 301509 - protein, 8 aa, Influenza virus
DGFKPNGC

SEQ ID NO: 301510 - protein, 8 aa, Influenza virus
GFKPNGCI

SEQ ID NO: 301511 - protein, 8 aa, Influenza virus
FKPNGCIE

SEQ ID NO: 301512 - protein, 8 aa, Influenza virus
KPNGCIEG

SEQ ID NO: 301513 - protein, 8 aa, Influenza virus
PNGCIESK

SEQ ID NO: 301514 - protein, 8 aa, Influenza virus
NGCIESKL

SEQ ID NO: 301515 - protein, 8 aa, Influenza virus
GCIESKLS

SEQ ID NO: 301516 - protein, 8 aa, Influenza virus
CIESKLSQ

SEQ ID NO: 301517 - protein, 8 aa, Influenza virus
SKLSQMSK

SEQ ID NO: 301518 - protein, 8 aa, Influenza virus
KLSQMSKK

SEQ ID NO: 301519 - protein, 8 aa, Influenza virus
LSQMSKKV

SEQ ID NO: 301520 - protein, 8 aa, Influenza virus
CYQRSKFL

SEQ ID NO: 301521 - protein, 8 aa, Influenza virus
YQRSKFLL

SEQ ID NO: 301522 - protein, 8 aa, Influenza virus
KLSIEDPD

SEQ ID NO: 301523 - protein, 8 aa, Influenza virus
LSIEDPDH

SEQ ID NO: 301524 - protein, 8 aa, Influenza virus
SIEDPDHE

SEQ ID NO: 301525 - protein, 8 aa, Influenza virus
IEDPDHEG

SEQ ID NO: 301526 - protein, 8 aa, Influenza virus
EDPDHEGE

SEQ ID NO: 301527 - protein, 8 aa, Influenza virus
DPDHEGEG

SEQ ID NO: 301528 - protein, 8 aa, Influenza virus
PDHEGEGI

SEQ ID NO: 301529 - protein, 8 aa, Influenza virus
DHEGEGIP

SEQ ID NO: 301530 - protein, 8 aa, Influenza virus
GIPLHDAI

SEQ ID NO: 301531 - protein, 8 aa, Influenza virus
IPLHDAIK

SEQ ID NO: 301532 - protein, 8 aa, Influenza virus
PLHDAIKC

SEQ ID NO: 301533 - protein, 8 aa, Influenza virus
KCMRTFFG

SEQ ID NO: 301534 - protein, 8 aa, Influenza virus
CMRTFFGW

SEQ ID NO: 301535 - protein, 8 aa, Influenza virus
MRTFFGWK

SEQ ID NO: 301536 - protein, 8 aa, Influenza virus
KTFFGWRE

SEQ ID NO: 301537 - protein, 8 aa, Influenza virus
LKWVLGEN

SEQ ID NO: 301538 - protein, 8 aa, Influenza virus
KWVLGENM

SEQ ID NO: 301539 - protein, 8 aa, Influenza virus
WTLGENMA

SEQ ID NO: 301540 - protein, 8 aa, Influenza virus
TLGENMAP

SEQ ID NO: 301541 - protein, 8 aa, Influenza virus
ENMAPEKI

SEQ ID NO: 301542 - protein, 8 aa, Influenza virus
NMAPEKID

SEQ ID NO: 301543 - protein, 8 aa, Influenza virus
MAPEKIDF

SEQ ID NO: 301544 - protein, 8 aa, Influenza virus
APEKMDFE

SEQ ID NO: 301545 - protein, 8 aa, Influenza virus
WVQNEFNK

SEQ ID NO: 301546 - protein, 8 aa, Influenza virus
VQNEFNKA

SEQ ID NO: 301547 - protein, 8 aa, Influenza virus
ACELTDSV

SEQ ID NO: 301548 - protein, 8 aa, Influenza virus
CELTDSVW

SEQ ID NO: 301549 - protein, 8 aa, Influenza virus
WMELDEIG

SEQ ID NO: 301550 - protein, 8 aa, Influenza virus
MELDEIGE

SEQ ID NO: 301551 - protein, 8 aa, Influenza virus
LDEIGEDL

SEQ ID NO: 301552 - protein, 8 aa, Influenza virus
DEIGEDLA

SEQ ID NO: 301553 - protein, 8 aa, Influenza virus
EIGEDLAP

SEQ ID NO: 301554 - protein, 8 aa, Influenza virus
IGEDLAPI

SEQ ID NO: 301555 - protein, 8 aa, Influenza virus
GEDLAPIE

SEQ ID NO: 301556 - protein, 8 aa, Influenza virus
EDIAPIEH

SEQ ID NO: 301557 - protein, 8 aa, Influenza virus
APIEYVAS

SEQ ID NO: 301558 - protein, 8 aa, Influenza virus
PIEYVASM

SEQ ID NO: 301559 - protein, 8 aa, Influenza virus
IEYVASMR

SEQ ID NO: 301560 - protein, 8 aa, Influenza virus
EYVASMRR

SEQ ID NO: 301561 - protein, 8 aa, Influenza virus
IASMRRDY

SEQ ID NO: 301562 - protein, 8 aa, Influenza virus
ASIRRNYF

SEQ ID NO: 301563 - protein, 8 aa, Influenza virus
SIRRNYFT

SEQ ID NO: 301564 - protein, 8 aa, Influenza virus
RRSYFTAE

SEQ ID NO: 301565 - protein, 8 aa, Influenza virus
RSYFTAEV

SEQ ID NO: 301566 - protein, 8 aa, Influenza virus
SYFTAEVS

SEQ ID NO: 301567 - protein, 8 aa, Influenza virus
YFTAEVSY

SEQ ID NO: 301568 - protein, 8 aa, Influenza virus
FTAEVSYC

SEQ ID NO: 301569 - protein, 8 aa, Influenza virus
TAEVSYCR

SEQ ID NO: 301570 - protein, 8 aa, Influenza virus
AEVSYCRA

SEQ ID NO: 301571 - protein, 8 aa, Influenza virus
MKGVYMNT

SEQ ID NO: 301572 - protein, 8 aa, Influenza virus
KGVYMNTA

SEQ ID NO: 301573 - protein, 8 aa, Influenza virus
GVYMNTAL

SEQ ID NO: 301574 - protein, 8 aa, Influenza virus
VYMNTALL

SEQ ID NO: 301575 - protein, 8 aa, Influenza virus
YMNTALLN

SEQ ID NO: 301576 - protein, 8 aa, Influenza virus
MNTALLNA

SEQ ID NO: 301577 - protein, 8 aa, Influenza virus
ASCAAMED

SEQ ID NO: 301578 - protein, 8 aa, Influenza virus
SCAAMEDF

SEQ ID NO: 301579 - protein, 8 aa, Influenza virus
CAAMEDFQ

SEQ ID NO: 301580 - protein, 8 aa, Influenza virus
AAMEDFQL

SEQ ID NO: 301581 - protein, 8 aa, Influenza virus
AMEDFQLI

SEQ ID NO: 301582 - protein, 8 aa, Influenza virus
PMISKSRT

SEQ ID NO: 301583 - protein, 8 aa, Influenza virus
MISKCKTK

SEQ ID NO: 301584 - protein, 8 aa, Influenza virus
ISKCKTKE

SEQ ID NO: 301585 - protein, 8 aa, Influenza virus
SKCKTKEG

SEQ ID NO: 301586 - protein, 8 aa, Influenza virus
RTKEGRRR

SEQ ID NO: 301587 - protein, 8 aa, Influenza virus
TKEGRRRT

SEQ ID NO: 301588 - protein, 8 aa, Influenza virus
KEGRRRTN

SEQ ID NO: 301589 - protein, 8 aa, Influenza virus
DTDVVNFL

SEQ ID NO: 301590 - protein, 8 aa, Influenza virus
TDVVNFLS

SEQ ID NO: 301591 - protein, 8 aa, Influenza virus
DVVNFLSM

SEQ ID NO: 301592 - protein, 8 aa, Influenza virus
VVNFLSME

SEQ ID NO: 301593 - protein, 8 aa, Influenza virus
VNFLSMEF

SEQ ID NO: 301594 - protein, 8 aa, Influenza virus
NFLSMEFS

SEQ ID NO: 301595 - protein, 8 aa, Influenza virus
FLSMEFSL

SEQ ID NO: 301596 - protein, 8 aa, Influenza virus
FSLTDPKL

SEQ ID NO: 301597 - protein, 8 aa, Influenza virus
SLTDPKLE

SEQ ID NO: 301598 - protein, 8 aa, Influenza virus
PHKWERYC

SEQ ID NO: 301599 - protein, 8 aa, Influenza virus
HKWERYCV

SEQ ID NO: 301600 - protein, 8 aa, Influenza virus
KWERYCVL

SEQ ID NO: 301601 - protein, 8 aa, Influenza virus
WERYCVLE

SEQ ID NO: 301602 - protein, 8 aa, Influenza virus
PIFLYVRT

SEQ ID NO: 301603 - protein, 8 aa, Influenza virus
IFLYVRTN

SEQ ID NO: 301604 - protein, 8 aa, Influenza virus
LQQIESII

SEQ ID NO: 301605 - protein, 8 aa, Influenza virus
QIESIIEA

SEQ ID NO: 301606 - protein, 8 aa, Influenza virus
IESIIEAE

SEQ ID NO: 301607 - protein, 8 aa, Influenza virus
ESIIEAES

SEQ ID NO: 301608 - protein, 8 aa, Influenza virus
SIIEAESS

SEQ ID NO: 301609 - protein, 8 aa, Influenza virus
MVEAESSV

SEQ ID NO: 301610 - protein, 8 aa, Influenza virus
VEAESSVK

SEQ ID NO: 301611 - protein, 8 aa, Influenza virus
EAESSVRE

SEQ ID NO: 301612 - protein, 8 aa, Influenza virus
AESSVREK

SEQ ID NO: 301613 - protein, 8 aa, Influenza virus
ESSVREKD

SEQ ID NO: 301614 - protein, 8 aa, Influenza virus
SSVREKDM

SEQ ID NO: 301615 - protein, 8 aa, Influenza virus
SVREKDMT

SEQ ID NO: 301616 - protein, 8 aa, Influenza virus
VKEKDMTR

SEQ ID NO: 301617 - protein, 8 aa, Influenza virus
REKDMTKE

SEQ ID NO: 301618 - protein, 8 aa, Influenza virus
EKDLTKEF

SEQ ID NO: 301619 - protein, 8 aa, Influenza virus
KDLTKEFF

SEQ ID NO: 301620 - protein, 8 aa, Influenza virus
DLTKEFFE

SEQ ID NO: 301621 - protein, 8 aa, Influenza virus
EKWPIGES

SEQ ID NO: 301622 - protein, 8 aa, Influenza virus
KWPIGESP

SEQ ID NO: 301623 - protein, 8 aa, Influenza virus
WPIGESPE

SEQ ID NO: 301624 - protein, 8 aa, Influenza virus
PIGESPEG

SEQ ID NO: 301625 - protein, 8 aa, Influenza virus
GESPEGVE

SEQ ID NO: 301626 - protein, 8 aa, Influenza virus
GVEDGSIG

SEQ ID NO: 301627 - protein, 8 aa, Influenza virus
VEDGSIGK

SEQ ID NO: 301628 - protein, 8 aa, Influenza virus
EDGSIGKV

SEQ ID NO: 301629 - protein, 8 aa, Influenza virus
DGSIGKVC

SEQ ID NO: 301630 - protein, 8 aa, Influenza virus
LAKSVFNN

SEQ ID NO: 301631 - protein, 8 aa, Influenza virus
AKSVFNNL

SEQ ID NO: 301632 - protein, 8 aa, Influenza virus
KSVFNNLY

SEQ ID NO: 301633 - protein, 8 aa, Influenza virus
SVFNNLYA

SEQ ID NO: 301634 - protein, 8 aa, Influenza virus
VFNNLYAS

SEQ ID NO: 301635 - protein, 8 aa, Influenza virus
FNCLYASP

SEQ ID NO: 301636 - protein, 8 aa, Influenza virus
NCLYASPQ

SEQ ID NO: 301637 - protein, 8 aa, Influenza virus
CLYASPQL

SEQ ID NO: 301638 - protein, 8 aa, Influenza virus
LYSSPQLE

SEQ ID NO: 301639 - protein, 8 aa, Influenza virus
YSSPQLEG

SEQ ID NO: 301640 - protein, 8 aa, Influenza virus
ESRKMLLI

SEQ ID NO: 301641 - protein, 8 aa, Influenza virus
SRKLLLIA

SEQ ID NO: 301642 - protein, 8 aa, Influenza virus
RKLLLIAQ

SEQ ID NO: 301643 - protein, 8 aa, Influenza virus
KLLLIAQA

SEQ ID NO: 301644 - protein, 8 aa, Influenza virus
LLLIAQAL

SEQ ID NO: 301645 - protein, 8 aa, Influenza virus
LLIAQALR

SEQ ID NO: 301646 - protein, 8 aa, Influenza virus
LIAQALRD

SEQ ID NO: 301647 - protein, 8 aa, Influenza virus
QAFRDNLE

SEQ ID NO: 301648 - protein, 8 aa, Influenza virus
AFRDNLEP

SEQ ID NO: 301649 - protein, 8 aa, Influenza virus
FRDNLEPG

SEQ ID NO: 301650 - protein, 8 aa, Influenza virus
KDNLEPGT

SEQ ID NO: 301651 - protein, 8 aa, Influenza virus
EPGTFDIG

SEQ ID NO: 301652 - protein, 8 aa, Influenza virus
PGTFDIGG

SEQ ID NO: 301653 - protein, 8 aa, Influenza virus
GTFDIGGL

SEQ ID NO: 301654 - protein, 8 aa, Influenza virus
TFDIGGLY

SEQ ID NO: 301655 - protein, 8 aa, Influenza virus
GLYDAIEE

SEQ ID NO: 301656 - protein, 8 aa, Influenza virus
LYDAIEEC

SEQ ID NO: 301657 - protein, 8 aa, Influenza virus
YDAIEECL

SEQ ID NO: 301658 - protein, 8 aa, Influenza virus
DAIEECLI

SEQ ID NO: 301659 - protein, 8 aa, Influenza virus
SWFNSFLV

SEQ ID NO: 301660 - protein, 8 aa, Influenza virus
WFNSFLVH

SEQ ID NO: 301661 - protein, 8 aa, Influenza virus
FLVHALKS

SEQ ID NO: 301662 - protein, 8 aa, Influenza virus
LTHALRFL

SEQ ID NO: 301663 - protein, 8 aa, Influenza virus
PTLLFLKM

SEQ ID NO: 301664 - protein, 8 aa, Influenza virus
TLLFLKMP

SEQ ID NO: 301665 - protein, 8 aa, Influenza virus
LLFLKVPV

SEQ ID NO: 301666 - protein, 8 aa, Influenza virus
LFLKVPVQ

SEQ ID NO: 301667 - protein, 8 aa, Influenza virus
FLKVPVQN

SEQ ID NO: 301668 - protein, 8 aa, Influenza virus
LKVPVQNA

SEQ ID NO: 301669 - protein, 8 aa, Influenza virus
KVPVQNAI

SEQ ID NO: 301670 - protein, 8 aa, Influenza virus
VPVQNAIS

SEQ ID NO: 301671 - protein, 8 aa, Influenza virus
PAQNAISI

SEQ ID NO: 301672 - protein, 8 aa, Influenza virus
AQNAISIT

SEQ ID NO: 301673 - protein, 8 aa, Influenza virus
HQYSERGK

SEQ ID NO: 301674 - protein, 8 aa, Influenza virus
QYSERGKW

SEQ ID NO: 301675 - protein, 8 aa, Influenza virus
NTEIGAPQ

SEQ ID NO: 301676 - protein, 8 aa, Influenza virus
TEIGAPQL

SEQ ID NO: 301677 - protein, 8 aa, Influenza virus
ETKAPQLN

SEQ ID NO: 301678 - protein, 8 aa, Influenza virus
TKAPQLNP

SEQ ID NO: 301679 - protein, 8 aa, Influenza virus
GALQLNPI

SEQ ID NO: 301680 - protein, 8 aa, Influenza virus
PIDGPLPD

SEQ ID NO: 301681 - protein, 8 aa, Influenza virus
NNEPSGYA

SEQ ID NO: 301682 - protein, 8 aa, Influenza virus
NDPSGYAQ

SEQ ID NO: 301683 - protein, 8 aa, Influenza virus
EAMAFLEN

SEQ ID NO: 301684 - protein, 8 aa, Influenza virus
AMAFLENS

SEQ ID NO: 301685 - protein, 8 aa, Influenza virus
MAFLENSH

SEQ ID NO: 301686 - protein, 8 aa, Influenza virus
AFLENSHP

SEQ ID NO: 301687 - protein, 8 aa, Influenza virus
FLENSHPG

SEQ ID NO: 301688 - protein, 8 aa, Influenza virus
LEESHPGL

SEQ ID NO: 301689 - protein, 8 aa, Influenza virus
EESHPGLF

SEQ ID NO: 301690 - protein, 8 aa, Influenza virus
ESHPGLFE

SEQ ID NO: 301691 - protein, 8 aa, Influenza virus
SHPGIFGN

SEQ ID NO: 301692 - protein, 8 aa, Influenza virus
HPGIFGNS

SEQ ID NO: 301693 - protein, 8 aa, Influenza virus
PGIFGNSC

SEQ ID NO: 301694 - protein, 8 aa, Influenza virus
GLFENSCL

SEQ ID NO: 301695 - protein, 8 aa, Influenza virus
LFENSCLE

SEQ ID NO: 301696 - protein, 8 aa, Influenza virus
FGNSCLET

SEQ ID NO: 301697 - protein, 8 aa, Influenza virus
NSCLETIE

SEQ ID NO: 301698 - protein, 8 aa, Influenza virus
VQQTRVDR

SEQ ID NO: 301699 - protein, 8 aa, Influenza virus
NTIEVFRL

SEQ ID NO: 301700 - protein, 8 aa, Influenza virus
TIEVFRLN

SEQ ID NO: 301701 - protein, 8 aa, Influenza virus
NESGRLMD

SEQ ID NO: 301702 - protein, 8 aa, Influenza virus
IDFLKDVV

SEQ ID NO: 301703 - protein, 8 aa, Influenza virus
EIVTHFQR

SEQ ID NO: 301704 - protein, 8 aa, Influenza virus
IVTHFQRK

SEQ ID NO: 301705 - protein, 8 aa, Influenza virus
ITHFQRKR

SEQ ID NO: 301706 - protein, 8 aa, Influenza virus
HRKRRVRD

SEQ ID NO: 301707 - protein, 8 aa, Influenza virus
KRRIRDNM

SEQ ID NO: 301708 - protein, 8 aa, Influenza virus
RRIRDNMT

SEQ ID NO: 301709 - protein, 8 aa, Influenza virus
RIRDNMTK

SEQ ID NO: 301710 - protein, 8 aa, Influenza virus
RDNMTKRM

SEQ ID NO: 301711 - protein, 8 aa, Influenza virus
TKRMVTQR

SEQ ID NO: 301712 - protein, 8 aa, Influenza virus
KRMVTQRT

SEQ ID NO: 301713 - protein, 8 aa, Influenza virus
RMVTQRTI

SEQ ID NO: 301714 - protein, 8 aa, Influenza virus
MVTQRTVG

SEQ ID NO: 301715 - protein, 8 aa, Influenza virus
VTQRTVGK

SEQ ID NO: 301716 - protein, 8 aa, Influenza virus
TQRTIGKR

SEQ ID NO: 301717 - protein, 8 aa, Influenza virus
QRTIGKRK

SEQ ID NO: 301718 - protein, 8 aa, Influenza virus
RTVGKKKQ

SEQ ID NO: 301719 - protein, 8 aa, Influenza virus
NYLIRALT

SEQ ID NO: 301720 - protein, 8 aa, Influenza virus
YIIRALTL

SEQ ID NO: 301721 - protein, 8 aa, Influenza virus
IIRALTLN

SEQ ID NO: 301722 - protein, 8 aa, Influenza virus
GFVHFVEA

SEQ ID NO: 301723 - protein, 8 aa, Influenza virus
FVHFVEAL

SEQ ID NO: 301724 - protein, 8 aa, Influenza virus
VHFVEALA

SEQ ID NO: 301725 - protein, 8 aa, Influenza virus
HFVEALAR

SEQ ID NO: 301726 - protein, 8 aa, Influenza virus
VETLARRI

SEQ ID NO: 301727 - protein, 8 aa, Influenza virus
ETLARRIC

SEQ ID NO: 301728 - protein, 8 aa, Influenza virus
LARCICEK

SEQ ID NO: 301729 - protein, 8 aa, Influenza virus
ARCICEKL

SEQ ID NO: 301730 - protein, 8 aa, Influenza virus
RCICEKLE

SEQ ID NO: 301731 - protein, 8 aa, Influenza virus
CICEKLEQ

SEQ ID NO: 301732 - protein, 8 aa, Influenza virus
TSSQDTEL

SEQ ID NO: 301733 - protein, 8 aa, Influenza virus
SSQDTELS

SEQ ID NO: 301734 - protein, 8 aa, Influenza virus
DTELSFTV

SEQ ID NO: 301735 - protein, 8 aa, Influenza virus
TELSFTVT

SEQ ID NO: 301736 - protein, 8 aa, Influenza virus
ELSFTVTG

SEQ ID NO: 301737 - protein, 8 aa, Influenza virus
NENQNPRI

SEQ ID NO: 301738 - protein, 8 aa, Influenza virus
ENQNPRIF

SEQ ID NO: 301739 - protein, 8 aa, Influenza virus
NQNPRIFL

SEQ ID NO: 301740 - protein, 8 aa, Influenza virus
QNPRVFLA

SEQ ID NO: 301741 - protein, 8 aa, Influenza virus
NPRVFLAM

SEQ ID NO: 301742 - protein, 8 aa, Influenza virus
PRVFLAMI

SEQ ID NO: 301743 - protein, 8 aa, Influenza virus
RVFLAMIT

SEQ ID NO: 301744 - protein, 8 aa, Influenza virus
VFLAMITY

SEQ ID NO: 301745 - protein, 8 aa, Influenza virus
TMITYITR

SEQ ID NO: 301746 - protein, 8 aa, Influenza virus
TYITRKQP

SEQ ID NO: 301747 - protein, 8 aa, Influenza virus
QPGWFRNV

SEQ ID NO: 301748 - protein, 8 aa, Influenza virus
PGWFRNVL

SEQ ID NO: 301749 - protein, 8 aa, Influenza virus
GWFRNVLS

SEQ ID NO: 301750 - protein, 8 aa, Influenza virus
WFRNILSI

SEQ ID NO: 301751 - protein, 8 aa, Influenza virus
FRNILSIA

SEQ ID NO: 301752 - protein, 8 aa, Influenza virus
RNILSIAP

SEQ ID NO: 301753 - protein, 8 aa, Influenza virus
NILSIAPI

SEQ ID NO: 301754 - protein, 8 aa, Influenza virus
ILSIAPIM

SEQ ID NO: 301755 - protein, 8 aa, Influenza virus
LSVAPIMF

SEQ ID NO: 301756 - protein, 8 aa, Influenza virus
SVAPIMFS

SEQ ID NO: 301757 - protein, 8 aa, Influenza virus
VAPIMFSN

SEQ ID NO: 301758 - protein, 8 aa, Influenza virus
NKVARLGK

SEQ ID NO: 301759 - protein, 8 aa, Influenza virus
KVARLGKG

SEQ ID NO: 301760 - protein, 8 aa, Influenza virus
VARLGKGY

SEQ ID NO: 301761 - protein, 8 aa, Influenza virus
GYMFESKN

SEQ ID NO: 301762 - protein, 8 aa, Influenza virus
YMFESKNM

SEQ ID NO: 301763 - protein, 8 aa, Influenza virus
MKLRTQVP

SEQ ID NO: 301764 - protein, 8 aa, Influenza virus
KLRTQVPA

SEQ ID NO: 301765 - protein, 8 aa, Influenza virus
LRTQVPAE

SEQ ID NO: 301766 - protein, 8 aa, Influenza virus
IDLRYFND

SEQ ID NO: 301767 - protein, 8 aa, Influenza virus
KIMKIRPI

SEQ ID NO: 301768 - protein, 8 aa, Influenza virus
IMKIRPIL

SEQ ID NO: 301769 - protein, 8 aa, Influenza virus
GTVSLSPG

SEQ ID NO: 301770 - protein, 8 aa, Influenza virus
TVSLSPGM

SEQ ID NO: 301771 - protein, 8 aa, Influenza virus
SVLNLGQK

SEQ ID NO: 301772 - protein, 8 aa, Influenza virus
ILNLGQKE

SEQ ID NO: 301773 - protein, 8 aa, Influenza virus
LNLGQKEY

SEQ ID NO: 301774 - protein, 8 aa, Influenza virus
NLGQKEYT

SEQ ID NO: 301775 - protein, 8 aa, Influenza virus
TSYWWDGL

SEQ ID NO: 301776 - protein, 8 aa, Influenza virus
SYWWDGLQ

SEQ ID NO: 301777 - protein, 8 aa, Influenza virus
FALIVNAL

SEQ ID NO: 301778 - protein, 8 aa, Influenza virus
EGIQAGVN

SEQ ID NO: 301779 - protein, 8 aa, Influenza virus
GVNRFYRT

SEQ ID NO: 301780 - protein, 8 aa, Influenza virus
VNRFYRTC

SEQ ID NO: 301781 - protein, 8 aa, Influenza virus
NRFYRTCK

SEQ ID NO: 301782 - protein, 8 aa, Influenza virus
FYRICKLV

SEQ ID NO: 301783 - protein, 8 aa, Influenza virus
YRICKLVG

SEQ ID NO: 301784 - protein, 8 aa, Influenza virus
RICKLVGI

SEQ ID NO: 301785 - protein, 8 aa, Influenza virus
ICKLVGIN

SEQ ID NO: 301786 - protein, 8 aa, Influenza virus
VGINMSKR

SEQ ID NO: 301787 - protein, 8 aa, Influenza virus
SIGVTVIR

SEQ ID NO: 301788 - protein, 8 aa, Influenza virus
IGVTVIRN

SEQ ID NO: 301789 - protein, 8 aa, Influenza virus
GVTVIRNN

SEQ ID NO: 301790 - protein, 8 aa, Influenza virus
VTVIRNNM

SEQ ID NO: 301791 - protein, 8 aa, Influenza virus
YRCHRGDM

SEQ ID NO: 301792 - protein, 8 aa, Influenza virus
RCHRGDMQ

SEQ ID NO: 301793 - protein, 8 aa, Influenza virus
CHRGDMQI

SEQ ID NO: 301794 - protein, 8 aa, Influenza virus
QIQTRRAF

SEQ ID NO: 301795 - protein, 8 aa, Influenza virus
IQTRRAFE

SEQ ID NO: 301796 - protein, 8 aa, Influenza virus
QTKRSFEL

SEQ ID NO: 301797 - protein, 8 aa, Influenza virus
TKRSFELK

SEQ ID NO: 301798 - protein, 8 aa, Influenza virus
LLVADGGP

SEQ ID NO: 301799 - protein, 8 aa, Influenza virus
LVADGGPN

SEQ ID NO: 301800 - protein, 8 aa, Influenza virus
VADGGPNL

SEQ ID NO: 301801 - protein, 8 aa, Influenza virus
PEAGLKWE

SEQ ID NO: 301802 - protein, 8 aa, Influenza virus
EAGLKWEL

SEQ ID NO: 301803 - protein, 8 aa, Influenza virus
YKGRLCNP

SEQ ID NO: 301804 - protein, 8 aa, Influenza virus
KGRLCNPL

SEQ ID NO: 301805 - protein, 8 aa, Influenza virus
NPLNPFVT

SEQ ID NO: 301806 - protein, 8 aa, Influenza virus
PLNPFVTH

SEQ ID NO: 301807 - protein, 8 aa, Influenza virus
NPFVNHKE

SEQ ID NO: 301808 - protein, 8 aa, Influenza virus
VEYDAVAT

SEQ ID NO: 301809 - protein, 8 aa, Influenza virus
VATTHSWT

SEQ ID NO: 301810 - protein, 8 aa, Influenza virus
ATTHSWTP

SEQ ID NO: 301811 - protein, 8 aa, Influenza virus
TTHSWTPK

SEQ ID NO: 301812 - protein, 8 aa, Influenza virus
THSWTPKR

SEQ ID NO: 301813 - protein, 8 aa, Influenza virus
HSWTPKRN

SEQ ID NO: 301814 - protein, 8 aa, Influenza virus
SWTPKRNR

SEQ ID NO: 301815 - protein, 8 aa, Influenza virus
WTPKRNRS

SEQ ID NO: 301816 - protein, 8 aa, Influenza virus
TPKRNRSI

SEQ ID NO: 301817 - protein, 8 aa, Influenza virus
QMYQKCCS

SEQ ID NO: 301818 - protein, 8 aa, Influenza virus
MYQKCCSL

SEQ ID NO: 301819 - protein, 8 aa, Influenza virus
YQKCCSLF

SEQ ID NO: 301820 - protein, 8 aa, Influenza virus
QKCCSLFE

SEQ ID NO: 301821 - protein, 8 aa, Influenza virus
KCCSLFEK

SEQ ID NO: 301822 - protein, 8 aa, Influenza virus
CCTLFEKF

SEQ ID NO: 301823 - protein, 8 aa, Influenza virus
CTLFEKFF

SEQ ID NO: 301824 - protein, 8 aa, Influenza virus
TLFEKFFP

SEQ ID NO: 301825 - protein, 8 aa, Influenza virus
PVGISSMG

SEQ ID NO: 301826 - protein, 8 aa, Influenza virus
VGISSMGE

SEQ ID NO: 301827 - protein, 8 aa, Influenza virus
GISSMGEA

SEQ ID NO: 301828 - protein, 8 aa, Influenza virus
ISSMGEAM

SEQ ID NO: 301829 - protein, 8 aa, Influenza virus
SSMGEAMV

SEQ ID NO: 301830 - protein, 8 aa, Influenza virus
SMGEAMVS

SEQ ID NO: 301831 - protein, 8 aa, Influenza virus
MGEAMVSR

SEQ ID NO: 301832 - protein, 8 aa, Influenza virus
GEAMVSRA

SEQ ID NO: 301833 - protein, 8 aa, Influenza virus
EAMMSRAR

SEQ ID NO: 301834 - protein, 8 aa, Influenza virus
AMMSRARI

SEQ ID NO: 301835 - protein, 8 aa, Influenza virus
MMSRARID

SEQ ID NO: 301836 - protein, 8 aa, Influenza virus
MSRARIDA

SEQ ID NO: 301837 - protein, 8 aa, Influenza virus
IDFESGRM

SEQ ID NO: 301838 - protein, 8 aa, Influenza virus
SKSRSIIF

SEQ ID NO: 301839 - protein, 8 aa, Influenza virus
KSRSIIFN

SEQ ID NO: 301840 - protein, 8 aa, Influenza virus
TLMSQSRT

SEQ ID NO: 301841 - protein, 8 aa, Influenza virus
MSQSRTRG

SEQ ID NO: 301842 - protein, 8 aa, Influenza virus
SQSRTRGI

SEQ ID NO: 301843 - protein, 8 aa, Influenza virus
TREILTKI

SEQ ID NO: 301844 - protein, 8 aa, Influenza virus
REILTKIT

SEQ ID NO: 301845 - protein, 8 aa, Influenza virus
EILTKITV

SEQ ID NO: 301846 - protein, 8 aa, Influenza virus
ARQEKNPA

SEQ ID NO: 301847 - protein, 8 aa, Influenza virus
MKYPITAE

SEQ ID NO: 301848 - protein, 8 aa, Influenza virus
KYPITADR

SEQ ID NO: 301849 - protein, 8 aa, Influenza virus
IPERNEHG

SEQ ID NO: 301850 - protein, 8 aa, Influenza virus
RNEQGQIL

SEQ ID NO: 301851 - protein, 8 aa, Influenza virus
NEQGQILW

SEQ ID NO: 301852 - protein, 8 aa, Influenza virus
DAGSDRVI

SEQ ID NO: 301853 - protein, 8 aa, Influenza virus
GSDRLMVS

SEQ ID NO: 301854 - protein, 8 aa, Influenza virus
IVSPLAVT

SEQ ID NO: 301855 - protein, 8 aa, Influenza virus
AVTWWNRS

SEQ ID NO: 301856 - protein, 8 aa, Influenza virus
HYPKVYRT

SEQ ID NO: 301857 - protein, 8 aa, Influenza virus
YPKVYRTY

SEQ ID NO: 301858 - protein, 8 aa, Influenza virus
PKVYRTYF

SEQ ID NO: 301859 - protein, 8 aa, Influenza virus
KIYKTYFE

SEQ ID NO: 301860 - protein, 8 aa, Influenza virus
IYKTYFEK

SEQ ID NO: 301861 - protein, 8 aa, Influenza virus
IFGPVHFR

SEQ ID NO: 301862 - protein, 8 aa, Influenza virus
FGPVHFRS

SEQ ID NO: 301863 - protein, 8 aa, Influenza virus
GPVHFRSQ

SEQ ID NO: 301864 - protein, 8 aa, Influenza virus
PVHFQNQV

SEQ ID NO: 301865 - protein, 8 aa, Influenza virus
VHFQNQVK

SEQ ID NO: 301866 - protein, 8 aa, Influenza virus
HFQNQVKI

SEQ ID NO: 301867 - protein, 8 aa, Influenza virus
FQNQVKIR

SEQ ID NO: 301868 - protein, 8 aa, Influenza virus
QNQVKIRR

SEQ ID NO: 301869 - protein, 8 aa, Influenza virus
KIRRRVDV

SEQ ID NO: 301870 - protein, 8 aa, Influenza virus
IRRRVDVN

SEQ ID NO: 301871 - protein, 8 aa, Influenza virus
RRRVDVNP

SEQ ID NO: 301872 - protein, 8 aa, Influenza virus
RRVDVNPG

SEQ ID NO: 301873 - protein, 8 aa, Influenza virus
RVDVNPGH

SEQ ID NO: 301874 - protein, 8 aa, Influenza virus
VDVNPGHA

SEQ ID NO: 301875 - protein, 8 aa, Influenza virus
DVNPGHAD

SEQ ID NO: 301876 - protein, 8 aa, Influenza virus
VNPGHADL

SEQ ID NO: 301877 - protein, 8 aa, Influenza virus
NPGHADIS

SEQ ID NO: 301878 - protein, 8 aa, Influenza virus
DLNAKEAQ

SEQ ID NO: 301879 - protein, 8 aa, Influenza virus
LNAKEAQD

SEQ ID NO: 301880 - protein, 8 aa, Influenza virus
NAKEAQDV

SEQ ID NO: 301881 - protein, 8 aa, Influenza virus
TKEAQDVI

SEQ ID NO: 301882 - protein, 8 aa, Influenza virus
EVGARIIT

SEQ ID NO: 301883 - protein, 8 aa, Influenza virus
VGARIITS

SEQ ID NO: 301884 - protein, 8 aa, Influenza virus
GARIITSE

SEQ ID NO: 301885 - protein, 8 aa, Influenza virus
ARIITSES

SEQ ID NO: 301886 - protein, 8 aa, Influenza virus
RIITSESQ

SEQ ID NO: 301887 - protein, 8 aa, Influenza virus
IITSESQL

SEQ ID NO: 301888 - protein, 8 aa, Influenza virus
TKEKKKEL

SEQ ID NO: 301889 - protein, 8 aa, Influenza virus
IAPLMMAY

SEQ ID NO: 301890 - protein, 8 aa, Influenza virus
KTRFLPVT

SEQ ID NO: 301891 - protein, 8 aa, Influenza virus
TRFLPVTG

SEQ ID NO: 301892 - protein, 8 aa, Influenza virus
RFLPVTGG

SEQ ID NO: 301893 - protein, 8 aa, Influenza virus
FLPVTGGT

SEQ ID NO: 301894 - protein, 8 aa, Influenza virus
LPVSGGTS

SEQ ID NO: 301895 - protein, 8 aa, Influenza virus
PVSGGTSS

SEQ ID NO: 301896 - protein, 8 aa, Influenza virus
GGTSSIYI

SEQ ID NO: 301897 - protein, 8 aa, Influenza virus
GTSSIYIE

SEQ ID NO: 301898 - protein, 8 aa, Influenza virus
TSSIYIEV

SEQ ID NO: 301899 - protein, 8 aa, Influenza virus
SSIYIEVL

SEQ ID NO: 301900 - protein, 8 aa, Influenza virus
SVYVEVLH

SEQ ID NO: 301901 - protein, 8 aa, Influenza virus
VYVEVLHL

SEQ ID NO: 301902 - protein, 8 aa, Influenza virus
QGTCWEQL

SEQ ID NO: 301903 - protein, 8 aa, Influenza virus
GTCWEQLY

SEQ ID NO: 301904 - protein, 8 aa, Influenza virus
TCWEQLYT

SEQ ID NO: 301905 - protein, 8 aa, Influenza virus
QLYTPGGE

SEQ ID NO: 301906 - protein, 8 aa, Influenza virus
LYTPGGEV

SEQ ID NO: 301907 - protein, 8 aa, Influenza virus
YTPGGEVK

SEQ ID NO: 301908 - protein, 8 aa, Influenza virus
TPGGEVKN

SEQ ID NO: 301909 - protein, 8 aa, Influenza virus
PGGEVKND

SEQ ID NO: 301910 - protein, 8 aa, Influenza virus
GGEVKNDD

SEQ ID NO: 301911 - protein, 8 aa, Influenza virus
VKNDDVDQ

SEQ ID NO: 301912 - protein, 8 aa, Influenza virus
KNDDVDQS

SEQ ID NO: 301913 - protein, 8 aa, Influenza virus
DDVDQSLV

SEQ ID NO: 301914 - protein, 8 aa, Influenza virus
DVDQSLVI

SEQ ID NO: 301915 - protein, 8 aa, Influenza virus
VDQSLVIA

SEQ ID NO: 301916 - protein, 8 aa, Influenza virus
SLVIAARN

SEQ ID NO: 301917 - protein, 8 aa, Influenza virus
LVIAARNI

SEQ ID NO: 301918 - protein, 8 aa, Influenza virus
VIAARNIV

SEQ ID NO: 301919 - protein, 8 aa, Influenza virus
RSIVRRAT

SEQ ID NO: 301920 - protein, 8 aa, Influenza virus
SIVRRATV

SEQ ID NO: 301921 - protein, 8 aa, Influenza virus
IVRRAIVS

SEQ ID NO: 301922 - protein, 8 aa, Influenza virus
VRRAIVSA

SEQ ID NO: 301923 - protein, 8 aa, Influenza virus
RRAIVSAD

SEQ ID NO: 301924 - protein, 8 aa, Influenza virus
RAIVSADP

SEQ ID NO: 301925 - protein, 8 aa, Influenza virus
AIVSADPL

SEQ ID NO: 301926 - protein, 8 aa, Influenza virus
IVSADPLA

SEQ ID NO: 301927 - protein, 8 aa, Influenza virus
LEMCHGTQ

SEQ ID NO: 301928 - protein, 8 aa, Influenza virus
EMCHGTQI

SEQ ID NO: 301929 - protein, 8 aa, Influenza virus
MCHGTQIG

SEQ ID NO: 301930 - protein, 8 aa, Influenza virus
CHGTQIGG

SEQ ID NO: 301931 - protein, 8 aa, Influenza virus
DILKHNPT

SEQ ID NO: 301932 - protein, 8 aa, Influenza virus
ILKHNPTE

SEQ ID NO: 301933 - protein, 8 aa, Influenza virus
LKHNPTEE

SEQ ID NO: 301934 - protein, 8 aa, Influenza virus
PTEEQAVN

SEQ ID NO: 301935 - protein, 8 aa, Influenza virus
TEEQAVNI

SEQ ID NO: 301936 - protein, 8 aa, Influenza virus
EEQAVNIC

SEQ ID NO: 301937 - protein, 8 aa, Influenza virus
EQAVNICK

SEQ ID NO: 301938 - protein, 8 aa, Influenza virus
QAVNICKA

SEQ ID NO: 301939 - protein, 8 aa, Influenza virus
AVNICKAA

SEQ ID NO: 301940 - protein, 8 aa, Influenza virus
VGICKAAM

SEQ ID NO: 301941 - protein, 8 aa, Influenza virus
GICKAAMG

SEQ ID NO: 301942 - protein, 8 aa, Influenza virus
ICKAALGL

SEQ ID NO: 301943 - protein, 8 aa, Influenza virus
CKAALGLR

SEQ ID NO: 301944 - protein, 8 aa, Influenza virus
KAALGLRI

SEQ ID NO: 301945 - protein, 8 aa, Influenza virus
AALGLRIS

SEQ ID NO: 301946 - protein, 8 aa, Influenza virus
ALGLRISS

SEQ ID NO: 301947 - protein, 8 aa, Influenza virus
LGLRISSS

SEQ ID NO: 301948 - protein, 8 aa, Influenza virus
GFTFKRTN

SEQ ID NO: 301949 - protein, 8 aa, Influenza virus
TFKRTKGF

SEQ ID NO: 301950 - protein, 8 aa, Influenza virus
FKRTKGFS

SEQ ID NO: 301951 - protein, 8 aa, Influenza virus
EEELLTGN

SEQ ID NO: 301952 - protein, 8 aa, Influenza virus
EELLTGNL

SEQ ID NO: 301953 - protein, 8 aa, Influenza virus
VLTGNLQA

SEQ ID NO: 301954 - protein, 8 aa, Influenza virus
GNLQTLRI

SEQ ID NO: 301955 - protein, 8 aa, Influenza virus
VYEGYEEF

SEQ ID NO: 301956 - protein, 8 aa, Influenza virus
HEGFEEFT

SEQ ID NO: 301957 - protein, 8 aa, Influenza virus
EGYEEFTI

SEQ ID NO: 301958 - protein, 8 aa, Influenza virus
GYEEFTIV

SEQ ID NO: 301959 - protein, 8 aa, Influenza virus
YEEFTIVG

SEQ ID NO: 301960 - protein, 8 aa, Influenza virus
VGQRATAI

SEQ ID NO: 301961 - protein, 8 aa, Influenza virus
RATAIIRK

SEQ ID NO: 301962 - protein, 8 aa, Influenza virus
ATAIIRKA

SEQ ID NO: 301963 - protein, 8 aa, Influenza virus
TAIIRKAT

SEQ ID NO: 301964 - protein, 8 aa, Influenza virus
AILRKATK

SEQ ID NO: 301965 - protein, 8 aa, Influenza virus
KKATRRLI

SEQ ID NO: 301966 - protein, 8 aa, Influenza virus
KATRRMIQ

SEQ ID NO: 301967 - protein, 8 aa, Influenza virus
ATRRMIQL

SEQ ID NO: 301968 - protein, 8 aa, Influenza virus
TRRMIQLI

SEQ ID NO: 301969 - protein, 8 aa, Influenza virus
RRMIQLIV

SEQ ID NO: 301970 - protein, 8 aa, Influenza virus
RMIQLIVS

SEQ ID NO: 301971 - protein, 8 aa, Influenza virus
MIQLIVSG

SEQ ID NO: 301972 - protein, 8 aa, Influenza virus
VQLIVSGK

SEQ ID NO: 301973 - protein, 8 aa, Influenza virus
QLIVSGRN

SEQ ID NO: 301974 - protein, 8 aa, Influenza virus
IVSGRNEQ

SEQ ID NO: 301975 - protein, 8 aa, Influenza virus
VSGRNEQS

SEQ ID NO: 301976 - protein, 8 aa, Influenza virus
SGRNEQSI

SEQ ID NO: 301977 - protein, 8 aa, Influenza virus
FSQEECMI

SEQ ID NO: 301978 - protein, 8 aa, Influenza virus
SQEECMIK

SEQ ID NO: 301979 - protein, 8 aa, Influenza virus
QEECMIKA

SEQ ID NO: 301980 - protein, 8 aa, Influenza virus
EECMIKAV

SEQ ID NO: 301981 - protein, 8 aa, Influenza virus
ECMIKAVR

SEQ ID NO: 301982 - protein, 8 aa, Influenza virus
CMMKAVRG

SEQ ID NO: 301983 - protein, 8 aa, Influenza virus
MMKAVRGD

SEQ ID NO: 301984 - protein, 8 aa, Influenza virus
RHFQKNAK

SEQ ID NO: 301985 - protein, 8 aa, Influenza virus
HFQKDARV

SEQ ID NO: 301986 - protein, 8 aa, Influenza virus
FQKDARVL

SEQ ID NO: 301987 - protein, 8 aa, Influenza virus
VMGMIGVL

SEQ ID NO: 301988 - protein, 8 aa, Influenza virus
MGMIGVLP

SEQ ID NO: 301989 - protein, 8 aa, Influenza virus
GMIGVLPD

SEQ ID NO: 301990 - protein, 8 aa, Influenza virus
GILPDLTP

SEQ ID NO: 301991 - protein, 8 aa, Influenza virus
RVSKVGVD

SEQ ID NO: 301992 - protein, 8 aa, Influenza virus
VSKVGVDE

SEQ ID NO: 301993 - protein, 8 aa, Influenza virus
SKTGVDEY

SEQ ID NO: 301994 - protein, 8 aa, Influenza virus
KTGVDEYS

SEQ ID NO: 301995 - protein, 8 aa, Influenza virus
VGVDEYSS

SEQ ID NO: 301996 - protein, 8 aa, Influenza virus
GVDEYSSA

SEQ ID NO: 301997 - protein, 8 aa, Influenza virus
VDEYSSAE

SEQ ID NO: 301998 - protein, 8 aa, Influenza virus
DEYSNAEK

SEQ ID NO: 301999 - protein, 8 aa, Influenza virus
VVNIDRFL

SEQ ID NO: 302000 - protein, 8 aa, Influenza virus
FLRVKDQQ

SEQ ID NO: 302001 - protein, 8 aa, Influenza virus
LRVKDQQG

SEQ ID NO: 302002 - protein, 8 aa, Influenza virus
RVKDQQGN

SEQ ID NO: 302003 - protein, 8 aa, Influenza virus
DQRGNILL

SEQ ID NO: 302004 - protein, 8 aa, Influenza virus
RGNILLSP

SEQ ID NO: 302005 - protein, 8 aa, Influenza virus
EVSETQGM

SEQ ID NO: 302006 - protein, 8 aa, Influenza virus
VSETQGME

SEQ ID NO: 302007 - protein, 8 aa, Influenza virus
QGMEKLTI

SEQ ID NO: 302008 - protein, 8 aa, Influenza virus
EKLTIIYS

SEQ ID NO: 302009 - protein, 8 aa, Influenza virus
KLTIIYSS

SEQ ID NO: 302010 - protein, 8 aa, Influenza virus
LTITYSSP

SEQ ID NO: 302011 - protein, 8 aa, Influenza virus
TIIYSSSM

SEQ ID NO: 302012 - protein, 8 aa, Influenza virus
IIYSSSMM

SEQ ID NO: 302013 - protein, 8 aa, Influenza virus
IYSSSMMW

SEQ ID NO: 302014 - protein, 8 aa, Influenza virus
YSSPMMWE

SEQ ID NO: 302015 - protein, 8 aa, Influenza virus
SSSMMWEV

SEQ ID NO: 302016 - protein, 8 aa, Influenza virus
SSMMWEVN

SEQ ID NO: 302017 - protein, 8 aa, Influenza virus
SMMWEVNG

SEQ ID NO: 302018 - protein, 8 aa, Influenza virus
MMWEVNGP

SEQ ID NO: 302019 - protein, 8 aa, Influenza virus
MWEINGPD

SEQ ID NO: 302020 - protein, 8 aa, Influenza virus
WEINGPDS

SEQ ID NO: 302021 - protein, 8 aa, Influenza virus
EINGPDSV

SEQ ID NO: 302022 - protein, 8 aa, Influenza virus
INGPDSVL

SEQ ID NO: 302023 - protein, 8 aa, Influenza virus
NGPDSVLV

SEQ ID NO: 302024 - protein, 8 aa, Influenza virus
GPDSVLVN

SEQ ID NO: 302025 - protein, 8 aa, Influenza virus
PDSVLVNT

SEQ ID NO: 302026 - protein, 8 aa, Influenza virus
LVNTYQWV

SEQ ID NO: 302027 - protein, 8 aa, Influenza virus
VNTYQWVI

SEQ ID NO: 302028 - protein, 8 aa, Influenza virus
NTYQWIIK

SEQ ID NO: 302029 - protein, 8 aa, Influenza virus
TYQWIIKN

SEQ ID NO: 302030 - protein, 8 aa, Influenza virus
YQWIIKNW

SEQ ID NO: 302031 - protein, 8 aa, Influenza virus
QWIIKNWE

SEQ ID NO: 302032 - protein, 8 aa, Influenza virus
KIQWSQEP

SEQ ID NO: 302033 - protein, 8 aa, Influenza virus
IQWSQNPT

SEQ ID NO: 302034 - protein, 8 aa, Influenza virus
LYNKVEFE

SEQ ID NO: 302035 - protein, 8 aa, Influenza virus
YNKVEFEP

SEQ ID NO: 302036 - protein, 8 aa, Influenza virus
NKVEFEPF

SEQ ID NO: 302037 - protein, 8 aa, Influenza virus
KVEFEPFQ

SEQ ID NO: 302038 - protein, 8 aa, Influenza virus
VEFEPFQS

SEQ ID NO: 302039 - protein, 8 aa, Influenza virus
PFQSLIPK

SEQ ID NO: 302040 - protein, 8 aa, Influenza virus
FQSLIPKA

SEQ ID NO: 302041 - protein, 8 aa, Influenza virus
RSQYSGFV

SEQ ID NO: 302042 - protein, 8 aa, Influenza virus
SQYSGFVR

SEQ ID NO: 302043 - protein, 8 aa, Influenza virus
LYSGFVRT

SEQ ID NO: 302044 - protein, 8 aa, Influenza virus
RDVIGTFD

SEQ ID NO: 302045 - protein, 8 aa, Influenza virus
DVIGTFDT

SEQ ID NO: 302046 - protein, 8 aa, Influenza virus
LGTFDTAQ

SEQ ID NO: 302047 - protein, 8 aa, Influenza virus
GTFDTAQI

SEQ ID NO: 302048 - protein, 8 aa, Influenza virus
TFDTAQII

SEQ ID NO: 302049 - protein, 8 aa, Influenza virus
FDTAQIIK

SEQ ID NO: 302050 - protein, 8 aa, Influenza virus
TAQIIKLL

SEQ ID NO: 302051 - protein, 8 aa, Influenza virus
AQIIKLLP

SEQ ID NO: 302052 - protein, 8 aa, Influenza virus
PFAAAPPV

SEQ ID NO: 302053 - protein, 8 aa, Influenza virus
FAAAPPVQ

SEQ ID NO: 302054 - protein, 8 aa, Influenza virus
AAAPPVQS

SEQ ID NO: 302055 - protein, 8 aa, Influenza virus
SAPPEQSR

SEQ ID NO: 302056 - protein, 8 aa, Influenza virus
APPVQSRM

SEQ ID NO: 302057 - protein, 8 aa, Influenza virus
PPVQSKMQ

SEQ ID NO: 302058 - protein, 8 aa, Influenza virus
PVQSRMQF

SEQ ID NO: 302059 - protein, 8 aa, Influenza virus
VQSKMQFS

SEQ ID NO: 302060 - protein, 8 aa, Influenza virus
FSSLAVNV

SEQ ID NO: 302061 - protein, 8 aa, Influenza virus
SSLAVNVR

SEQ ID NO: 302062 - protein, 8 aa, Influenza virus
LTVSVRGS

SEQ ID NO: 302063 - protein, 8 aa, Influenza virus
TVSVRGSG

SEQ ID NO: 302064 - protein, 8 aa, Influenza virus
VNVRGTGM

SEQ ID NO: 302065 - protein, 8 aa, Influenza virus
NVRGTGMR

SEQ ID NO: 302066 - protein, 8 aa, Influenza virus
VRGTGMRI

SEQ ID NO: 302067 - protein, 8 aa, Influenza virus
RGTGMRIL

SEQ ID NO: 302068 - protein, 8 aa, Influenza virus
GSGMRILI

SEQ ID NO: 302069 - protein, 8 aa, Influenza virus
SGMRILIR

SEQ ID NO: 302070 - protein, 8 aa, Influenza virus
GMRILIRG

SEQ ID NO: 302071 - protein, 8 aa, Influenza virus
MRILIRGN

SEQ ID NO: 302072 - protein, 8 aa, Influenza virus
LVRGNSPA

SEQ ID NO: 302073 - protein, 8 aa, Influenza virus
VRGNSPAF

SEQ ID NO: 302074 - protein, 8 aa, Influenza virus
RGNSPAFN

SEQ ID NO: 302075 - protein, 8 aa, Influenza virus
GNSPAFNY

SEQ ID NO: 302076 - protein, 8 aa, Influenza virus
NSPAFNYN

SEQ ID NO: 302077 - protein, 8 aa, Influenza virus
SPIFNYNK

SEQ ID NO: 302078 - protein, 8 aa, Influenza virus
TKRLTIIG

SEQ ID NO: 302079 - protein, 8 aa, Influenza virus
KRLTIIGK

SEQ ID NO: 302080 - protein, 8 aa, Influenza virus
RLTIIGKD

SEQ ID NO: 302081 - protein, 8 aa, Influenza virus
LGKDAGSL

SEQ ID NO: 302082 - protein, 8 aa, Influenza virus
TGVESAVL

SEQ ID NO: 302083 - protein, 8 aa, Influenza virus
RGFLILGR

SEQ ID NO: 302084 - protein, 8 aa, Influenza virus
GFLILGRE

SEQ ID NO: 302085 - protein, 8 aa, Influenza virus
FLILGKEN

SEQ ID NO: 302086 - protein, 8 aa, Influenza virus
LILGKEDR

SEQ ID NO: 302087 - protein, 8 aa, Influenza virus
GREDKRYG

SEQ ID NO: 302088 - protein, 8 aa, Influenza virus
REDKRYGP

SEQ ID NO: 302089 - protein, 8 aa, Influenza virus
ENKRYGPA

SEQ ID NO: 302090 - protein, 8 aa, Influenza virus
NKRYGPAL

SEQ ID NO: 302091 - protein, 8 aa, Influenza virus
KKYGPALS

SEQ ID NO: 302092 - protein, 8 aa, Influenza virus
ALSINELG

SEQ ID NO: 302093 - protein, 8 aa, Influenza virus
LSINELSK

SEQ ID NO: 302094 - protein, 8 aa, Influenza virus
LARGEKAN

SEQ ID NO: 302095 - protein, 8 aa, Influenza virus
ARGEKANV

SEQ ID NO: 302096 - protein, 8 aa, Influenza virus
TKRIRMAT

SEQ ID NO: 302097 - protein, 8 aa, Influenza virus
IRMAINWG

SEQ ID NO: 302098 - protein, 8 aa, Influenza virus
KRKKRGLF

SEQ ID NO: 302099 - protein, 8 aa, Influenza virus
KTRGLFGA

SEQ ID NO: 302100 - protein, 8 aa, Influenza virus
QMTRGLFG

SEQ ID NO: 302101 - protein, 8 aa, Influenza virus
ARGLFGAI

SEQ ID NO: 302102 - protein, 8 aa, Influenza virus
DFRDMRKN

SEQ ID NO: 302103 - protein, 8 aa, Influenza virus
GVKMNPNQ

SEQ ID NO: 302104 - protein, 8 aa, Influenza virus
VKMNPNQK

SEQ ID NO: 302105 - protein, 8 aa, Influenza virus
RTQESECQ

SEQ ID NO: 302106 - protein, 8 aa, Influenza virus
TQESECQC

SEQ ID NO: 302107 - protein, 8 aa, Influenza virus
IRHLEECS

SEQ ID NO: 302108 - protein, 8 aa, Influenza virus
YYEECSCY

SEQ ID NO: 302109 - protein, 8 aa, Influenza virus
IEECSCYG

SEQ ID NO: 302110 - protein, 8 aa, Influenza virus
GWAVHSKD

SEQ ID NO: 302111 - protein, 8 aa, Influenza virus
WAVHSKDN

SEQ ID NO: 302112 - protein, 8 aa, Influenza virus
SKDNGIRI

SEQ ID NO: 302113 - protein, 8 aa, Influenza virus
KDNNIRIG

SEQ ID NO: 302114 - protein, 8 aa, Influenza virus
DNNIRIGS

SEQ ID NO: 302115 - protein, 8 aa, Influenza virus
NSIRIGSR

SEQ ID NO: 302116 - protein, 8 aa, Influenza virus
SIRIGSRG

SEQ ID NO: 302117 - protein, 8 aa, Influenza virus
GDVFVMRE

SEQ ID NO: 302118 - protein, 8 aa, Influenza virus
DVFVMREP

SEQ ID NO: 302119 - protein, 8 aa, Influenza virus
VFVMREPF

SEQ ID NO: 302120 - protein, 8 aa, Influenza virus
DKHSNGTA

SEQ ID NO: 302121 - protein, 8 aa, Influenza virus
DRSPHRAL

SEQ ID NO: 302122 - protein, 8 aa, Influenza virus
RALMSCPI

SEQ ID NO: 302123 - protein, 8 aa, Influenza virus
ALMSCPIG

SEQ ID NO: 302124 - protein, 8 aa, Influenza virus
SCPIGEAP

SEQ ID NO: 302125 - protein, 8 aa, Influenza virus
PIGEAPSP

SEQ ID NO: 302126 - protein, 8 aa, Influenza virus
IGEAPSPY

SEQ ID NO: 302127 - protein, 8 aa, Influenza virus
ASACHDGL

SEQ ID NO: 302128 - protein, 8 aa, Influenza virus
GWITIGIS

SEQ ID NO: 302129 - protein, 8 aa, Influenza virus
GISGPDSG

SEQ ID NO: 302130 - protein, 8 aa, Influenza virus
ISGPDSGA

SEQ ID NO: 302131 - protein, 8 aa, Influenza virus
SGPDSGAV

SEQ ID NO: 302132 - protein, 8 aa, Influenza virus
GPDSGAVA

SEQ ID NO: 302133 - protein, 8 aa, Influenza virus
PDSGAVAV

SEQ ID NO: 302134 - protein, 8 aa, Influenza virus
DSGAVAVL

SEQ ID NO: 302135 - protein, 8 aa, Influenza virus
SGAVAVLK

SEQ ID NO: 302136 - protein, 8 aa, Influenza virus
AVLKYKGI

SEQ ID NO: 302137 - protein, 8 aa, Influenza virus
VLKYKGII

SEQ ID NO: 302138 - protein, 8 aa, Influenza virus
LKYKGIIT

SEQ ID NO: 302139 - protein, 8 aa, Influenza virus
ITDTVKSW

SEQ ID NO: 302140 - protein, 8 aa, Influenza virus
CLNGSCFT

SEQ ID NO: 302141 - protein, 8 aa, Influenza virus
NGFCFTVM

SEQ ID NO: 302142 - protein, 8 aa, Influenza virus
GSCFTLMT

SEQ ID NO: 302143 - protein, 8 aa, Influenza virus
SCFTLMTD

SEQ ID NO: 302144 - protein, 8 aa, Influenza virus
TVMTDGPN

SEQ ID NO: 302145 - protein, 8 aa, Influenza virus
APNSHYEE

SEQ ID NO: 302146 - protein, 8 aa, Influenza virus
PNSHYEEC

SEQ ID NO: 302147 - protein, 8 aa, Influenza virus
NSHYEECS

SEQ ID NO: 302148 - protein, 8 aa, Influenza virus
SHYEECSC

SEQ ID NO: 302149 - protein, 8 aa, Influenza virus
ECSCYPES

SEQ ID NO: 302150 - protein, 8 aa, Influenza virus
ICVCRDNW

SEQ ID NO: 302151 - protein, 8 aa, Influenza virus
GANRPWVS

SEQ ID NO: 302152 - protein, 8 aa, Influenza virus
RPWISFNQ

SEQ ID NO: 302153 - protein, 8 aa, Influenza virus
YQVGYICS

SEQ ID NO: 302154 - protein, 8 aa, Influenza virus
QVGYICSG

SEQ ID NO: 302155 - protein, 8 aa, Influenza virus
VGYICSGV

SEQ ID NO: 302156 - protein, 8 aa, Influenza virus
CSGVLGDN

SEQ ID NO: 302157 - protein, 8 aa, Influenza virus
SGVLGDNP

SEQ ID NO: 302158 - protein, 8 aa, Influenza virus
GVLGDNPR

SEQ ID NO: 302159 - protein, 8 aa, Influenza virus
VFGDSPRP

SEQ ID NO: 302160 - protein, 8 aa, Influenza virus
GIKGFSFK

SEQ ID NO: 302161 - protein, 8 aa, Influenza virus
IKGFSFKY

SEQ ID NO: 302162 - protein, 8 aa, Influenza virus
KGFSYKYD

SEQ ID NO: 302163 - protein, 8 aa, Influenza virus
KYGNGVWM

SEQ ID NO: 302164 - protein, 8 aa, Influenza virus
YGNGVWMG

SEQ ID NO: 302165 - protein, 8 aa, Influenza virus
GNGVWMGR

SEQ ID NO: 302166 - protein, 8 aa, Influenza virus
IWDPNGWS

SEQ ID NO: 302167 - protein, 8 aa, Influenza virus
TNWSGYSG

SEQ ID NO: 302168 - protein, 8 aa, Influenza virus
HPELTGMD

SEQ ID NO: 302169 - protein, 8 aa, Influenza virus
PELTGMDC

SEQ ID NO: 302170 - protein, 8 aa, Influenza virus
NCMRPCFW

SEQ ID NO: 302171 - protein, 8 aa, Influenza virus
WVELVRGR

SEQ ID NO: 302172 - protein, 8 aa, Influenza virus
VELVRGRP

SEQ ID NO: 302173 - protein, 8 aa, Influenza virus
TIWTSGSI

SEQ ID NO: 302174 - protein, 8 aa, Influenza virus
IWTSGSII

SEQ ID NO: 302175 - protein, 8 aa, Influenza virus
IISFCGVN

SEQ ID NO: 302176 - protein, 8 aa, Influenza virus
DWSWPDGA

SEQ ID NO: 302177 - protein, 8 aa, Influenza virus
SWPDDAEL

SEQ ID NO: 302178 - protein, 8 aa, Influenza virus
WPDDAELP

SEQ ID NO: 302179 - protein, 8 aa, Influenza virus
PDGAKLPF

SEQ ID NO: 302180 - protein, 8 aa, Influenza virus
GFAPFTKD

SEQ ID NO: 302181 - protein, 8 aa, Influenza virus
FAPFTKDN

SEQ ID NO: 302182 - protein, 8 aa, Influenza virus
APFTKDNS

SEQ ID NO: 302183 - protein, 8 aa, Influenza virus
PLSKDNSI

SEQ ID NO: 302184 - protein, 8 aa, Influenza virus
LSKDNSIR

SEQ ID NO: 302185 - protein, 8 aa, Influenza virus
SKDNSVRL

SEQ ID NO: 302186 - protein, 8 aa, Influenza virus
NSIRLAAG

SEQ ID NO: 302187 - protein, 8 aa, Influenza virus
VWVTREPY

SEQ ID NO: 302188 - protein, 8 aa, Influenza virus
REPYVSCE

SEQ ID NO: 302189 - protein, 8 aa, Influenza virus
PYRTLLMS

SEQ ID NO: 302190 - protein, 8 aa, Influenza virus
YRTLLMSE

SEQ ID NO: 302191 - protein, 8 aa, Influenza virus
IPFHLGTK

SEQ ID NO: 302192 - protein, 8 aa, Influenza virus
TRQVCMAW

SEQ ID NO: 302193 - protein, 8 aa, Influenza virus
RQVCMAWS

SEQ ID NO: 302194 - protein, 8 aa, Influenza virus
SSCHDGNA

SEQ ID NO: 302195 - protein, 8 aa, Influenza virus
SCHDGNAW

SEQ ID NO: 302196 - protein, 8 aa, Influenza virus
DGNAWLHV

SEQ ID NO: 302197 - protein, 8 aa, Influenza virus
GNAWLHVC

SEQ ID NO: 302198 - protein, 8 aa, Influenza virus
NATASLIY

SEQ ID NO: 302199 - protein, 8 aa, Influenza virus
DILRTQES

SEQ ID NO: 302200 - protein, 8 aa, Influenza virus
SECVCIDG

SEQ ID NO: 302201 - protein, 8 aa, Influenza virus
MTDGSASD

SEQ ID NO: 302202 - protein, 8 aa, Influenza virus
ECSCYPRH

SEQ ID NO: 302203 - protein, 8 aa, Influenza virus
WRGSNRPI

SEQ ID NO: 302204 - protein, 8 aa, Influenza virus
LVGDTPRD

SEQ ID NO: 302205 - protein, 8 aa, Influenza virus
VKGWAFDY

SEQ ID NO: 302206 - protein, 8 aa, Influenza virus
RAGYETFR

SEQ ID NO: 302207 - protein, 8 aa, Influenza virus
AGYETFRV

SEQ ID NO: 302208 - protein, 8 aa, Influenza virus
GYETFKVV

SEQ ID NO: 302209 - protein, 8 aa, Influenza virus
WWTANSII

SEQ ID NO: 302210 - protein, 8 aa, Influenza virus
WTSNSIIA

SEQ ID NO: 302211 - protein, 8 aa, Influenza virus
TSNSIIAF

SEQ ID NO: 302212 - protein, 8 aa, Influenza virus
SNSIIAFC

SEQ ID NO: 302213 - protein, 8 aa, Influenza virus
NSIIAFCG

SEQ ID NO: 302214 - protein, 8 aa, Influenza virus
SIIAFCGT

SEQ ID NO: 302215 - protein, 8 aa, Influenza virus
IIAFCGTS

SEQ ID NO: 302216 - protein, 8 aa, Influenza virus
IAFCGTSG

SEQ ID NO: 302217 - protein, 8 aa, Influenza virus
TGTWPDGA

SEQ ID NO: 302218 - protein, 8 aa, Influenza virus
SWPDGAEI

SEQ ID NO: 302219 - protein, 8 aa, Influenza virus
NINFMPYI

SEQ ID NO: 302220 - protein, 8 aa, Influenza virus
ISCLYKLS

SEQ ID NO: 302221 - protein, 8 aa, Influenza virus
NFMPYISF

SEQ ID NO: 302222 - protein, 8 aa, Influenza virus
CLYKLSQF

SEQ ID NO: 302223 - protein, 8 aa, Influenza virus
ALIIGVGN

SEQ ID NO: 302224 - protein, 8 aa, Influenza virus
LIIGVGNL

SEQ ID NO: 302225 - protein, 8 aa, Influenza virus
GIGNLVFN

SEQ ID NO: 302226 - protein, 8 aa, Influenza virus
GNLIFNAV

SEQ ID NO: 302227 - protein, 8 aa, Influenza virus
NLIFNAVI

SEQ ID NO: 302228 - protein, 8 aa, Influenza virus
LIFNAVIH

SEQ ID NO: 302229 - protein, 8 aa, Influenza virus
FNAVIHEK

SEQ ID NO: 302230 - protein, 8 aa, Influenza virus
NAIRLGET

SEQ ID NO: 302231 - protein, 8 aa, Influenza virus
VIITREPY

SEQ ID NO: 302232 - protein, 8 aa, Influenza virus
IITREPYV

SEQ ID NO: 302233 - protein, 8 aa, Influenza virus
EPYVSCDS

SEQ ID NO: 302234 - protein, 8 aa, Influenza virus
HCWSFALA

SEQ ID NO: 302235 - protein, 8 aa, Influenza virus
ALAQGVLL

SEQ ID NO: 302236 - protein, 8 aa, Influenza virus
LSQGALLG

SEQ ID NO: 302237 - protein, 8 aa, Influenza virus
AQGVLLGT

SEQ ID NO: 302238 - protein, 8 aa, Influenza virus
LLGTRHSN

SEQ ID NO: 302239 - protein, 8 aa, Influenza virus
LGTRHSNG

SEQ ID NO: 302240 - protein, 8 aa, Influenza virus
HSNGTIED

SEQ ID NO: 302241 - protein, 8 aa, Influenza virus
SNGTIEDR

SEQ ID NO: 302242 - protein, 8 aa, Influenza virus
NGTIEDRT

SEQ ID NO: 302243 - protein, 8 aa, Influenza virus
RDRTPYRS

SEQ ID NO: 302244 - protein, 8 aa, Influenza virus
TPYRSLIK

SEQ ID NO: 302245 - protein, 8 aa, Influenza virus
PYRSLIKF

SEQ ID NO: 302246 - protein, 8 aa, Influenza virus
RSLIQFPM

SEQ ID NO: 302247 - protein, 8 aa, Influenza virus
SLIQFPMG

SEQ ID NO: 302248 - protein, 8 aa, Influenza virus
AAPVLGNY

SEQ ID NO: 302249 - protein, 8 aa, Influenza virus
APVLGNCK

SEQ ID NO: 302250 - protein, 8 aa, Influenza virus
PVLGNCKE

SEQ ID NO: 302251 - protein, 8 aa, Influenza virus
EMCVAWSS

SEQ ID NO: 302252 - protein, 8 aa, Influenza virus
DGREWMHV

SEQ ID NO: 302253 - protein, 8 aa, Influenza virus
GREWMHVC

SEQ ID NO: 302254 - protein, 8 aa, Influenza virus
KNILRTQE

SEQ ID NO: 302255 - protein, 8 aa, Influenza virus
ITDGPAAN

SEQ ID NO: 302256 - protein, 8 aa, Influenza virus
TDGPADNK

SEQ ID NO: 302257 - protein, 8 aa, Influenza virus
DGPADNKA

SEQ ID NO: 302258 - protein, 8 aa, Influenza virus
ADYRVYWI

SEQ ID NO: 302259 - protein, 8 aa, Influenza virus
DHRIYWVR

SEQ ID NO: 302260 - protein, 8 aa, Influenza virus
KVQHLEEC

SEQ ID NO: 302261 - protein, 8 aa, Influenza virus
IRHLEECS

SEQ ID NO: 302262 - protein, 8 aa, Influenza virus
DIYCVCRD

SEQ ID NO: 302263 - protein, 8 aa, Influenza virus
IYCVCRDN

SEQ ID NO: 302264 - protein, 8 aa, Influenza virus
SNRPWIRI

SEQ ID NO: 302265 - protein, 8 aa, Influenza virus
NRPWVRIN

SEQ ID NO: 302266 - protein, 8 aa, Influenza virus
RPWVRINN

SEQ ID NO: 302267 - protein, 8 aa, Influenza virus
PWVRINNE

SEQ ID NO: 302268 - protein, 8 aa, Influenza virus
WVRINNET

SEQ ID NO: 302269 - protein, 8 aa, Influenza virus
VRINNETI

SEQ ID NO: 302270 - protein, 8 aa, Influenza virus
RINNETII

SEQ ID NO: 302271 - protein, 8 aa, Influenza virus
INNETIIE

SEQ ID NO: 302272 - protein, 8 aa, Influenza virus
NNETIVET

SEQ ID NO: 302273 - protein, 8 aa, Influenza virus
TIVETGYV

SEQ ID NO: 302274 - protein, 8 aa, Influenza virus
IVETGYVC

SEQ ID NO: 302275 - protein, 8 aa, Influenza virus
VETGYVCS

SEQ ID NO: 302276 - protein, 8 aa, Influenza virus
HSDTPRPS

SEQ ID NO: 302277 - protein, 8 aa, Influenza virus
SDTPRPSD

SEQ ID NO: 302278 - protein, 8 aa, Influenza virus
DTPRPSDP

SEQ ID NO: 302279 - protein, 8 aa, Influenza virus
TPRPSDPS

SEQ ID NO: 302280 - protein, 8 aa, Influenza virus
EPGVKGFG

SEQ ID NO: 302281 - protein, 8 aa, Influenza virus
GSDVWLGR

SEQ ID NO: 302282 - protein, 8 aa, Influenza virus
WRSGFEII

SEQ ID NO: 302283 - protein, 8 aa, Influenza virus
RSGFEVIR

SEQ ID NO: 302284 - protein, 8 aa, Influenza virus
IKVTDGWI

SEQ ID NO: 302285 - protein, 8 aa, Influenza virus
TQTLVANN

SEQ ID NO: 302286 - protein, 8 aa, Influenza virus
GYSGSFSV

SEQ ID NO: 302287 - protein, 8 aa, Influenza virus
YVELTRGV

SEQ ID NO: 302288 - protein, 8 aa, Influenza virus
ELIRGRTN

SEQ ID NO: 302289 - protein, 8 aa, Influenza virus
SWTSNSII

SEQ ID NO: 302290 - protein, 8 aa, Influenza virus
NEPGSGSW

SEQ ID NO: 302291 - protein, 8 aa, Influenza virus
SGNWPDGP

SEQ ID NO: 302292 - protein, 8 aa, Influenza virus
WPDGPKIG

SEQ ID NO: 302293 - protein, 8 aa, Influenza virus
PDGSKIGF

SEQ ID NO: 302294 - protein, 8 aa, Influenza virus
DGSNIKFM

SEQ ID NO: 302295 - protein, 8 aa, Influenza virus
GSNIKFMP

SEQ ID NO: 302296 - protein, 8 aa, Influenza virus
NQKIVTIG

SEQ ID NO: 302297 - protein, 8 aa, Influenza virus
QKIVTIGS

SEQ ID NO: 302298 - protein, 8 aa, Influenza virus
IGLLLQII

SEQ ID NO: 302299 - protein, 8 aa, Influenza virus
FSHYNQVA

SEQ ID NO: 302300 - protein, 8 aa, Influenza virus
SHYNQVAQ

SEQ ID NO: 302301 - protein, 8 aa, Influenza virus
HYNQMKQA

SEQ ID NO: 302302 - protein, 8 aa, Influenza virus
NMTNVQNN

SEQ ID NO: 302303 - protein, 8 aa, Influenza virus
MTNVQNNY

SEQ ID NO: 302304 - protein, 8 aa, Influenza virus
ISCSVSEC

SEQ ID NO: 302305 - protein, 8 aa, Influenza virus
SCSVSECR

SEQ ID NO: 302306 - protein, 8 aa, Influenza virus
CSIHECRT

SEQ ID NO: 302307 - protein, 8 aa, Influenza virus
SVSECRTF

SEQ ID NO: 302308 - protein, 8 aa, Influenza virus
VSECRTFF

SEQ ID NO: 302309 - protein, 8 aa, Influenza virus
HECRTFFL

SEQ ID NO: 302310 - protein, 8 aa, Influenza virus
MSCHIGVA

SEQ ID NO: 302311 - protein, 8 aa, Influenza virus
SCHIGVAP

SEQ ID NO: 302312 - protein, 8 aa, Influenza virus
CHIGVAPS

SEQ ID NO: 302313 - protein, 8 aa, Influenza virus
PIGVVPSP

SEQ ID NO: 302314 - protein, 8 aa, Influenza virus
IGITGPDA

SEQ ID NO: 302315 - protein, 8 aa, Influenza virus
DATAVAVI

SEQ ID NO: 302316 - protein, 8 aa, Influenza virus
ATAVAVIK

SEQ ID NO: 302317 - protein, 8 aa, Influenza virus
LVTDGPSD

SEQ ID NO: 302318 - protein, 8 aa, Influenza virus
VTDGPSDA

SEQ ID NO: 302319 - protein, 8 aa, Influenza virus
KIKKGKLV

SEQ ID NO: 302320 - protein, 8 aa, Influenza virus
DVDAPGFH

SEQ ID NO: 302321 - protein, 8 aa, Influenza virus
ATGFHLEE

SEQ ID NO: 302322 - protein, 8 aa, Influenza virus
AGFHFEEC

SEQ ID NO: 302323 - protein, 8 aa, Influenza virus
SCYPSGED

SEQ ID NO: 302324 - protein, 8 aa, Influenza virus
SVECVCRD

SEQ ID NO: 302325 - protein, 8 aa, Influenza virus
IRFNSDLN

SEQ ID NO: 302326 - protein, 8 aa, Influenza virus
FGDNPRSV

SEQ ID NO: 302327 - protein, 8 aa, Influenza virus
GDSPRPVD

SEQ ID NO: 302328 - protein, 8 aa, Influenza virus
DNPRSVDG

SEQ ID NO: 302329 - protein, 8 aa, Influenza virus
PRPMDSTG

SEQ ID NO: 302330 - protein, 8 aa, Influenza virus
RPMDSTGS

SEQ ID NO: 302331 - protein, 8 aa, Influenza virus
PMDSTGSC

SEQ ID NO: 302332 - protein, 8 aa, Influenza virus
GVNSDTTS

SEQ ID NO: 302333 - protein, 8 aa, Influenza virus
VNSDTTSW

SEQ ID NO: 302334 - protein, 8 aa, Influenza virus
SNTTGWSW

SEQ ID NO: 302335 - protein, 8 aa, Influenza virus
DTTCWSWP

SEQ ID NO: 302336 - protein, 8 aa, Influenza virus
KIITIGSM

SEQ ID NO: 302337 - protein, 8 aa, Influenza virus
IITIGSMS

SEQ ID NO: 302338 - protein, 8 aa, Influenza virus
MTIGSVSL

SEQ ID NO: 302339 - protein, 8 aa, Influenza virus
TIGSVSLT

SEQ ID NO: 302340 - protein, 8 aa, Influenza virus
IGSVSLTL

SEQ ID NO: 302341 - protein, 8 aa, Influenza virus
GSVSLALA

SEQ ID NO: 302342 - protein, 8 aa, Influenza virus
TTEVYSET

SEQ ID NO: 302343 - protein, 8 aa, Influenza virus
TKVYNETV

SEQ ID NO: 302344 - protein, 8 aa, Influenza virus
EMYNETVR

SEQ ID NO: 302345 - protein, 8 aa, Influenza virus
VYSETVRV

SEQ ID NO: 302346 - protein, 8 aa, Influenza virus
YNETVRVK

SEQ ID NO: 302347 - protein, 8 aa, Influenza virus
SETVRVET

SEQ ID NO: 302348 - protein, 8 aa, Influenza virus
ETVRVKTV

SEQ ID NO: 302349 - protein, 8 aa, Influenza virus
VTIPVNNT

SEQ ID NO: 302350 - protein, 8 aa, Influenza virus
VIPVNNTI

SEQ ID NO: 302351 - protein, 8 aa, Influenza virus
KFLNNTEP

SEQ ID NO: 302352 - protein, 8 aa, Influenza virus
LCEVSGFV

SEQ ID NO: 302353 - protein, 8 aa, Influenza virus
CEVSGFAV

SEQ ID NO: 302354 - protein, 8 aa, Influenza virus
SGFAIASK

SEQ ID NO: 302355 - protein, 8 aa, Influenza virus
GFVIVSKD

SEQ ID NO: 302356 - protein, 8 aa, Influenza virus
FAIASKDN

SEQ ID NO: 302357 - protein, 8 aa, Influenza virus
AVVSKDNG

SEQ ID NO: 302358 - protein, 8 aa, Influenza virus
IASKDNGI

SEQ ID NO: 302359 - protein, 8 aa, Influenza virus
PFVACGPA

SEQ ID NO: 302360 - protein, 8 aa, Influenza virus
FVACGPAE

SEQ ID NO: 302361 - protein, 8 aa, Influenza virus
VACGPAEC

SEQ ID NO: 302362 - protein, 8 aa, Influenza virus
ACGPAECR

SEQ ID NO: 302363 - protein, 8 aa, Influenza virus
CSPSECRT

SEQ ID NO: 302364 - protein, 8 aa, Influenza virus
SPSECRTF

SEQ ID NO: 302365 - protein, 8 aa, Influenza virus
CHDGKGWL

SEQ ID NO: 302366 - protein, 8 aa, Influenza virus
WLALGISG

SEQ ID NO: 302367 - protein, 8 aa, Influenza virus
GVSGTDDD

SEQ ID NO: 302368 - protein, 8 aa, Influenza virus
VSGTDDDA

SEQ ID NO: 302369 - protein, 8 aa, Influenza virus
GGVPTDVI

SEQ ID NO: 302370 - protein, 8 aa, Influenza virus
GVPTDVIR

SEQ ID NO: 302371 - protein, 8 aa, Influenza virus
VPTDVIRS

SEQ ID NO: 302372 - protein, 8 aa, Influenza virus
DVVRSWRR

SEQ ID NO: 302373 - protein, 8 aa, Influenza virus
VVRSWRKK

SEQ ID NO: 302374 - protein, 8 aa, Influenza virus
VRSWRKKI

SEQ ID NO: 302375 - protein, 8 aa, Influenza virus
RSWRRQIL

SEQ ID NO: 302376 - protein, 8 aa, Influenza virus
SWRRQILR

SEQ ID NO: 302377 - protein, 8 aa, Influenza virus
WRRQILRT

SEQ ID NO: 302378 - protein, 8 aa, Influenza virus
RRQILRTQ

SEQ ID NO: 302379 - protein, 8 aa, Influenza virus
ESSCVCIK

SEQ ID NO: 302380 - protein, 8 aa, Influenza virus
SSCVCIKG

SEQ ID NO: 302381 - protein, 8 aa, Influenza virus
MTDGPASN

SEQ ID NO: 302382 - protein, 8 aa, Influenza virus
TDGPASNQ

SEQ ID NO: 302383 - protein, 8 aa, Influenza virus
DGPASNQA

SEQ ID NO: 302384 - protein, 8 aa, Influenza virus
GPASNQAS

SEQ ID NO: 302385 - protein, 8 aa, Influenza virus
PANKQASY

SEQ ID NO: 302386 - protein, 8 aa, Influenza virus
ASNQASYK

SEQ ID NO: 302387 - protein, 8 aa, Influenza virus
NKQASYKI

SEQ ID NO: 302388 - protein, 8 aa, Influenza virus
NQASYRIF

SEQ ID NO: 302389 - protein, 8 aa, Influenza virus
SYKIFKSR

SEQ ID NO: 302390 - protein, 8 aa, Influenza virus
EVSFRGGH

SEQ ID NO: 302391 - protein, 8 aa, Influenza virus
ISFQSGHI

SEQ ID NO: 302392 - protein, 8 aa, Influenza virus
SCYPNLGQ

SEQ ID NO: 302393 - protein, 8 aa, Influenza virus
CYPNLGQV

SEQ ID NO: 302394 - protein, 8 aa, Influenza virus
YPNLGQVE

SEQ ID NO: 302395 - protein, 8 aa, Influenza virus
PNLGQVEC

SEQ ID NO: 302396 - protein, 8 aa, Influenza virus
NLGQVECV

SEQ ID NO: 302397 - protein, 8 aa, Influenza virus
LGQVECVC

SEQ ID NO: 302398 - protein, 8 aa, Influenza virus
YDVGYLCA

SEQ ID NO: 302399 - protein, 8 aa, Influenza virus
KVGYLCAG

SEQ ID NO: 302400 - protein, 8 aa, Influenza virus
DTPRVQDD

SEQ ID NO: 302401 - protein, 8 aa, Influenza virus
NAVGRSGT

SEQ ID NO: 302402 - protein, 8 aa, Influenza virus
AIGGSGTD

SEQ ID NO: 302403 - protein, 8 aa, Influenza virus
VGRSGTNN

SEQ ID NO: 302404 - protein, 8 aa, Influenza virus
SISSRNGF

SEQ ID NO: 302405 - protein, 8 aa, Influenza virus
TASRSGFE

SEQ ID NO: 302406 - protein, 8 aa, Influenza virus
FEVLFIED

SEQ ID NO: 302407 - protein, 8 aa, Influenza virus
EVLLIENG

SEQ ID NO: 302408 - protein, 8 aa, Influenza virus
VLFIEDGW

SEQ ID NO: 302409 - protein, 8 aa, Influenza virus
EVLNNKHW

SEQ ID NO: 302410 - protein, 8 aa, Influenza virus
VLDNKNWS

SEQ ID NO: 302411 - protein, 8 aa, Influenza virus
LNNRNWSG

SEQ ID NO: 302412 - protein, 8 aa, Influenza virus
NNMNWSGY

SEQ ID NO: 302413 - protein, 8 aa, Influenza virus
SGAFTVPI

SEQ ID NO: 302414 - protein, 8 aa, Influenza virus
FTVPITMT

SEQ ID NO: 302415 - protein, 8 aa, Influenza virus
IRGKPKER

SEQ ID NO: 302416 - protein, 8 aa, Influenza virus
PEERNSIW

SEQ ID NO: 302417 - protein, 8 aa, Influenza virus
EEKTSIWT

SEQ ID NO: 302418 - protein, 8 aa, Influenza virus
ERPSIWTS

SEQ ID NO: 302419 - protein, 8 aa, Influenza virus
KTSIWTSS

SEQ ID NO: 302420 - protein, 8 aa, Influenza virus
VSSEVPGC

SEQ ID NO: 302421 - protein, 8 aa, Influenza virus
SSEVPEWS

SEQ ID NO: 302422 - protein, 8 aa, Influenza virus
SEAPGWSW

SEQ ID NO: 302423 - protein, 8 aa, Influenza virus
EVPGCTMG

SEQ ID NO: 302424 - protein, 8 aa, Influenza virus
QKIMCISA

SEQ ID NO: 302425 - protein, 8 aa, Influenza virus
IICISTTG

SEQ ID NO: 302426 - protein, 8 aa, Influenza virus
CISATGMA

SEQ ID NO: 302427 - protein, 8 aa, Influenza virus
ISATGMIL

SEQ ID NO: 302428 - protein, 8 aa, Influenza virus
SATGMILS

SEQ ID NO: 302429 - protein, 8 aa, Influenza virus
ATGMILSV

SEQ ID NO: 302430 - protein, 8 aa, Influenza virus
TGMALSVV

SEQ ID NO: 302431 - protein, 8 aa, Influenza virus
GMILSVVS

SEQ ID NO: 302432 - protein, 8 aa, Influenza virus
GLVNLGLN

SEQ ID NO: 302433 - protein, 8 aa, Influenza virus
LANLGLNV

SEQ ID NO: 302434 - protein, 8 aa, Influenza virus
LTKSLCEV

SEQ ID NO: 302435 - protein, 8 aa, Influenza virus
KSLCEVNS

SEQ ID NO: 302436 - protein, 8 aa, Influenza virus
SLCEVNSW

SEQ ID NO: 302437 - protein, 8 aa, Influenza virus
EVNSWHIF

SEQ ID NO: 302438 - protein, 8 aa, Influenza virus
NAIRIGEG

SEQ ID NO: 302439 - protein, 8 aa, Influenza virus
AVRIGEDA

SEQ ID NO: 302440 - protein, 8 aa, Influenza virus
VRIGEDAH

SEQ ID NO: 302441 - protein, 8 aa, Influenza virus
RIGEDAHV

SEQ ID NO: 302442 - protein, 8 aa, Influenza virus
IGEDAHVL

SEQ ID NO: 302443 - protein, 8 aa, Influenza virus
DAHVLVTR

SEQ ID NO: 302444 - protein, 8 aa, Influenza virus
RHANGTIN

SEQ ID NO: 302445 - protein, 8 aa, Influenza virus
GTINDRSP

SEQ ID NO: 302446 - protein, 8 aa, Influenza virus
TMHDRSPF

SEQ ID NO: 302447 - protein, 8 aa, Influenza virus
MHDRSPFR

SEQ ID NO: 302448 - protein, 8 aa, Influenza virus
NDRSPFRA

SEQ ID NO: 302449 - protein, 8 aa, Influenza virus
RSPYRALI

SEQ ID NO: 302450 - protein, 8 aa, Influenza virus
SPYRALIS

SEQ ID NO: 302451 - protein, 8 aa, Influenza virus
PYRALISW

SEQ ID NO: 302452 - protein, 8 aa, Influenza virus
FRALISWG

SEQ ID NO: 302453 - protein, 8 aa, Influenza virus
ISWEMGLA

SEQ ID NO: 302454 - protein, 8 aa, Influenza virus
IECVGWSS

SEQ ID NO: 302455 - protein, 8 aa, Influenza virus
STSCHDGR

SEQ ID NO: 302456 - protein, 8 aa, Influenza virus
TSCHDGRS

SEQ ID NO: 302457 - protein, 8 aa, Influenza virus
SCHDGRSR

SEQ ID NO: 302458 - protein, 8 aa, Influenza virus
CHDGRSRM

SEQ ID NO: 302459 - protein, 8 aa, Influenza virus
HDGRSRMS

SEQ ID NO: 302460 - protein, 8 aa, Influenza virus
VCMSGPNN

SEQ ID NO: 302461 - protein, 8 aa, Influenza virus
IEIPSWAG

SEQ ID NO: 302462 - protein, 8 aa, Influenza virus
IPSWAGNV

SEQ ID NO: 302463 - protein, 8 aa, Influenza virus
PTWAGNIL

SEQ ID NO: 302464 - protein, 8 aa, Influenza virus
ECVCHNGV

SEQ ID NO: 302465 - protein, 8 aa, Influenza virus
CVCHNGVC

SEQ ID NO: 302466 - protein, 8 aa, Influenza virus
VCHNGVCP

SEQ ID NO: 302467 - protein, 8 aa, Influenza virus
CHNGVCPV

SEQ ID NO: 302468 - protein, 8 aa, Influenza virus
HNGVCPVV

SEQ ID NO: 302469 - protein, 8 aa, Influenza virus
VMTDGPAD

SEQ ID NO: 302470 - protein, 8 aa, Influenza virus
MTDGPANS

SEQ ID NO: 302471 - protein, 8 aa, Influenza virus
TDGPANDR

SEQ ID NO: 302472 - protein, 8 aa, Influenza virus
DGPANDRA

SEQ ID NO: 302473 - protein, 8 aa, Influenza virus
GKAQHIEE

SEQ ID NO: 302474 - protein, 8 aa, Influenza virus
KAQHIEEC

SEQ ID NO: 302475 - protein, 8 aa, Influenza virus
NRPIITIN

SEQ ID NO: 302476 - protein, 8 aa, Influenza virus
MTHSSKYL

SEQ ID NO: 302477 - protein, 8 aa, Influenza virus
THSSKYLC

SEQ ID NO: 302478 - protein, 8 aa, Influenza virus
HSSKYLCS

SEQ ID NO: 302479 - protein, 8 aa, Influenza virus
YLCSRVLT

SEQ ID NO: 302480 - protein, 8 aa, Influenza virus
LCSRVLTD

SEQ ID NO: 302481 - protein, 8 aa, Influenza virus
CSRVLTDT

SEQ ID NO: 302482 - protein, 8 aa, Influenza virus
SRVLTDTS

SEQ ID NO: 302483 - protein, 8 aa, Influenza virus
RVLTDTSR

SEQ ID NO: 302484 - protein, 8 aa, Influenza virus
GGTPDPGV

SEQ ID NO: 302485 - protein, 8 aa, Influenza virus
GNPDPGVK

SEQ ID NO: 302486 - protein, 8 aa, Influenza virus
NPDPGVKG

SEQ ID NO: 302487 - protein, 8 aa, Influenza virus
KGFAFLDR

SEQ ID NO: 302488 - protein, 8 aa, Influenza virus
ANSWLGRT

SEQ ID NO: 302489 - protein, 8 aa, Influenza virus
GRTISKDT

SEQ ID NO: 302490 - protein, 8 aa, Influenza virus
RTISKDTR

SEQ ID NO: 302491 - protein, 8 aa, Influenza virus
TISKDTRS

SEQ ID NO: 302492 - protein, 8 aa, Influenza virus
ISKDTRSG

SEQ ID NO: 302493 - protein, 8 aa, Influenza virus
DLRSGYEM

SEQ ID NO: 302494 - protein, 8 aa, Influenza virus
LRSGYEML

SEQ ID NO: 302495 - protein, 8 aa, Influenza virus
YEVLKVPD

SEQ ID NO: 302496 - protein, 8 aa, Influenza virus
EVLKVPDA

SEQ ID NO: 302497 - protein, 8 aa, Influenza virus
VLKVPDAE

SEQ ID NO: 302498 - protein, 8 aa, Influenza virus
LKVPNAEA

SEQ ID NO: 302499 - protein, 8 aa, Influenza virus
IVNNPNWS

SEQ ID NO: 302500 - protein, 8 aa, Influenza virus
VNNQKWSG

SEQ ID NO: 302501 - protein, 8 aa, Influenza virus
GYSGAFVD

SEQ ID NO: 302502 - protein, 8 aa, Influenza virus
YSGAFVDY

SEQ ID NO: 302503 - protein, 8 aa, Influenza virus
SGAFVDYW

SEQ ID NO: 302504 - protein, 8 aa, Influenza virus
IRGRPRES

SEQ ID NO: 302505 - protein, 8 aa, Influenza virus
ENSVLWTS

SEQ ID NO: 302506 - protein, 8 aa, Influenza virus
NSVLWTSN

SEQ ID NO: 302507 - protein, 8 aa, Influenza virus
GVLWTSNS

SEQ ID NO: 302508 - protein, 8 aa, Influenza virus
VLWTSNSV

SEQ ID NO: 302509 - protein, 8 aa, Influenza virus
LWTSNSMV

SEQ ID NO: 302510 - protein, 8 aa, Influenza virus
CGSKKRLG

SEQ ID NO: 302511 - protein, 8 aa, Influenza virus
GSKKRLGS

SEQ ID NO: 302512 - protein, 8 aa, Influenza virus
SKKRLGSW

SEQ ID NO: 302513 - protein, 8 aa, Influenza virus
KKRLGSWS

SEQ ID NO: 302514 - protein, 8 aa, Influenza virus
PSQKLFAL

SEQ ID NO: 302515 - protein, 8 aa, Influenza virus
SQKLFALS

SEQ ID NO: 302516 - protein, 8 aa, Influenza virus
QKLFALSE

SEQ ID NO: 302517 - protein, 8 aa, Influenza virus
FALSGVAV

SEQ ID NO: 302518 - protein, 8 aa, Influenza virus
MNLLIGIS

SEQ ID NO: 302519 - protein, 8 aa, Influenza virus
LLIGVSNV

SEQ ID NO: 302520 - protein, 8 aa, Influenza virus
LIGVSNVG

SEQ ID NO: 302521 - protein, 8 aa, Influenza virus
IGISNVVL

SEQ ID NO: 302522 - protein, 8 aa, Influenza virus
GISNVVLN

SEQ ID NO: 302523 - protein, 8 aa, Influenza virus
SNVGLNMS

SEQ ID NO: 302524 - protein, 8 aa, Influenza virus
NVGLNMSL

SEQ ID NO: 302525 - protein, 8 aa, Influenza virus
VGLNMSLH

SEQ ID NO: 302526 - protein, 8 aa, Influenza virus
GLKVSLHL

SEQ ID NO: 302527 - protein, 8 aa, Influenza virus
LNISLHLK

SEQ ID NO: 302528 - protein, 8 aa, Influenza virus
ENTYVNKT

SEQ ID NO: 302529 - protein, 8 aa, Influenza virus
NKYVNNTT

SEQ ID NO: 302530 - protein, 8 aa, Influenza virus
TYINNATI

SEQ ID NO: 302531 - protein, 8 aa, Influenza virus
YINNTTII

SEQ ID NO: 302532 - protein, 8 aa, Influenza virus
YLMLSKSL

SEQ ID NO: 302533 - protein, 8 aa, Influenza virus
LMLSKSLC

SEQ ID NO: 302534 - protein, 8 aa, Influenza virus
LLNKSLCS

SEQ ID NO: 302535 - protein, 8 aa, Influenza virus
LSKSLCKV

SEQ ID NO: 302536 - protein, 8 aa, Influenza virus
LCKIEGWV

SEQ ID NO: 302537 - protein, 8 aa, Influenza virus
GWVVIEKD

SEQ ID NO: 302538 - protein, 8 aa, Influenza virus
AVAKDNAI

SEQ ID NO: 302539 - protein, 8 aa, Influenza virus
IEKDNAVR

SEQ ID NO: 302540 - protein, 8 aa, Influenza virus
PYVSCDPI

SEQ ID NO: 302541 - protein, 8 aa, Influenza virus
GCKMFALH

SEQ ID NO: 302542 - protein, 8 aa, Influenza virus
NRHSNGTI

SEQ ID NO: 302543 - protein, 8 aa, Influenza virus
RHSNGTIH

SEQ ID NO: 302544 - protein, 8 aa, Influenza virus
NGTINDRT

SEQ ID NO: 302545 - protein, 8 aa, Influenza virus
TIHDGTAF

SEQ ID NO: 302546 - protein, 8 aa, Influenza virus
INDRTAFR

SEQ ID NO: 302547 - protein, 8 aa, Influenza virus
HDGTAFRG

SEQ ID NO: 302548 - protein, 8 aa, Influenza virus
GTAFRGLI

SEQ ID NO: 302549 - protein, 8 aa, Influenza virus
TTFRGLIS

SEQ ID NO: 302550 - protein, 8 aa, Influenza virus
FRGLISTQ

SEQ ID NO: 302551 - protein, 8 aa, Influenza virus
RGLISTQL

SEQ ID NO: 302552 - protein, 8 aa, Influenza virus
GLISTQLG

SEQ ID NO: 302553 - protein, 8 aa, Influenza virus
STHLGTPP

SEQ ID NO: 302554 - protein, 8 aa, Influenza virus
SNSEFICV

SEQ ID NO: 302555 - protein, 8 aa, Influenza virus
NSEFICVG

SEQ ID NO: 302556 - protein, 8 aa, Influenza virus
SEFICVGW

SEQ ID NO: 302557 - protein, 8 aa, Influenza virus
EFICVGWS

SEQ ID NO: 302558 - protein, 8 aa, Influenza virus
STTCHDGV

SEQ ID NO: 302559 - protein, 8 aa, Influenza virus
CHDGIARM

SEQ ID NO: 302560 - protein, 8 aa, Influenza virus
HDGVNRMT

SEQ ID NO: 302561 - protein, 8 aa, Influenza virus
DGVNRMTI

SEQ ID NO: 302562 - protein, 8 aa, Influenza virus
GVSRMTIC

SEQ ID NO: 302563 - protein, 8 aa, Influenza virus
SRMTICVQ

SEQ ID NO: 302564 - protein, 8 aa, Influenza virus
QGNNENAT

SEQ ID NO: 302565 - protein, 8 aa, Influenza virus
GNNENATA

SEQ ID NO: 302566 - protein, 8 aa, Influenza virus
NNENATAT

SEQ ID NO: 302567 - protein, 8 aa, Influenza virus
TATVYYNG

SEQ ID NO: 302568 - protein, 8 aa, Influenza virus
ATVYYNGR

SEQ ID NO: 302569 - protein, 8 aa, Influenza virus
TVYYNGRL

SEQ ID NO: 302570 - protein, 8 aa, Influenza virus
VYYNGRLT

SEQ ID NO: 302571 - protein, 8 aa, Influenza virus
YYNGRLTT

SEQ ID NO: 302572 - protein, 8 aa, Influenza virus
YNGRLTTT

SEQ ID NO: 302573 - protein, 8 aa, Influenza virus
NGRLTTTI

SEQ ID NO: 302574 - protein, 8 aa, Influenza virus
RRLTTTIR

SEQ ID NO: 302575 - protein, 8 aa, Influenza virus
TTIKPWAR

SEQ ID NO: 302576 - protein, 8 aa, Influenza virus
TIKTWAGK

SEQ ID NO: 302577 - protein, 8 aa, Influenza virus
IKTWAGKI

SEQ ID NO: 302578 - protein, 8 aa, Influenza virus
KTWAGKIL

SEQ ID NO: 302579 - protein, 8 aa, Influenza virus
TWAGKILR

SEQ ID NO: 302580 - protein, 8 aa, Influenza virus
WAGKILRT

SEQ ID NO: 302581 - protein, 8 aa, Influenza virus
AGKILRTQ

SEQ ID NO: 302582 - protein, 8 aa, Influenza virus
GKILRTQE

SEQ ID NO: 302583 - protein, 8 aa, Influenza virus
VCHNGTCG

SEQ ID NO: 302584 - protein, 8 aa, Influenza virus
STCVVVMT

SEQ ID NO: 302585 - protein, 8 aa, Influenza virus
TCVAVMTD

SEQ ID NO: 302586 - protein, 8 aa, Influenza virus
CVAVMTDG

SEQ ID NO: 302587 - protein, 8 aa, Influenza virus
AVMTDGSA

SEQ ID NO: 302588 - protein, 8 aa, Influenza virus
VMTDGPAS

SEQ ID NO: 302589 - protein, 8 aa, Influenza virus
MTDGSASG

SEQ ID NO: 302590 - protein, 8 aa, Influenza virus
TDGSASGQ

SEQ ID NO: 302591 - protein, 8 aa, Influenza virus
DGSASGQA

SEQ ID NO: 302592 - protein, 8 aa, Influenza virus
ANSQAYTK

SEQ ID NO: 302593 - protein, 8 aa, Influenza virus
LQGSARHI

SEQ ID NO: 302594 - protein, 8 aa, Influenza virus
QGSARHIE

SEQ ID NO: 302595 - protein, 8 aa, Influenza virus
ARHVEECS

SEQ ID NO: 302596 - protein, 8 aa, Influenza virus
RHIEEWSC

SEQ ID NO: 302597 - protein, 8 aa, Influenza virus
KITCVCRD

SEQ ID NO: 302598 - protein, 8 aa, Influenza virus
VSCVCRDN

SEQ ID NO: 302599 - protein, 8 aa, Influenza virus
NRPVIEIN

SEQ ID NO: 302600 - protein, 8 aa, Influenza virus
RPVIEINM

SEQ ID NO: 302601 - protein, 8 aa, Influenza virus
HTSRYMCT

SEQ ID NO: 302602 - protein, 8 aa, Influenza virus
TSRYMCTG

SEQ ID NO: 302603 - protein, 8 aa, Influenza virus
DTSRPGDR

SEQ ID NO: 302604 - protein, 8 aa, Influenza virus
PITGSPEA

SEQ ID NO: 302605 - protein, 8 aa, Influenza virus
ITGSPCAP

SEQ ID NO: 302606 - protein, 8 aa, Influenza virus
TGSPCAPG

SEQ ID NO: 302607 - protein, 8 aa, Influenza virus
KGFGFLDG

SEQ ID NO: 302608 - protein, 8 aa, Influenza virus
NNTWLGRT

SEQ ID NO: 302609 - protein, 8 aa, Influenza virus
LGRTFSPR

SEQ ID NO: 302610 - protein, 8 aa, Influenza virus
GRTFSPRS

SEQ ID NO: 302611 - protein, 8 aa, Influenza virus
GTISPRSR

SEQ ID NO: 302612 - protein, 8 aa, Influenza virus
TISPHSRS

SEQ ID NO: 302613 - protein, 8 aa, Influenza virus
ISTRSRSG

SEQ ID NO: 302614 - protein, 8 aa, Influenza virus
SPRSRNGF

SEQ ID NO: 302615 - protein, 8 aa, Influenza virus
PRSRNGFE

SEQ ID NO: 302616 - protein, 8 aa, Influenza virus
RSRNGFEM

SEQ ID NO: 302617 - protein, 8 aa, Influenza virus
MLKVPNAE

SEQ ID NO: 302618 - protein, 8 aa, Influenza virus
LKVPNAEK

SEQ ID NO: 302619 - protein, 8 aa, Influenza virus
KVPNAEKD

SEQ ID NO: 302620 - protein, 8 aa, Influenza virus
VPNAEKDP

SEQ ID NO: 302621 - protein, 8 aa, Influenza virus
ERQEIVGN

SEQ ID NO: 302622 - protein, 8 aa, Influenza virus
SKCYNPCF

SEQ ID NO: 302623 - protein, 8 aa, Influenza virus
EVKYVWWT

SEQ ID NO: 302624 - protein, 8 aa, Influenza virus
VKYVWWTS

SEQ ID NO: 302625 - protein, 8 aa, Influenza virus
WWASNSLI

SEQ ID NO: 302626 - protein, 8 aa, Influenza virus
IALCGSPI

SEQ ID NO: 302627 - protein, 8 aa, Influenza virus
GSFPDGAR

SEQ ID NO: 302628 - protein, 8 aa, Influenza virus
SFPDGAKI

SEQ ID NO: 302629 - protein, 8 aa, Influenza virus
FPDGAKIQ

SEQ ID NO: 302630 - protein, 8 aa, Influenza virus
PNGAQIQY

SEQ ID NO: 302631 - protein, 8 aa, Influenza virus
DGAKIQYF

SEQ ID NO: 302632 - protein, 8 aa, Influenza virus
REYNETVK

SEQ ID NO: 302633 - protein, 8 aa, Influenza virus
EYNETVKV

SEQ ID NO: 302634 - protein, 8 aa, Influenza virus
YNETVKVE

SEQ ID NO: 302635 - protein, 8 aa, Influenza virus
EGFAPFSK

SEQ ID NO: 302636 - protein, 8 aa, Influenza virus
LPNDKHSN

SEQ ID NO: 302637 - protein, 8 aa, Influenza virus
LNDKHFNG

SEQ ID NO: 302638 - protein, 8 aa, Influenza virus
DKHSNGTM

SEQ ID NO: 302639 - protein, 8 aa, Influenza virus
KHSNGTMK

SEQ ID NO: 302640 - protein, 8 aa, Influenza virus
TMKDRSPY

SEQ ID NO: 302641 - protein, 8 aa, Influenza virus
MKDRSPYR

SEQ ID NO: 302642 - protein, 8 aa, Influenza virus
YRTLMSVG

SEQ ID NO: 302643 - protein, 8 aa, Influenza virus
RTLMSVKV

SEQ ID NO: 302644 - protein, 8 aa, Influenza virus
TLMSVKVG

SEQ ID NO: 302645 - protein, 8 aa, Influenza virus
LMSVKVGQ

SEQ ID NO: 302646 - protein, 8 aa, Influenza virus
MSVKVGQS

SEQ ID NO: 302647 - protein, 8 aa, Influenza virus
IGQSANVY

SEQ ID NO: 302648 - protein, 8 aa, Influenza virus
VYQSRFEA

SEQ ID NO: 302649 - protein, 8 aa, Influenza virus
YQSRFEAV

SEQ ID NO: 302650 - protein, 8 aa, Influenza virus
QSRFEAVA

SEQ ID NO: 302651 - protein, 8 aa, Influenza virus
SRFEAVAW

SEQ ID NO: 302652 - protein, 8 aa, Influenza virus
KFEAVAWS

SEQ ID NO: 302653 - protein, 8 aa, Influenza virus
HDGKKWTT

SEQ ID NO: 302654 - protein, 8 aa, Influenza virus
KWTTIGVT

SEQ ID NO: 302655 - protein, 8 aa, Influenza virus
WMIIGVTG

SEQ ID NO: 302656 - protein, 8 aa, Influenza virus
TIGVTGSD

SEQ ID NO: 302657 - protein, 8 aa, Influenza virus
SWAGDIMR

SEQ ID NO: 302658 - protein, 8 aa, Influenza virus
WAGDIMRT

SEQ ID NO: 302659 - protein, 8 aa, Influenza virus
AGDIMRTQ

SEQ ID NO: 302660 - protein, 8 aa, Influenza virus
ESSCTCIL

SEQ ID NO: 302661 - protein, 8 aa, Influenza virus
SSCTCILG

SEQ ID NO: 302662 - protein, 8 aa, Influenza virus
GNCYWVMT

SEQ ID NO: 302663 - protein, 8 aa, Influenza virus
NCYWVMTD

SEQ ID NO: 302664 - protein, 8 aa, Influenza virus
MTDGPANN

SEQ ID NO: 302665 - protein, 8 aa, Influenza virus
TDGPANNQ

SEQ ID NO: 302666 - protein, 8 aa, Influenza virus
DGPANNQA

SEQ ID NO: 302667 - protein, 8 aa, Influenza virus
FNEGHIEE

SEQ ID NO: 302668 - protein, 8 aa, Influenza virus
NEGHIEEC

SEQ ID NO: 302669 - protein, 8 aa, Influenza virus
TNRPVLVV

SEQ ID NO: 302670 - protein, 8 aa, Influenza virus
NRPVLVVS

SEQ ID NO: 302671 - protein, 8 aa, Influenza virus
LVISTDLS

SEQ ID NO: 302672 - protein, 8 aa, Influenza virus
VISTDLSY

SEQ ID NO: 302673 - protein, 8 aa, Influenza virus
LSYQVGYL

SEQ ID NO: 302674 - protein, 8 aa, Influenza virus
SYQVGYLC

SEQ ID NO: 302675 - protein, 8 aa, Influenza virus
YQVGYLCA

SEQ ID NO: 302676 - protein, 8 aa, Influenza virus
QVGYLCAG

SEQ ID NO: 302677 - protein, 8 aa, Influenza virus
DTPRGEDG

SEQ ID NO: 302678 - protein, 8 aa, Influenza virus
TPRGEDGQ

SEQ ID NO: 302679 - protein, 8 aa, Influenza virus
PRGEDGQF

SEQ ID NO: 302680 - protein, 8 aa, Influenza virus
GFRQGSDV

SEQ ID NO: 302681 - protein, 8 aa, Influenza virus
FRQGSDVW

SEQ ID NO: 302682 - protein, 8 aa, Influenza virus
DVWVGRTI

SEQ ID NO: 302683 - protein, 8 aa, Influenza virus
VWMGRTLS

SEQ ID NO: 302684 - protein, 8 aa, Influenza virus
LTSRSGFE

SEQ ID NO: 302685 - protein, 8 aa, Influenza virus
DNPNWSGY

SEQ ID NO: 302686 - protein, 8 aa, Influenza virus
NPNWSGYS

SEQ ID NO: 302687 - protein, 8 aa, Influenza virus
SFTLPVEM

SEQ ID NO: 302688 - protein, 8 aa, Influenza virus
SCLVPCFW

SEQ ID NO: 302689 - protein, 8 aa, Influenza virus
IVMCGVNY

SEQ ID NO: 302690 - protein, 8 aa, Influenza virus
ADWSWQDG

SEQ ID NO: 302691 - protein, 8 aa, Influenza virus
DWSWQDGA

SEQ ID NO: 302692 - protein, 8 aa, Influenza virus
DGAILPFA

SEQ ID NO: 302693 - protein, 8 aa, Influenza virus
GAILPLTS

SEQ ID NO: 302694 - protein, 8 aa, Influenza virus
AILPLTSI

SEQ ID NO: 302695 - protein, 8 aa, Influenza virus
PNQKIQCT

SEQ ID NO: 302696 - protein, 8 aa, Influenza virus
SQKILCTS

SEQ ID NO: 302697 - protein, 8 aa, Influenza virus
KILFASAT

SEQ ID NO: 302698 - protein, 8 aa, Influenza virus
ILFASATA

SEQ ID NO: 302699 - protein, 8 aa, Influenza virus
LCTSATAL

SEQ ID NO: 302700 - protein, 8 aa, Influenza virus
GITNLGLN

SEQ ID NO: 302701 - protein, 8 aa, Influenza virus
IINNYHNE

SEQ ID NO: 302702 - protein, 8 aa, Influenza virus
INNYYNDT

SEQ ID NO: 302703 - protein, 8 aa, Influenza virus
NNYYNDTN

SEQ ID NO: 302704 - protein, 8 aa, Influenza virus
ITQISNIN

SEQ ID NO: 302705 - protein, 8 aa, Influenza virus
FNNLTKRL

SEQ ID NO: 302706 - protein, 8 aa, Influenza virus
NNLTKRLC

SEQ ID NO: 302707 - protein, 8 aa, Influenza virus
NLTKRLCT

SEQ ID NO: 302708 - protein, 8 aa, Influenza virus
LTKRLCTI

SEQ ID NO: 302709 - protein, 8 aa, Influenza virus
TKRLCTIN

SEQ ID NO: 302710 - protein, 8 aa, Influenza virus
KRLCTINS

SEQ ID NO: 302711 - protein, 8 aa, Influenza virus
IYGKDNAI

SEQ ID NO: 302712 - protein, 8 aa, Influenza virus
YGKDNAIR

SEQ ID NO: 302713 - protein, 8 aa, Influenza virus
NAIRIGED

SEQ ID NO: 302714 - protein, 8 aa, Influenza virus
AIRIGEDS

SEQ ID NO: 302715 - protein, 8 aa, Influenza virus
RIGGNSDV

SEQ ID NO: 302716 - protein, 8 aa, Influenza virus
IGENSGVL

SEQ ID NO: 302717 - protein, 8 aa, Influenza virus
GGNSDVLV

SEQ ID NO: 302718 - protein, 8 aa, Influenza virus
ENSGVLVT

SEQ ID NO: 302719 - protein, 8 aa, Influenza virus
SSDVLVTR

SEQ ID NO: 302720 - protein, 8 aa, Influenza virus
SCDPNECR

SEQ ID NO: 302721 - protein, 8 aa, Influenza virus
CDPNECRF

SEQ ID NO: 302722 - protein, 8 aa, Influenza virus
DPNECRFY

SEQ ID NO: 302723 - protein, 8 aa, Influenza virus
RALISWPQ

SEQ ID NO: 302724 - protein, 8 aa, Influenza virus
ALISWPQS

SEQ ID NO: 302725 - protein, 8 aa, Influenza virus
PPTVYNSK

SEQ ID NO: 302726 - protein, 8 aa, Influenza virus
TSCHDGKF

SEQ ID NO: 302727 - protein, 8 aa, Influenza virus
SCHDGKFR

SEQ ID NO: 302728 - protein, 8 aa, Influenza virus
CHDGKFRM

SEQ ID NO: 302729 - protein, 8 aa, Influenza virus
HDGKFRMS

SEQ ID NO: 302730 - protein, 8 aa, Influenza virus
NNNASTVI

SEQ ID NO: 302731 - protein, 8 aa, Influenza virus
NNASAIIW

SEQ ID NO: 302732 - protein, 8 aa, Influenza virus
NASTVIWY

SEQ ID NO: 302733 - protein, 8 aa, Influenza virus
ASAVIWYK

SEQ ID NO: 302734 - protein, 8 aa, Influenza virus
KRPVTEIN

SEQ ID NO: 302735 - protein, 8 aa, Influenza virus
RPTTEINT

SEQ ID NO: 302736 - protein, 8 aa, Influenza virus
PTTEINTW

SEQ ID NO: 302737 - protein, 8 aa, Influenza virus
TTEINTWA

SEQ ID NO: 302738 - protein, 8 aa, Influenza virus
ECVCQNGV

SEQ ID NO: 302739 - protein, 8 aa, Influenza virus
CVCHDGVC

SEQ ID NO: 302740 - protein, 8 aa, Influenza virus
VCHDGVCP

SEQ ID NO: 302741 - protein, 8 aa, Influenza virus
CQNGVCPV

SEQ ID NO: 302742 - protein, 8 aa, Influenza virus
HNGICPVA

SEQ ID NO: 302743 - protein, 8 aa, Influenza virus
SGVCPVVF

SEQ ID NO: 302744 - protein, 8 aa, Influenza virus
TGPADTRV

SEQ ID NO: 302745 - protein, 8 aa, Influenza virus
GPADTRVY

SEQ ID NO: 302746 - protein, 8 aa, Influenza virus
PADTRVYY

SEQ ID NO: 302747 - protein, 8 aa, Influenza virus
ADTRVYYF

SEQ ID NO: 302748 - protein, 8 aa, Influenza virus
TRVYYFKG

SEQ ID NO: 302749 - protein, 8 aa, Influenza virus
RVYYFKKG

SEQ ID NO: 302750 - protein, 8 aa, Influenza virus
GGKILKWE

SEQ ID NO: 302751 - protein, 8 aa, Influenza virus
GRILKWEP

SEQ ID NO: 302752 - protein, 8 aa, Influenza virus
RILKWEPL

SEQ ID NO: 302753 - protein, 8 aa, Influenza virus
KWESLAGT

SEQ ID NO: 302754 - protein, 8 aa, Influenza virus
WESLAGTA

SEQ ID NO: 302755 - protein, 8 aa, Influenza virus
TMTHTSQY

SEQ ID NO: 302756 - protein, 8 aa, Influenza virus
NPRPNDPV

SEQ ID NO: 302757 - protein, 8 aa, Influenza virus
PYPGNSNN

SEQ ID NO: 302758 - protein, 8 aa, Influenza virus
YPGNNNGV

SEQ ID NO: 302759 - protein, 8 aa, Influenza virus
PGNNNKGV

SEQ ID NO: 302760 - protein, 8 aa, Influenza virus
GNNNKGVK

SEQ ID NO: 302761 - protein, 8 aa, Influenza virus
SNTWLGRT

SEQ ID NO: 302762 - protein, 8 aa, Influenza virus
WVGRTISI

SEQ ID NO: 302763 - protein, 8 aa, Influenza virus
LGRTLNTA

SEQ ID NO: 302764 - protein, 8 aa, Influenza virus
TLNTASRS

SEQ ID NO: 302765 - protein, 8 aa, Influenza virus
ISTASRYG

SEQ ID NO: 302766 - protein, 8 aa, Influenza virus
PNALTDER

SEQ ID NO: 302767 - protein, 8 aa, Influenza virus
NALTNDRS

SEQ ID NO: 302768 - protein, 8 aa, Influenza virus
ALTDDRST

SEQ ID NO: 302769 - protein, 8 aa, Influenza virus
LTNDRSKP

SEQ ID NO: 302770 - protein, 8 aa, Influenza virus
RSKPVQGQ

SEQ ID NO: 302771 - protein, 8 aa, Influenza virus
SKPMQGQT

SEQ ID NO: 302772 - protein, 8 aa, Influenza virus
PIQGQTVV

SEQ ID NO: 302773 - protein, 8 aa, Influenza virus
QGQTIVLD

SEQ ID NO: 302774 - protein, 8 aa, Influenza virus
GQTIVLDT

SEQ ID NO: 302775 - protein, 8 aa, Influenza virus
QTIVLDTD

SEQ ID NO: 302776 - protein, 8 aa, Influenza virus
TIVLTTDW

SEQ ID NO: 302777 - protein, 8 aa, Influenza virus
SFVDYWAE

SEQ ID NO: 302778 - protein, 8 aa, Influenza virus
FIDYWAEG

SEQ ID NO: 302779 - protein, 8 aa, Influenza virus
DYWAKGDC

SEQ ID NO: 302780 - protein, 8 aa, Influenza virus
YWAKGDCY

SEQ ID NO: 302781 - protein, 8 aa, Influenza virus
WAKGDCYR

SEQ ID NO: 302782 - protein, 8 aa, Influenza virus
AKGDCYRA

SEQ ID NO: 302783 - protein, 8 aa, Influenza virus
KGDCYRAC

SEQ ID NO: 302784 - protein, 8 aa, Influenza virus
GRPKEDEV

SEQ ID NO: 302785 - protein, 8 aa, Influenza virus
RPKEDEVW

SEQ ID NO: 302786 - protein, 8 aa, Influenza virus
PKEDEVWW

SEQ ID NO: 302787 - protein, 8 aa, Influenza virus
KEDEVWWT

SEQ ID NO: 302788 - protein, 8 aa, Influenza virus
EDEVWWTS

SEQ ID NO: 302789 - protein, 8 aa, Influenza virus
DEVWWTSN

SEQ ID NO: 302790 - protein, 8 aa, Influenza virus
DGAKIETL

SEQ ID NO: 302791 - protein, 8 aa, Influenza virus
SLDKICLG

SEQ ID NO: 302792 - protein, 8 aa, Influenza virus
CLGHHAVT

SEQ ID NO: 302793 - protein, 8 aa, Influenza virus
LGHHAVTN

SEQ ID NO: 302794 - protein, 8 aa, Influenza virus
GHHAVTNG

SEQ ID NO: 302795 - protein, 8 aa, Influenza virus
HHAVTNGT

SEQ ID NO: 302796 - protein, 8 aa, Influenza virus
NGTFVKTL

SEQ ID NO: 302797 - protein, 8 aa, Influenza virus
GTFVKTLT

SEQ ID NO: 302798 - protein, 8 aa, Influenza virus
KEKVTNAT

SEQ ID NO: 302799 - protein, 8 aa, Influenza virus
RDLGNCHP

SEQ ID NO: 302800 - protein, 8 aa, Influenza virus
DLDNCHPI

SEQ ID NO: 302801 - protein, 8 aa, Influenza virus
LDNCHPIG

SEQ ID NO: 302802 - protein, 8 aa, Influenza virus
DNCHPIGM

SEQ ID NO: 302803 - protein, 8 aa, Influenza virus
YLTGTWDT

SEQ ID NO: 302804 - protein, 8 aa, Influenza virus
GKWDTPIE

SEQ ID NO: 302805 - protein, 8 aa, Influenza virus
TWDTIIER

SEQ ID NO: 302806 - protein, 8 aa, Influenza virus
WNTLIERD

SEQ ID NO: 302807 - protein, 8 aa, Influenza virus
AYCYPGST

SEQ ID NO: 302808 - protein, 8 aa, Influenza virus
VSEEALRQ

SEQ ID NO: 302809 - protein, 8 aa, Influenza virus
MESGGVNK

SEQ ID NO: 302810 - protein, 8 aa, Influenza virus
SFYAELRW

SEQ ID NO: 302811 - protein, 8 aa, Influenza virus
FYGELKWL

SEQ ID NO: 302812 - protein, 8 aa, Influenza virus
ELRWLVSK

SEQ ID NO: 302813 - protein, 8 aa, Influenza virus
KEQNFPQT

SEQ ID NO: 302814 - protein, 8 aa, Influenza virus
GQSFPQTT

SEQ ID NO: 302815 - protein, 8 aa, Influenza virus
QNFPRTTN

SEQ ID NO: 302816 - protein, 8 aa, Influenza virus
NFPRTTNT

SEQ ID NO: 302817 - protein, 8 aa, Influenza virus
TWGIHHPS

SEQ ID NO: 302818 - protein, 8 aa, Influenza virus
GIHHPSSI

SEQ ID NO: 302819 - protein, 8 aa, Influenza virus
ERNDLYGT

SEQ ID NO: 302820 - protein, 8 aa, Influenza virus
AQSLSISV

SEQ ID NO: 302821 - protein, 8 aa, Influenza virus
QPLSISVG

SEQ ID NO: 302822 - protein, 8 aa, Influenza virus
PLSISVGS

SEQ ID NO: 302823 - protein, 8 aa, Influenza virus
SVGSSTYH

SEQ ID NO: 302824 - protein, 8 aa, Influenza virus
VGSSTYQS

SEQ ID NO: 302825 - protein, 8 aa, Influenza virus
GSSTYQSN

SEQ ID NO: 302826 - protein, 8 aa, Influenza virus
QNNFVPVM

SEQ ID NO: 302827 - protein, 8 aa, Influenza virus
NNFVPVVR

SEQ ID NO: 302828 - protein, 8 aa, Influenza virus
NFVPVVRA

SEQ ID NO: 302829 - protein, 8 aa, Influenza virus
FVPVMGAR

SEQ ID NO: 302830 - protein, 8 aa, Influenza virus
VPVVRARP

SEQ ID NO: 302831 - protein, 8 aa, Influenza virus
PVMGARPQ

SEQ ID NO: 302832 - protein, 8 aa, Influenza virus
VVRARPQV

SEQ ID NO: 302833 - protein, 8 aa, Influenza virus
MGARPQVN

SEQ ID NO: 302834 - protein, 8 aa, Influenza virus
NGQRGRID

SEQ ID NO: 302835 - protein, 8 aa, Influenza virus
GQRGRIDF

SEQ ID NO: 302836 - protein, 8 aa, Influenza virus
QSGRINFH

SEQ ID NO: 302837 - protein, 8 aa, Influenza virus
SGRINFHW

SEQ ID NO: 302838 - protein, 8 aa, Influenza virus
GRIVFHWT

SEQ ID NO: 302839 - protein, 8 aa, Influenza virus
QPGDHITF

SEQ ID NO: 302840 - protein, 8 aa, Influenza virus
PGDHITFS

SEQ ID NO: 302841 - protein, 8 aa, Influenza virus
GHNITFSH

SEQ ID NO: 302842 - protein, 8 aa, Influenza virus
DNITFLHN

SEQ ID NO: 302843 - protein, 8 aa, Influenza virus
NITFLHNG

SEQ ID NO: 302844 - protein, 8 aa, Influenza virus
NGGRIAPS

SEQ ID NO: 302845 - protein, 8 aa, Influenza virus
GGRIAPSR

SEQ ID NO: 302846 - protein, 8 aa, Influenza virus
GRIAPSRV

SEQ ID NO: 302847 - protein, 8 aa, Influenza virus
IAPNRVSK

SEQ ID NO: 302848 - protein, 8 aa, Influenza virus
APSRVSKF

SEQ ID NO: 302849 - protein, 8 aa, Influenza virus
GRGLGVQS

SEQ ID NO: 302850 - protein, 8 aa, Influenza virus
SCESKCFW

SEQ ID NO: 302851 - protein, 8 aa, Influenza virus
FWRGGSII

SEQ ID NO: 302852 - protein, 8 aa, Influenza virus
WRGGSIIT

SEQ ID NO: 302853 - protein, 8 aa, Influenza virus
GGSIITEL

SEQ ID NO: 302854 - protein, 8 aa, Influenza virus
GSIITELP

SEQ ID NO: 302855 - protein, 8 aa, Influenza virus
SIITELPF

SEQ ID NO: 302856 - protein, 8 aa, Influenza virus
IITELPFQ

SEQ ID NO: 302857 - protein, 8 aa, Influenza virus
ITELPFQN

SEQ ID NO: 302858 - protein, 8 aa, Influenza virus
QCPKYVKK

SEQ ID NO: 302859 - protein, 8 aa, Influenza virus
RSLMLATG

SEQ ID NO: 302860 - protein, 8 aa, Influenza virus
DYKSTQKT

SEQ ID NO: 302861 - protein, 8 aa, Influenza virus
YKSTQKTI

SEQ ID NO: 302862 - protein, 8 aa, Influenza virus
TIDQVTGK

SEQ ID NO: 302863 - protein, 8 aa, Influenza virus
INQITGKL

SEQ ID NO: 302864 - protein, 8 aa, Influenza virus
NQITGKLN

SEQ ID NO: 302865 - protein, 8 aa, Influenza virus
SEFNEIEY

SEQ ID NO: 302866 - protein, 8 aa, Influenza virus
EFNEIEYQ

SEQ ID NO: 302867 - protein, 8 aa, Influenza virus
FNEIEYQI

SEQ ID NO: 302868 - protein, 8 aa, Influenza virus
SEIEHQIS

SEQ ID NO: 302869 - protein, 8 aa, Influenza virus
EIEYQIGN

SEQ ID NO: 302870 - protein, 8 aa, Influenza virus
GCFEIYHN

SEQ ID NO: 302871 - protein, 8 aa, Influenza virus
CFEIYHNC

SEQ ID NO: 302872 - protein, 8 aa, Influenza virus
FEIYHNCD

SEQ ID NO: 302873 - protein, 8 aa, Influenza virus
SCMERIRN

SEQ ID NO: 302874 - protein, 8 aa, Influenza virus
RNNTYNHT

SEQ ID NO: 302875 - protein, 8 aa, Influenza virus
NNTYDHSH

SEQ ID NO: 302876 - protein, 8 aa, Influenza virus
NTYNHTQY

SEQ ID NO: 302877 - protein, 8 aa, Influenza virus
TYDHSHYR

SEQ ID NO: 302878 - protein, 8 aa, Influenza virus
YNHTQYRE

SEQ ID NO: 302879 - protein, 8 aa, Influenza virus
DHSHYREE

SEQ ID NO: 302880 - protein, 8 aa, Influenza virus
HSHYREEA

SEQ ID NO: 302881 - protein, 8 aa, Influenza virus
SHYREEAL

SEQ ID NO: 302882 - protein, 8 aa, Influenza virus
EALLNRIN

SEQ ID NO: 302883 - protein, 8 aa, Influenza virus
APLNRLNI

SEQ ID NO: 302884 - protein, 8 aa, Influenza virus
INSVKLFS

SEQ ID NO: 302885 - protein, 8 aa, Influenza virus
NPVKLSSS

SEQ ID NO: 302886 - protein, 8 aa, Influenza virus
PVRLSSGY

SEQ ID NO: 302887 - protein, 8 aa, Influenza virus
VKLFSGYK

SEQ ID NO: 302888 - protein, 8 aa, Influenza virus
RLSSGYKD

SEQ ID NO: 302889 - protein, 8 aa, Influenza virus
SSFVLLAV

SEQ ID NO: 302890 - protein, 8 aa, Influenza virus
FFCLKDGN

SEQ ID NO: 302891 - protein, 8 aa, Influenza virus
LCLKNGNM

SEQ ID NO: 302892 - protein, 8 aa, Influenza virus
CLKDGNMR

SEQ ID NO: 302893 - protein, 8 aa, Influenza virus
SLDKICLG

SEQ ID NO: 302894 - protein, 8 aa, Influenza virus
CLGHHAIP

SEQ ID NO: 302895 - protein, 8 aa, Influenza virus
LGHHAVTN

SEQ ID NO: 302896 - protein, 8 aa, Influenza virus
GHHAIPNG

SEQ ID NO: 302897 - protein, 8 aa, Influenza virus
HHAIPNGT

SEQ ID NO: 302898 - protein, 8 aa, Influenza virus
HAIPNGTI

SEQ ID NO: 302899 - protein, 8 aa, Influenza virus
TNGTIVKT

SEQ ID NO: 302900 - protein, 8 aa, Influenza virus
VKTLTNER

SEQ ID NO: 302901 - protein, 8 aa, Influenza virus
KTLTNERE

SEQ ID NO: 302902 - protein, 8 aa, Influenza virus
TLTNEHEE

SEQ ID NO: 302903 - protein, 8 aa, Influenza virus
LTNEHEEV

SEQ ID NO: 302904 - protein, 8 aa, Influenza virus
EREEVTNA

SEQ ID NO: 302905 - protein, 8 aa, Influenza virus
KEEVINAT

SEQ ID NO: 302906 - protein, 8 aa, Influenza virus
ATETVENK

SEQ ID NO: 302907 - protein, 8 aa, Influenza virus
YKDLDNCH

SEQ ID NO: 302908 - protein, 8 aa, Influenza virus
RDLGNCHP

SEQ ID NO: 302909 - protein, 8 aa, Influenza virus
DLDNCHPI

SEQ ID NO: 302910 - protein, 8 aa, Influenza virus
LDNCHPIG

SEQ ID NO: 302911 - protein, 8 aa, Influenza virus
GNCHPVGM

SEQ ID NO: 302912 - protein, 8 aa, Influenza virus
NCHPIGML

SEQ ID NO: 302913 - protein, 8 aa, Influenza virus
CHPVGMLI

SEQ ID NO: 302914 - protein, 8 aa, Influenza virus
HPVGMLIG

SEQ ID NO: 302915 - protein, 8 aa, Influenza virus
IGAPSCDL

SEQ ID NO: 302916 - protein, 8 aa, Influenza virus
GAPACDLH

SEQ ID NO: 302917 - protein, 8 aa, Influenza virus
APACDLHL

SEQ ID NO: 302918 - protein, 8 aa, Influenza virus
PSCDLHLT

SEQ ID NO: 302919 - protein, 8 aa, Influenza virus
SCDLHLTG

SEQ ID NO: 302920 - protein, 8 aa, Influenza virus
CDLHLTGI

SEQ ID NO: 302921 - protein, 8 aa, Influenza virus
DLHLTGIW

SEQ ID NO: 302922 - protein, 8 aa, Influenza virus
LHLTGMWD

SEQ ID NO: 302923 - protein, 8 aa, Influenza virus
HLTGMWDT

SEQ ID NO: 302924 - protein, 8 aa, Influenza virus
TLIERGSS

SEQ ID NO: 302925 - protein, 8 aa, Influenza virus
SVAYCYPG

SEQ ID NO: 302926 - protein, 8 aa, Influenza virus
IAYCYPGS

SEQ ID NO: 302927 - protein, 8 aa, Influenza virus
AYCYPGST

SEQ ID NO: 302928 - protein, 8 aa, Influenza virus
YCYPGSTV

SEQ ID NO: 302929 - protein, 8 aa, Influenza virus
CYPGSTVN

SEQ ID NO: 302930 - protein, 8 aa, Influenza virus
YPGSTVNE

SEQ ID NO: 302931 - protein, 8 aa, Influenza virus
PGATVNEG

SEQ ID NO: 302932 - protein, 8 aa, Influenza virus
GATVNEGA

SEQ ID NO: 302933 - protein, 8 aa, Influenza virus
ATVNEGAL

SEQ ID NO: 302934 - protein, 8 aa, Influenza virus
ESGGIDKV

SEQ ID NO: 302935 - protein, 8 aa, Influenza virus
SGGISKMS

SEQ ID NO: 302936 - protein, 8 aa, Influenza virus
GGISKMST

SEQ ID NO: 302937 - protein, 8 aa, Influenza virus
FTYESSIN

SEQ ID NO: 302938 - protein, 8 aa, Influenza virus
AYGSSINS

SEQ ID NO: 302939 - protein, 8 aa, Influenza virus
YGSSINST

SEQ ID NO: 302940 - protein, 8 aa, Influenza virus
GASINSAG

SEQ ID NO: 302941 - protein, 8 aa, Influenza virus
SINSAGAT

SEQ ID NO: 302942 - protein, 8 aa, Influenza virus
GRNSFYAE

SEQ ID NO: 302943 - protein, 8 aa, Influenza virus
ENSFYAEL

SEQ ID NO: 302944 - protein, 8 aa, Influenza virus
LKWLISKS

SEQ ID NO: 302945 - protein, 8 aa, Influenza virus
KWLISKSK

SEQ ID NO: 302946 - protein, 8 aa, Influenza virus
WLISKSKE

SEQ ID NO: 302947 - protein, 8 aa, Influenza virus
LVSKDKGR

SEQ ID NO: 302948 - protein, 8 aa, Influenza virus
KEQNFPQT

SEQ ID NO: 302949 - protein, 8 aa, Influenza virus
RNFPQTTN

SEQ ID NO: 302950 - protein, 8 aa, Influenza virus
SFPQTTNT

SEQ ID NO: 302951 - protein, 8 aa, Influenza virus
EHLITWGI

SEQ ID NO: 302952 - protein, 8 aa, Influenza virus
HLIMWGIH

SEQ ID NO: 302953 - protein, 8 aa, Influenza virus
LIMWGIHH

SEQ ID NO: 302954 - protein, 8 aa, Influenza virus
ITWGIHHP

SEQ ID NO: 302955 - protein, 8 aa, Influenza virus
TWGIHHPS

SEQ ID NO: 302956 - protein, 8 aa, Influenza virus
SSTKEKNE

SEQ ID NO: 302957 - protein, 8 aa, Influenza virus
STKEKNEL

SEQ ID NO: 302958 - protein, 8 aa, Influenza virus
TKEKNELY

SEQ ID NO: 302959 - protein, 8 aa, Influenza virus
QERNDLYG

SEQ ID NO: 302960 - protein, 8 aa, Influenza virus
EKNALYGT

SEQ ID NO: 302961 - protein, 8 aa, Influenza virus
KNDLYGAQ

SEQ ID NO: 302962 - protein, 8 aa, Influenza virus
NALYGTQS

SEQ ID NO: 302963 - protein, 8 aa, Influenza virus
ALYGTQSL

SEQ ID NO: 302964 - protein, 8 aa, Influenza virus
QSLSISIG

SEQ ID NO: 302965 - protein, 8 aa, Influenza virus
PLSISVGS

SEQ ID NO: 302966 - protein, 8 aa, Influenza virus
SVGSSIYQ

SEQ ID NO: 302967 - protein, 8 aa, Influenza virus
VGSSTYHN

SEQ ID NO: 302968 - protein, 8 aa, Influenza virus
GSSTYHNS

SEQ ID NO: 302969 - protein, 8 aa, Influenza virus
TVQPGDNI

SEQ ID NO: 302970 - protein, 8 aa, Influenza virus
PSRVSKLT

SEQ ID NO: 302971 - protein, 8 aa, Influenza virus
SRVSKLTG

SEQ ID NO: 302972 - protein, 8 aa, Influenza virus
RDLGIQSE

SEQ ID NO: 302973 - protein, 8 aa, Influenza virus
GLGIQSGS

SEQ ID NO: 302974 - protein, 8 aa, Influenza virus
RGGSINTR

SEQ ID NO: 302975 - protein, 8 aa, Influenza virus
QCPKYVSQ

SEQ ID NO: 302976 - protein, 8 aa, Influenza virus
RSLMLATG

SEQ ID NO: 302977 - protein, 8 aa, Influenza virus
YKSTQKTI

SEQ ID NO: 302978 - protein, 8 aa, Influenza virus
KSTQKTID

SEQ ID NO: 302979 - protein, 8 aa, Influenza virus
TQATIDQI

SEQ ID NO: 302980 - protein, 8 aa, Influenza virus
QATIDQIT

SEQ ID NO: 302981 - protein, 8 aa, Influenza virus
ATIDQITG

SEQ ID NO: 302982 - protein, 8 aa, Influenza virus
TIDQITGK

SEQ ID NO: 302983 - protein, 8 aa, Influenza virus
SEFNEIEY

SEQ ID NO: 302984 - protein, 8 aa, Influenza virus
EFNEIEYQ

SEQ ID NO: 302985 - protein, 8 aa, Influenza virus
FNEIEYQI

SEQ ID NO: 302986 - protein, 8 aa, Influenza virus
NEIEYQIG

SEQ ID NO: 302987 - protein, 8 aa, Influenza virus
GCFEIYHN

SEQ ID NO: 302988 - protein, 8 aa, Influenza virus
CFEIYHNC

SEQ ID NO: 302989 - protein, 8 aa, Influenza virus
FEIYHNCD

SEQ ID NO: 302990 - protein, 8 aa, Influenza virus
CDDNCMER

SEQ ID NO: 302991 - protein, 8 aa, Influenza virus
DDNCMERI

SEQ ID NO: 302992 - protein, 8 aa, Influenza virus
DNCMERIR

SEQ ID NO: 302993 - protein, 8 aa, Influenza virus
PCMESIRN

SEQ ID NO: 302994 - protein, 8 aa, Influenza virus
RLNINPVT

SEQ ID NO: 302995 - protein, 8 aa, Influenza virus
LNINPVTL

SEQ ID NO: 302996 - protein, 8 aa, Influenza virus
NINPVTLS

SEQ ID NO: 302997 - protein, 8 aa, Influenza virus
SCFVLLAI

SEQ ID NO: 302998 - protein, 8 aa, Influenza virus
CFVLLAAI

SEQ ID NO: 302999 - protein, 8 aa, Influenza virus
LLAVIVGL

SEQ ID NO: 303000 - protein, 8 aa, Influenza virus
IVGLVFFC

SEQ ID NO: 303001 - protein, 8 aa, Influenza virus
ALSGMAIA

SEQ ID NO: 303002 - protein, 8 aa, Influenza virus
LSGVAISL

SEQ ID NO: 303003 - protein, 8 aa, Influenza virus
SGMAIALS

SEQ ID NO: 303004 - protein, 8 aa, Influenza virus
FNLLIGIS

SEQ ID NO: 303005 - protein, 8 aa, Influenza virus
ERGTKQEE

SEQ ID NO: 303006 - protein, 8 aa, Influenza virus
TGTAKQNY

SEQ ID NO: 303007 - protein, 8 aa, Influenza virus
VNNTTVIS

SEQ ID NO: 303008 - protein, 8 aa, Influenza virus
NNTTIINK

SEQ ID NO: 303009 - protein, 8 aa, Influenza virus
YLMLSKSL

SEQ ID NO: 303010 - protein, 8 aa, Influenza virus
LMLSKSLC

SEQ ID NO: 303011 - protein, 8 aa, Influenza virus
LLNKSLCS

SEQ ID NO: 303012 - protein, 8 aa, Influenza virus
LSKSLCKV

SEQ ID NO: 303013 - protein, 8 aa, Influenza virus
SKSLCKVE

SEQ ID NO: 303014 - protein, 8 aa, Influenza virus
KRLCKVEG

SEQ ID NO: 303015 - protein, 8 aa, Influenza virus
RLCKVEGW

SEQ ID NO: 303016 - protein, 8 aa, Influenza virus
SCDPSGCK

SEQ ID NO: 303017 - protein, 8 aa, Influenza virus
CDPSGCKM

SEQ ID NO: 303018 - protein, 8 aa, Influenza virus
DPTGCKMY

SEQ ID NO: 303019 - protein, 8 aa, Influenza virus
PTGCKMYA

SEQ ID NO: 303020 - protein, 8 aa, Influenza virus
SGCKMYAL

SEQ ID NO: 303021 - protein, 8 aa, Influenza virus
TPLGSPPM

SEQ ID NO: 303022 - protein, 8 aa, Influenza virus
PLGSPPMV

SEQ ID NO: 303023 - protein, 8 aa, Influenza virus
LGSPPMVS

SEQ ID NO: 303024 - protein, 8 aa, Influenza virus
GSPPMVSN

SEQ ID NO: 303025 - protein, 8 aa, Influenza virus
SPPMVSNS

SEQ ID NO: 303026 - protein, 8 aa, Influenza virus
PPIVSNSE

SEQ ID NO: 303027 - protein, 8 aa, Influenza virus
PIVSNSEF

SEQ ID NO: 303028 - protein, 8 aa, Influenza virus
VSNSDFMC

SEQ ID NO: 303029 - protein, 8 aa, Influenza virus
SNSDFMCV

SEQ ID NO: 303030 - protein, 8 aa, Influenza virus
NSDFMCVG

SEQ ID NO: 303031 - protein, 8 aa, Influenza virus
SDFMCVGW

SEQ ID NO: 303032 - protein, 8 aa, Influenza virus
DFMCVGWS

SEQ ID NO: 303033 - protein, 8 aa, Influenza virus
VGRMTICI

SEQ ID NO: 303034 - protein, 8 aa, Influenza virus
ICVQGNNK

SEQ ID NO: 303035 - protein, 8 aa, Influenza virus
CVQGNNKN

SEQ ID NO: 303036 - protein, 8 aa, Influenza virus
VQGNNKNA

SEQ ID NO: 303037 - protein, 8 aa, Influenza virus
TVYYNRRP

SEQ ID NO: 303038 - protein, 8 aa, Influenza virus
VYYNRRPT

SEQ ID NO: 303039 - protein, 8 aa, Influenza virus
YYNGRLTT

SEQ ID NO: 303040 - protein, 8 aa, Influenza virus
YNRRPTTT

SEQ ID NO: 303041 - protein, 8 aa, Influenza virus
NRRPTTTI

SEQ ID NO: 303042 - protein, 8 aa, Influenza virus
TIKTWAGK

SEQ ID NO: 303043 - protein, 8 aa, Influenza virus
IKTWAGKI

SEQ ID NO: 303044 - protein, 8 aa, Influenza virus
KTWAGKIL

SEQ ID NO: 303045 - protein, 8 aa, Influenza virus
TWAGKILR

SEQ ID NO: 303046 - protein, 8 aa, Influenza virus
VVIMTDGP

SEQ ID NO: 303047 - protein, 8 aa, Influenza virus
IMTDGSAN

SEQ ID NO: 303048 - protein, 8 aa, Influenza virus
MTDGSASG

SEQ ID NO: 303049 - protein, 8 aa, Influenza virus
TDGPANSQ

SEQ ID NO: 303050 - protein, 8 aa, Influenza virus
DGSASGQA

SEQ ID NO: 303051 - protein, 8 aa, Influenza virus
GSANSQAY

SEQ ID NO: 303052 - protein, 8 aa, Influenza virus
PASSQAYT

SEQ ID NO: 303053 - protein, 8 aa, Influenza virus
NSQAYTKV

SEQ ID NO: 303054 - protein, 8 aa, Influenza virus
QAYTKIMY

SEQ ID NO: 303055 - protein, 8 aa, Influenza virus
AYTKIMYF

SEQ ID NO: 303056 - protein, 8 aa, Influenza virus
YTKIMYFH

SEQ ID NO: 303057 - protein, 8 aa, Influenza virus
TKIMYFHK

SEQ ID NO: 303058 - protein, 8 aa, Influenza virus
KILYFHKG

SEQ ID NO: 303059 - protein, 8 aa, Influenza virus
IMYFHKGL

SEQ ID NO: 303060 - protein, 8 aa, Influenza virus
LYFHKGIV

SEQ ID NO: 303061 - protein, 8 aa, Influenza virus
YFHKGLVV

SEQ ID NO: 303062 - protein, 8 aa, Influenza virus
FHKGLVVK

SEQ ID NO: 303063 - protein, 8 aa, Influenza virus
HKGLVVKE

SEQ ID NO: 303064 - protein, 8 aa, Influenza virus
KGLVVKEE

SEQ ID NO: 303065 - protein, 8 aa, Influenza virus
KEEVLKGS

SEQ ID NO: 303066 - protein, 8 aa, Influenza virus
EETLKGSA

SEQ ID NO: 303067 - protein, 8 aa, Influenza virus
ETLKGSAR

SEQ ID NO: 303068 - protein, 8 aa, Influenza virus
VLKGSARH

SEQ ID NO: 303069 - protein, 8 aa, Influenza virus
CSCYGHSQ

SEQ ID NO: 303070 - protein, 8 aa, Influenza virus
SCYGHSQK

SEQ ID NO: 303071 - protein, 8 aa, Influenza virus
CYGHSQKV

SEQ ID NO: 303072 - protein, 8 aa, Influenza virus
YGHSQKVT

SEQ ID NO: 303073 - protein, 8 aa, Influenza virus
GHSQKVTC

SEQ ID NO: 303074 - protein, 8 aa, Influenza virus
SKVTCICR

SEQ ID NO: 303075 - protein, 8 aa, Influenza virus
NRPVIEIN

SEQ ID NO: 303076 - protein, 8 aa, Influenza virus
RPVIEINM

SEQ ID NO: 303077 - protein, 8 aa, Influenza virus
AMDHTSQY

SEQ ID NO: 303078 - protein, 8 aa, Influenza virus
MDHTSQYL

SEQ ID NO: 303079 - protein, 8 aa, Influenza virus
EHTSQYIC

SEQ ID NO: 303080 - protein, 8 aa, Influenza virus
DTSRPGDR

SEQ ID NO: 303081 - protein, 8 aa, Influenza virus
KGFGFLDN

SEQ ID NO: 303082 - protein, 8 aa, Influenza virus
LKIPNAGI

SEQ ID NO: 303083 - protein, 8 aa, Influenza virus
KIPNAGID

SEQ ID NO: 303084 - protein, 8 aa, Influenza virus
IPNAGIDP

SEQ ID NO: 303085 - protein, 8 aa, Influenza virus
PNAGIDPN

SEQ ID NO: 303086 - protein, 8 aa, Influenza virus
NAGIDPNS

SEQ ID NO: 303087 - protein, 8 aa, Influenza virus
ITERQEVV

SEQ ID NO: 303088 - protein, 8 aa, Influenza virus
IERQEIVD

SEQ ID NO: 303089 - protein, 8 aa, Influenza virus
RQEIVDNR

SEQ ID NO: 303090 - protein, 8 aa, Influenza virus
NRNWSGYS

SEQ ID NO: 303091 - protein, 8 aa, Influenza virus
SDWSGYSG

SEQ ID NO: 303092 - protein, 8 aa, Influenza virus
SKCYNPCF

SEQ ID NO: 303093 - protein, 8 aa, Influenza virus
KCYNPCFY

SEQ ID NO: 303094 - protein, 8 aa, Influenza virus
ALCGSPFP

SEQ ID NO: 303095 - protein, 8 aa, Influenza virus
LCGSPFPV

SEQ ID NO: 303096 - protein, 8 aa, Influenza virus
CGSPFPVG

SEQ ID NO: 303097 - protein, 8 aa, Influenza virus
GSPFPVGS

SEQ ID NO: 303098 - protein, 8 aa, Influenza virus
SPFPVGSG

SEQ ID NO: 303099 - protein, 8 aa, Influenza virus
PFPVGSGS

SEQ ID NO: 303100 - protein, 8 aa, Influenza virus
FPVGSGSF

SEQ ID NO: 303101 - protein, 8 aa, Influenza virus
MSNNSTEK

SEQ ID NO: 303102 - protein, 8 aa, Influenza virus
NNSTERVD

SEQ ID NO: 303103 - protein, 8 aa, Influenza virus
NSTERVDT

SEQ ID NO: 303104 - protein, 8 aa, Influenza virus
STERVDTI

SEQ ID NO: 303105 - protein, 8 aa, Influenza virus
TERVDTII

SEQ ID NO: 303106 - protein, 8 aa, Influenza virus
ERVDTIIE

SEQ ID NO: 303107 - protein, 8 aa, Influenza virus
RVDTIIES

SEQ ID NO: 303108 - protein, 8 aa, Influenza virus
NTIIESNV

SEQ ID NO: 303109 - protein, 8 aa, Influenza virus
MHTGSFCS

SEQ ID NO: 303110 - protein, 8 aa, Influenza virus
TFCSINGK

SEQ ID NO: 303111 - protein, 8 aa, Influenza virus
FCSINGRA

SEQ ID NO: 303112 - protein, 8 aa, Influenza virus
CSINGKEP

SEQ ID NO: 303113 - protein, 8 aa, Influenza virus
SINGRAPI

SEQ ID NO: 303114 - protein, 8 aa, Influenza virus
INGKEPIS

SEQ ID NO: 303115 - protein, 8 aa, Influenza virus
NGRAPISL

SEQ ID NO: 303116 - protein, 8 aa, Influenza virus
RAPISLGD

SEQ ID NO: 303117 - protein, 8 aa, Influenza virus
LGNPMCDY

SEQ ID NO: 303118 - protein, 8 aa, Influenza virus
GNPMCDNL

SEQ ID NO: 303119 - protein, 8 aa, Influenza virus
NPMCDNLI

SEQ ID NO: 303120 - protein, 8 aa, Influenza virus
PMCDNLIG

SEQ ID NO: 303121 - protein, 8 aa, Influenza virus
MCDNLIGK

SEQ ID NO: 303122 - protein, 8 aa, Influenza virus
CDYLIGKT

SEQ ID NO: 303123 - protein, 8 aa, Influenza virus
DYLIGKTS

SEQ ID NO: 303124 - protein, 8 aa, Influenza virus
YLIGKTSW

SEQ ID NO: 303125 - protein, 8 aa, Influenza virus
WSYIVEKT

SEQ ID NO: 303126 - protein, 8 aa, Influenza virus
SYIVERPN

SEQ ID NO: 303127 - protein, 8 aa, Influenza virus
YIVEKTNP

SEQ ID NO: 303128 - protein, 8 aa, Influenza virus
NPINGICY

SEQ ID NO: 303129 - protein, 8 aa, Influenza virus
PINGICYP

SEQ ID NO: 303130 - protein, 8 aa, Influenza virus
INGICYPG

SEQ ID NO: 303131 - protein, 8 aa, Influenza virus
ICYPGSLE

SEQ ID NO: 303132 - protein, 8 aa, Influenza virus
EEGLRLKF

SEQ ID NO: 303133 - protein, 8 aa, Influenza virus
SFFRNMIW

SEQ ID NO: 303134 - protein, 8 aa, Influenza virus
FRNMVWLV

SEQ ID NO: 303135 - protein, 8 aa, Influenza virus
MVWLTHQS

SEQ ID NO: 303136 - protein, 8 aa, Influenza virus
WLIDQSGT

SEQ ID NO: 303137 - protein, 8 aa, Influenza virus
LIDQSGTY

SEQ ID NO: 303138 - protein, 8 aa, Influenza virus
IDQSGTYP

SEQ ID NO: 303139 - protein, 8 aa, Influenza virus
YQSGTYPV

SEQ ID NO: 303140 - protein, 8 aa, Influenza virus
QSGTYPII

SEQ ID NO: 303141 - protein, 8 aa, Influenza virus
RIFNNTKG

SEQ ID NO: 303142 - protein, 8 aa, Influenza virus
FNNIKGRD

SEQ ID NO: 303143 - protein, 8 aa, Influenza virus
NNTKGRYV

SEQ ID NO: 303144 - protein, 8 aa, Influenza virus
NTKGRYVL

SEQ ID NO: 303145 - protein, 8 aa, Influenza virus
DLYKKDIS

SEQ ID NO: 303146 - protein, 8 aa, Influenza virus
LYKKDTSY

SEQ ID NO: 303147 - protein, 8 aa, Influenza virus
YKKDISYV

SEQ ID NO: 303148 - protein, 8 aa, Influenza virus
RMTFYWAI

SEQ ID NO: 303149 - protein, 8 aa, Influenza virus
MTFYWAIV

SEQ ID NO: 303150 - protein, 8 aa, Influenza virus
VTFESNGA

SEQ ID NO: 303151 - protein, 8 aa, Influenza virus
TFESNGVF

SEQ ID NO: 303152 - protein, 8 aa, Influenza virus
FESNGALL

SEQ ID NO: 303153 - protein, 8 aa, Influenza virus
ESNGVFLA

SEQ ID NO: 303154 - protein, 8 aa, Influenza virus
SNGALLAP

SEQ ID NO: 303155 - protein, 8 aa, Influenza virus
NGVFLAPR

SEQ ID NO: 303156 - protein, 8 aa, Influenza virus
GAFLAPGY

SEQ ID NO: 303157 - protein, 8 aa, Influenza virus
ALLAPRYA

SEQ ID NO: 303158 - protein, 8 aa, Influenza virus
LLAPRYAF

SEQ ID NO: 303159 - protein, 8 aa, Influenza virus
LAPRYSFE

SEQ ID NO: 303160 - protein, 8 aa, Influenza virus
APGYAFEI

SEQ ID NO: 303161 - protein, 8 aa, Influenza virus
PRYSFELV

SEQ ID NO: 303162 - protein, 8 aa, Influenza virus
GYAFEIVS

SEQ ID NO: 303163 - protein, 8 aa, Influenza virus
GKGKLFRS

SEQ ID NO: 303164 - protein, 8 aa, Influenza virus
GKLFRSNL

SEQ ID NO: 303165 - protein, 8 aa, Influenza virus
CSIKCQSE

SEQ ID NO: 303166 - protein, 8 aa, Influenza virus
RCQSEIGG

SEQ ID NO: 303167 - protein, 8 aa, Influenza virus
CQSEIGWI

SEQ ID NO: 303168 - protein, 8 aa, Influenza virus
QSEIGWIN

SEQ ID NO: 303169 - protein, 8 aa, Influenza virus
SEIGWINT

SEQ ID NO: 303170 - protein, 8 aa, Influenza virus
GIGGINTN

SEQ ID NO: 303171 - protein, 8 aa, Influenza virus
IGWINTNR

SEQ ID NO: 303172 - protein, 8 aa, Influenza virus
GGINTNKN

SEQ ID NO: 303173 - protein, 8 aa, Influenza virus
SFHNVHRS

SEQ ID NO: 303174 - protein, 8 aa, Influenza virus
FQNVHRNT

SEQ ID NO: 303175 - protein, 8 aa, Influenza virus
QNVHRNTI

SEQ ID NO: 303176 - protein, 8 aa, Influenza virus
NVHRSTIG

SEQ ID NO: 303177 - protein, 8 aa, Influenza virus
VHRSTIGD

SEQ ID NO: 303178 - protein, 8 aa, Influenza virus
HRSTIGDC

SEQ ID NO: 303179 - protein, 8 aa, Influenza virus
RNTFGDCP

SEQ ID NO: 303180 - protein, 8 aa, Influenza virus
NTFGDCPK

SEQ ID NO: 303181 - protein, 8 aa, Influenza virus
CPKYVNIK

SEQ ID NO: 303182 - protein, 8 aa, Influenza virus
PKYVNIKS

SEQ ID NO: 303183 - protein, 8 aa, Influenza virus
KYVNIKSL

SEQ ID NO: 303184 - protein, 8 aa, Influenza virus
YVNIKSLK

SEQ ID NO: 303185 - protein, 8 aa, Influenza virus
VNIKSLKL

SEQ ID NO: 303186 - protein, 8 aa, Influenza virus
IKSLKLAT

SEQ ID NO: 303187 - protein, 8 aa, Influenza virus
KSLKLVTG

SEQ ID NO: 303188 - protein, 8 aa, Influenza virus
SLKLAIGP

SEQ ID NO: 303189 - protein, 8 aa, Influenza virus
LKLAIGPR

SEQ ID NO: 303190 - protein, 8 aa, Influenza virus
KLVTGLRN

SEQ ID NO: 303191 - protein, 8 aa, Influenza virus
LASGLRNV

SEQ ID NO: 303192 - protein, 8 aa, Influenza virus
ASGLRNVP

SEQ ID NO: 303193 - protein, 8 aa, Influenza virus
SGLRNVPA

SEQ ID NO: 303194 - protein, 8 aa, Influenza virus
LRNVPAIS

SEQ ID NO: 303195 - protein, 8 aa, Influenza virus
SRGLFGAK

SEQ ID NO: 303196 - protein, 8 aa, Influenza virus
ADKESTQE

SEQ ID NO: 303197 - protein, 8 aa, Influenza virus
DKESTQEA

SEQ ID NO: 303198 - protein, 8 aa, Influenza virus
NNIIDRMN

SEQ ID NO: 303199 - protein, 8 aa, Influenza virus
IEERINRL

SEQ ID NO: 303200 - protein, 8 aa, Influenza virus
EERINRLS

SEQ ID NO: 303201 - protein, 8 aa, Influenza virus
LDIWSYNA

SEQ ID NO: 303202 - protein, 8 aa, Influenza virus
DIWSYNAK

SEQ ID NO: 303203 - protein, 8 aa, Influenza virus
NVKNLHEK

SEQ ID NO: 303204 - protein, 8 aa, Influenza virus
SLHEKVRR

SEQ ID NO: 303205 - protein, 8 aa, Influenza virus
LHEKIRRM

SEQ ID NO: 303206 - protein, 8 aa, Influenza virus
HEKIRRML

SEQ ID NO: 303207 - protein, 8 aa, Influenza virus
LQDNAKDE

SEQ ID NO: 303208 - protein, 8 aa, Influenza virus
KNNAKDEG

SEQ ID NO: 303209 - protein, 8 aa, Influenza virus
PFYHKCDN

SEQ ID NO: 303210 - protein, 8 aa, Influenza virus
FYHKCNNE

SEQ ID NO: 303211 - protein, 8 aa, Influenza virus
YHKCNNEC

SEQ ID NO: 303212 - protein, 8 aa, Influenza virus
HKCNNECI

SEQ ID NO: 303213 - protein, 8 aa, Influenza virus
KCNNECIE

SEQ ID NO: 303214 - protein, 8 aa, Influenza virus
DECIEKVR

SEQ ID NO: 303215 - protein, 8 aa, Influenza virus
ECIEKIRN

SEQ ID NO: 303216 - protein, 8 aa, Influenza virus
KDFEEESK

SEQ ID NO: 303217 - protein, 8 aa, Influenza virus
EESRINRQ

SEQ ID NO: 303218 - protein, 8 aa, Influenza virus
ESRINRQE

SEQ ID NO: 303219 - protein, 8 aa, Influenza virus
SRINRQEI

SEQ ID NO: 303220 - protein, 8 aa, Influenza virus
RINRQEIE

SEQ ID NO: 303221 - protein, 8 aa, Influenza virus
RQEVEGVK

SEQ ID NO: 303222 - protein, 8 aa, Influenza virus
QEVEGVKL

SEQ ID NO: 303223 - protein, 8 aa, Influenza virus
EIGGVKLD

SEQ ID NO: 303224 - protein, 8 aa, Influenza virus
SSLVLAAS

SEQ ID NO: 303225 - protein, 8 aa, Influenza virus
SLVLAALN

SEQ ID NO: 303226 - protein, 8 aa, Influenza virus
LVLAALNM

SEQ ID NO: 303227 - protein, 8 aa, Influenza virus
VLAALNMG

SEQ ID NO: 303228 - protein, 8 aa, Influenza virus
LAALNMGF

SEQ ID NO: 303229 - protein, 8 aa, Influenza virus
WVCSNGSC

SEQ ID NO: 303230 - protein, 8 aa, Influenza virus
VCSNGSCR

SEQ ID NO: 303231 - protein, 8 aa, Influenza virus
MKKFIILS

SEQ ID NO: 303232 - protein, 8 aa, Influenza virus
KKFIILST

SEQ ID NO: 303233 - protein, 8 aa, Influenza virus
TETVNTLT

SEQ ID NO: 303234 - protein, 8 aa, Influenza virus
ETVNTLTE

SEQ ID NO: 303235 - protein, 8 aa, Influenza virus
NTLIEQNI

SEQ ID NO: 303236 - protein, 8 aa, Influenza virus
TLIEQNIP

SEQ ID NO: 303237 - protein, 8 aa, Influenza virus
LIEQNIPV

SEQ ID NO: 303238 - protein, 8 aa, Influenza virus
IEQNIPVT

SEQ ID NO: 303239 - protein, 8 aa, Influenza virus
EELVHRGI

SEQ ID NO: 303240 - protein, 8 aa, Influenza virus
ELVHRGID

SEQ ID NO: 303241 - protein, 8 aa, Influenza virus
LVHRGIDP

SEQ ID NO: 303242 - protein, 8 aa, Influenza virus
DCSLKGLI

SEQ ID NO: 303243 - protein, 8 aa, Influenza virus
CSLEGLVL

SEQ ID NO: 303244 - protein, 8 aa, Influenza virus
SLKGLILG

SEQ ID NO: 303245 - protein, 8 aa, Influenza virus
LEGLILSN

SEQ ID NO: 303246 - protein, 8 aa, Influenza virus
EGLVLGNP

SEQ ID NO: 303247 - protein, 8 aa, Influenza virus
GLVLGNPK

SEQ ID NO: 303248 - protein, 8 aa, Influenza virus
LVLGNPKC

SEQ ID NO: 303249 - protein, 8 aa, Influenza virus
RPKEIEGI

SEQ ID NO: 303250 - protein, 8 aa, Influenza virus
PKEIEGIC

SEQ ID NO: 303251 - protein, 8 aa, Influenza virus
ICYPGSVE

SEQ ID NO: 303252 - protein, 8 aa, Influenza virus
VENQEELR

SEQ ID NO: 303253 - protein, 8 aa, Influenza virus
KNQEELRS

SEQ ID NO: 303254 - protein, 8 aa, Influenza virus
FTKWNVTH

SEQ ID NO: 303255 - protein, 8 aa, Influenza virus
TKWNVTHT

SEQ ID NO: 303256 - protein, 8 aa, Influenza virus
VTHTGTSK

SEQ ID NO: 303257 - protein, 8 aa, Influenza virus
THTGTSKA

SEQ ID NO: 303258 - protein, 8 aa, Influenza virus
HTGTSKAC

SEQ ID NO: 303259 - protein, 8 aa, Influenza virus
SKACNDIS

SEQ ID NO: 303260 - protein, 8 aa, Influenza virus
KACNSISN

SEQ ID NO: 303261 - protein, 8 aa, Influenza virus
ACNNTSNR

SEQ ID NO: 303262 - protein, 8 aa, Influenza virus
TSNQDSFY

SEQ ID NO: 303263 - protein, 8 aa, Influenza virus
NQDSFYRS

SEQ ID NO: 303264 - protein, 8 aa, Influenza virus
RGSFYRSM

SEQ ID NO: 303265 - protein, 8 aa, Influenza virus
DSFYRSMK

SEQ ID NO: 303266 - protein, 8 aa, Influenza virus
SFYRSMKW

SEQ ID NO: 303267 - protein, 8 aa, Influenza virus
FYRSMKWL

SEQ ID NO: 303268 - protein, 8 aa, Influenza virus
YRSMKWLT

SEQ ID NO: 303269 - protein, 8 aa, Influenza virus
RSMKWLTL

SEQ ID NO: 303270 - protein, 8 aa, Influenza virus
SMKWLTLK

SEQ ID NO: 303271 - protein, 8 aa, Influenza virus
MKWLTLKS

SEQ ID NO: 303272 - protein, 8 aa, Influenza virus
KWLTLKSG

SEQ ID NO: 303273 - protein, 8 aa, Influenza virus
IHHPPTSA

SEQ ID NO: 303274 - protein, 8 aa, Influenza virus
HHPPTSAE

SEQ ID NO: 303275 - protein, 8 aa, Influenza virus
HPPTSAEQ

SEQ ID NO: 303276 - protein, 8 aa, Influenza virus
PPTTDEQM

SEQ ID NO: 303277 - protein, 8 aa, Influenza virus
EIDRSFRP

SEQ ID NO: 303278 - protein, 8 aa, Influenza virus
IDRSFRPN

SEQ ID NO: 303279 - protein, 8 aa, Influenza virus
DRSFRPNI

SEQ ID NO: 303280 - protein, 8 aa, Influenza virus
RNFKPNIG

SEQ ID NO: 303281 - protein, 8 aa, Influenza virus
NFKPNIGP

SEQ ID NO: 303282 - protein, 8 aa, Influenza virus
IGPRPLIR

SEQ ID NO: 303283 - protein, 8 aa, Influenza virus
GPRPLVMG

SEQ ID NO: 303284 - protein, 8 aa, Influenza virus
PRPLVMGQ

SEQ ID NO: 303285 - protein, 8 aa, Influenza virus
RPLIRGQQ

SEQ ID NO: 303286 - protein, 8 aa, Influenza virus
PLIRGQQG

SEQ ID NO: 303287 - protein, 8 aa, Influenza virus
LVMGQQGR

SEQ ID NO: 303288 - protein, 8 aa, Influenza virus
VMGQQGRM

SEQ ID NO: 303289 - protein, 8 aa, Influenza virus
APEYGYLI

SEQ ID NO: 303290 - protein, 8 aa, Influenza virus
PEYGHLTT

SEQ ID NO: 303291 - protein, 8 aa, Influenza virus
EYGHLTTG

SEQ ID NO: 303292 - protein, 8 aa, Influenza virus
YGYLITGK

SEQ ID NO: 303293 - protein, 8 aa, Influenza virus
GYLITGKS

SEQ ID NO: 303294 - protein, 8 aa, Influenza virus
HLTTGKSH

SEQ ID NO: 303295 - protein, 8 aa, Influenza virus
LKNNLPMG

SEQ ID NO: 303296 - protein, 8 aa, Influenza virus
ECQLNEGI

SEQ ID NO: 303297 - protein, 8 aa, Influenza virus
VMNTSKPL

SEQ ID NO: 303298 - protein, 8 aa, Influenza virus
KPFQNTSR

SEQ ID NO: 303299 - protein, 8 aa, Influenza virus
PFQNTSRH

SEQ ID NO: 303300 - protein, 8 aa, Influenza virus
LQNTSKHY

SEQ ID NO: 303301 - protein, 8 aa, Influenza virus
CPKYIPSR

SEQ ID NO: 303302 - protein, 8 aa, Influenza virus
PKYIPSRS

SEQ ID NO: 303303 - protein, 8 aa, Influenza virus
KYIPSRSL

SEQ ID NO: 303304 - protein, 8 aa, Influenza virus
YIPSRSLK

SEQ ID NO: 303305 - protein, 8 aa, Influenza virus
IPSRSLKL

SEQ ID NO: 303306 - protein, 8 aa, Influenza virus
SSGSLKLA

SEQ ID NO: 303307 - protein, 8 aa, Influenza virus
GPRNVPQA

SEQ ID NO: 303308 - protein, 8 aa, Influenza virus
LRNVPQIQ

SEQ ID NO: 303309 - protein, 8 aa, Influenza virus
RNVPQVQD

SEQ ID NO: 303310 - protein, 8 aa, Influenza virus
NVPQVQDR

SEQ ID NO: 303311 - protein, 8 aa, Influenza virus
VPQVQDRG

SEQ ID NO: 303312 - protein, 8 aa, Influenza virus
PQVQDRGL

SEQ ID NO: 303313 - protein, 8 aa, Influenza virus
QVQDRGLF

SEQ ID NO: 303314 - protein, 8 aa, Influenza virus
VQDRGLFG

SEQ ID NO: 303315 - protein, 8 aa, Influenza virus
DRGLFGAK

SEQ ID NO: 303316 - protein, 8 aa, Influenza virus
QNAEGIGI

SEQ ID NO: 303317 - protein, 8 aa, Influenza virus
NAEGIGIA

SEQ ID NO: 303318 - protein, 8 aa, Influenza virus
SEGTGIVA

SEQ ID NO: 303319 - protein, 8 aa, Influenza virus
EGTGIVAD

SEQ ID NO: 303320 - protein, 8 aa, Influenza virus
GIGIAADR

SEQ ID NO: 303321 - protein, 8 aa, Influenza virus
IGIAADRD

SEQ ID NO: 303322 - protein, 8 aa, Influenza virus
GIVADRDS

SEQ ID NO: 303323 - protein, 8 aa, Influenza virus
IVADRDST

SEQ ID NO: 303324 - protein, 8 aa, Influenza virus
ADRGSTQK

SEQ ID NO: 303325 - protein, 8 aa, Influenza virus
DRGSTQKA

SEQ ID NO: 303326 - protein, 8 aa, Influenza virus
RGSTQKAI

SEQ ID NO: 303327 - protein, 8 aa, Influenza virus
GSTQKAID

SEQ ID NO: 303328 - protein, 8 aa, Influenza virus
STQKAIDI

SEQ ID NO: 303329 - protein, 8 aa, Influenza virus
TQKAIDIM

SEQ ID NO: 303330 - protein, 8 aa, Influenza virus
QKAIDIMQ

SEQ ID NO: 303331 - protein, 8 aa, Influenza virus
KAIDIMQN

SEQ ID NO: 303332 - protein, 8 aa, Influenza virus
IDKMNNQF

SEQ ID NO: 303333 - protein, 8 aa, Influenza virus
EFSEVGSR

SEQ ID NO: 303334 - protein, 8 aa, Influenza virus
FSEVEIRI

SEQ ID NO: 303335 - protein, 8 aa, Influenza virus
SEVGSRIN

SEQ ID NO: 303336 - protein, 8 aa, Influenza virus
VGSRINMI

SEQ ID NO: 303337 - protein, 8 aa, Influenza virus
EIRINMIN

SEQ ID NO: 303338 - protein, 8 aa, Influenza virus
SRINTINS

SEQ ID NO: 303339 - protein, 8 aa, Influenza virus
NMINSQID

SEQ ID NO: 303340 - protein, 8 aa, Influenza virus
MINSQIDD

SEQ ID NO: 303341 - protein, 8 aa, Influenza virus
INSKINDQ

SEQ ID NO: 303342 - protein, 8 aa, Influenza virus
NSKIEDQI

SEQ ID NO: 303343 - protein, 8 aa, Influenza virus
INDQITDI

SEQ ID NO: 303344 - protein, 8 aa, Influenza virus
DDQIIDIW

SEQ ID NO: 303345 - protein, 8 aa, Influenza virus
VRNLHDRT

SEQ ID NO: 303346 - protein, 8 aa, Influenza virus
RNLHDRTR

SEQ ID NO: 303347 - protein, 8 aa, Influenza virus
NLHDRTRR

SEQ ID NO: 303348 - protein, 8 aa, Influenza virus
RRILKENA

SEQ ID NO: 303349 - protein, 8 aa, Influenza virus
RILKENAL

SEQ ID NO: 303350 - protein, 8 aa, Influenza virus
ILKENALD

SEQ ID NO: 303351 - protein, 8 aa, Influenza virus
ENAIDAGD

SEQ ID NO: 303352 - protein, 8 aa, Influenza virus
NALDTGDG

SEQ ID NO: 303353 - protein, 8 aa, Influenza virus
AVDTGDGC

SEQ ID NO: 303354 - protein, 8 aa, Influenza virus
VDTGDGCF

SEQ ID NO: 303355 - protein, 8 aa, Influenza virus
FEILHKCN

SEQ ID NO: 303356 - protein, 8 aa, Influenza virus
EILHRCND

SEQ ID NO: 303357 - protein, 8 aa, Influenza virus
RNGTYNHQ

SEQ ID NO: 303358 - protein, 8 aa, Influenza virus
GTYNHQEY

SEQ ID NO: 303359 - protein, 8 aa, Influenza virus
TYNHQEYE

SEQ ID NO: 303360 - protein, 8 aa, Influenza virus
YEDESRIE

SEQ ID NO: 303361 - protein, 8 aa, Influenza virus
EDESRIER

SEQ ID NO: 303362 - protein, 8 aa, Influenza virus
EESRIERQ

SEQ ID NO: 303363 - protein, 8 aa, Influenza virus
ESKLERQR

SEQ ID NO: 303364 - protein, 8 aa, Influenza virus
SKLERQRI

SEQ ID NO: 303365 - protein, 8 aa, Influenza virus
ERQKISGV

SEQ ID NO: 303366 - protein, 8 aa, Influenza virus
RQKISGVK

SEQ ID NO: 303367 - protein, 8 aa, Influenza virus
QKISGVKL

SEQ ID NO: 303368 - protein, 8 aa, Influenza virus
KISGVKLE

SEQ ID NO: 303369 - protein, 8 aa, Influenza virus
LSTNSSDK

SEQ ID NO: 303370 - protein, 8 aa, Influenza virus
STNSSDKV

SEQ ID NO: 303371 - protein, 8 aa, Influenza virus
TNSSDKVD

SEQ ID NO: 303372 - protein, 8 aa, Influenza virus
NSSEKVNT

SEQ ID NO: 303373 - protein, 8 aa, Influenza virus
SSEKVNTL

SEQ ID NO: 303374 - protein, 8 aa, Influenza virus
SEKVNTLL

SEQ ID NO: 303375 - protein, 8 aa, Influenza virus
EKVNTLLE

SEQ ID NO: 303376 - protein, 8 aa, Influenza virus
KVNTLLEN

SEQ ID NO: 303377 - protein, 8 aa, Influenza virus
VNTLLEND

SEQ ID NO: 303378 - protein, 8 aa, Influenza virus
NTLLENDV

SEQ ID NO: 303379 - protein, 8 aa, Influenza virus
TLLESDVP

SEQ ID NO: 303380 - protein, 8 aa, Influenza virus
LLESDVPV

SEQ ID NO: 303381 - protein, 8 aa, Influenza virus
LESDVPVT

SEQ ID NO: 303382 - protein, 8 aa, Influenza virus
ESDVPVTS

SEQ ID NO: 303383 - protein, 8 aa, Influenza virus
SDVPVTSS

SEQ ID NO: 303384 - protein, 8 aa, Influenza virus
VTSSIDLV

SEQ ID NO: 303385 - protein, 8 aa, Influenza virus
TSSIDLVE

SEQ ID NO: 303386 - protein, 8 aa, Influenza virus
SSIDLVET

SEQ ID NO: 303387 - protein, 8 aa, Influenza virus
DLIETTHT

SEQ ID NO: 303388 - protein, 8 aa, Influenza virus
LIETTHTG

SEQ ID NO: 303389 - protein, 8 aa, Influenza virus
IETTHTGT

SEQ ID NO: 303390 - protein, 8 aa, Influenza virus
TGTYCSLS

SEQ ID NO: 303391 - protein, 8 aa, Influenza virus
GTYCSLSG

SEQ ID NO: 303392 - protein, 8 aa, Influenza virus
CSFEGWIG

SEQ ID NO: 303393 - protein, 8 aa, Influenza virus
SFEGWIGG

SEQ ID NO: 303394 - protein, 8 aa, Influenza virus
SYLIEDPT

SEQ ID NO: 303395 - protein, 8 aa, Influenza virus
YLIEDPAA

SEQ ID NO: 303396 - protein, 8 aa, Influenza virus
LIEDPTAP

SEQ ID NO: 303397 - protein, 8 aa, Influenza virus
IEDPTAPH

SEQ ID NO: 303398 - protein, 8 aa, Influenza virus
EDPAAPHG

SEQ ID NO: 303399 - protein, 8 aa, Influenza virus
DPAAPHGL

SEQ ID NO: 303400 - protein, 8 aa, Influenza virus
PAAPHGLC

SEQ ID NO: 303401 - protein, 8 aa, Influenza virus
AAPHGLCY

SEQ ID NO: 303402 - protein, 8 aa, Influenza virus
LIAPASWG

SEQ ID NO: 303403 - protein, 8 aa, Influenza virus
SWGDLLDG

SEQ ID NO: 303404 - protein, 8 aa, Influenza virus
KGFNSFYR

SEQ ID NO: 303405 - protein, 8 aa, Influenza virus
SFYRNLAW

SEQ ID NO: 303406 - protein, 8 aa, Influenza virus
FYRNLAWF

SEQ ID NO: 303407 - protein, 8 aa, Influenza virus
YRNLVWLV

SEQ ID NO: 303408 - protein, 8 aa, Influenza virus
GAYNNTTG

SEQ ID NO: 303409 - protein, 8 aa, Influenza virus
DVLVMWGL

SEQ ID NO: 303410 - protein, 8 aa, Influenza virus
VLVMWGLH

SEQ ID NO: 303411 - protein, 8 aa, Influenza virus
LVMWGLHH

SEQ ID NO: 303412 - protein, 8 aa, Influenza virus
VMWGLHHP

SEQ ID NO: 303413 - protein, 8 aa, Influenza virus
WGLHHPVS

SEQ ID NO: 303414 - protein, 8 aa, Influenza virus
PYTLVSTR

SEQ ID NO: 303415 - protein, 8 aa, Influenza virus
YTLVSTRS

SEQ ID NO: 303416 - protein, 8 aa, Influenza virus
TLVSTRSW

SEQ ID NO: 303417 - protein, 8 aa, Influenza virus
LVSTRSWS

SEQ ID NO: 303418 - protein, 8 aa, Influenza virus
GVRPRYNG

SEQ ID NO: 303419 - protein, 8 aa, Influenza virus
VRPRYNGQ

SEQ ID NO: 303420 - protein, 8 aa, Influenza virus
SWMKIYWD

SEQ ID NO: 303421 - protein, 8 aa, Influenza virus
WMKIYWDL

SEQ ID NO: 303422 - protein, 8 aa, Influenza virus
RGRIFQSR

SEQ ID NO: 303423 - protein, 8 aa, Influenza virus
RIFQSRII

SEQ ID NO: 303424 - protein, 8 aa, Influenza virus
RTFQNIDR

SEQ ID NO: 303425 - protein, 8 aa, Influenza virus
IDKNALGE

SEQ ID NO: 303426 - protein, 8 aa, Influenza virus
DRNALGDC

SEQ ID NO: 303427 - protein, 8 aa, Influenza virus
KNALGECP

SEQ ID NO: 303428 - protein, 8 aa, Influenza virus
TGLRNVPS

SEQ ID NO: 303429 - protein, 8 aa, Influenza virus
RGFFGAIA

SEQ ID NO: 303430 - protein, 8 aa, Influenza virus
AVDGTIAG

SEQ ID NO: 303431 - protein, 8 aa, Influenza virus
VDGTIAGF

SEQ ID NO: 303432 - protein, 8 aa, Influenza virus
QNEQGMGM

SEQ ID NO: 303433 - protein, 8 aa, Influenza virus
NEQGMGMA

SEQ ID NO: 303434 - protein, 8 aa, Influenza virus
EQGMGMAA

SEQ ID NO: 303435 - protein, 8 aa, Influenza virus
QGTGIAAE

SEQ ID NO: 303436 - protein, 8 aa, Influenza virus
GTGIAAEK

SEQ ID NO: 303437 - protein, 8 aa, Influenza virus
TGIAAEKE

SEQ ID NO: 303438 - protein, 8 aa, Influenza virus
GEFSQVER

SEQ ID NO: 303439 - protein, 8 aa, Influenza virus
EFSQVERR

SEQ ID NO: 303440 - protein, 8 aa, Influenza virus
FSQVERRI

SEQ ID NO: 303441 - protein, 8 aa, Influenza virus
SQVERRIN

SEQ ID NO: 303442 - protein, 8 aa, Influenza virus
QVERRINM

SEQ ID NO: 303443 - protein, 8 aa, Influenza virus
VERRINML

SEQ ID NO: 303444 - protein, 8 aa, Influenza virus
ERRINMLA

SEQ ID NO: 303445 - protein, 8 aa, Influenza virus
RRINMLAD

SEQ ID NO: 303446 - protein, 8 aa, Influenza virus
DLHDANVR

SEQ ID NO: 303447 - protein, 8 aa, Influenza virus
VRNLHDQI

SEQ ID NO: 303448 - protein, 8 aa, Influenza virus
RNLHDQIR

SEQ ID NO: 303449 - protein, 8 aa, Influenza virus
NLHEQVRK

SEQ ID NO: 303450 - protein, 8 aa, Influenza virus
KCNNTCME

SEQ ID NO: 303451 - protein, 8 aa, Influenza virus
CNNTCMET

SEQ ID NO: 303452 - protein, 8 aa, Influenza virus
NDSCMDTI

SEQ ID NO: 303453 - protein, 8 aa, Influenza virus
NTCMETIR

SEQ ID NO: 303454 - protein, 8 aa, Influenza virus
RNGTYNHS

SEQ ID NO: 303455 - protein, 8 aa, Influenza virus
RQEIEGIR

SEQ ID NO: 303456 - protein, 8 aa, Influenza virus
QEIEGIRL

SEQ ID NO: 303457 - protein, 8 aa, Influenza virus
EIEGIRLK

SEQ ID NO: 303458 - protein, 8 aa, Influenza virus
IEGIRLKS

SEQ ID NO: 303459 - protein, 8 aa, Influenza virus
GIKLESED

SEQ ID NO: 303460 - protein, 8 aa, Influenza virus
LKSEDGVY

SEQ ID NO: 303461 - protein, 8 aa, Influenza virus
SEDGVYKA

SEQ ID NO: 303462 - protein, 8 aa, Influenza virus
EDGVYKAL

SEQ ID NO: 303463 - protein, 8 aa, Influenza virus
DNVYRALS

SEQ ID NO: 303464 - protein, 8 aa, Influenza virus
NVYRALSI

SEQ ID NO: 303465 - protein, 8 aa, Influenza virus
SSVVLVGP

SEQ ID NO: 303466 - protein, 8 aa, Influenza virus
SVVLVGPI

SEQ ID NO: 303467 - protein, 8 aa, Influenza virus
VVLVGPIL

SEQ ID NO: 303468 - protein, 8 aa, Influenza virus
VLVGPILS

SEQ ID NO: 303469 - protein, 8 aa, Influenza virus
LVGPILSF

SEQ ID NO: 303470 - protein, 8 aa, Influenza virus
VGLILTFI

SEQ ID NO: 303471 - protein, 8 aa, Influenza virus
GLILTFIM

SEQ ID NO: 303472 - protein, 8 aa, Influenza virus
PILSFIMW

SEQ ID NO: 303473 - protein, 8 aa, Influenza virus
ILTFIMWA

SEQ ID NO: 303474 - protein, 8 aa, Influenza virus
LTFIMWAC

SEQ ID NO: 303475 - protein, 8 aa, Influenza virus
FIMWACNS

SEQ ID NO: 303476 - protein, 8 aa, Influenza virus
IMWACNSG

SEQ ID NO: 303477 - protein, 8 aa, Influenza virus
MWACNSGN

SEQ ID NO: 303478 - protein, 8 aa, Influenza virus
WACNSGNC

SEQ ID NO: 303479 - protein, 8 aa, Influenza virus
ACNSGNCR

SEQ ID NO: 303480 - protein, 8 aa, Influenza virus
CSNGNCRF

SEQ ID NO: 303481 - protein, 8 aa, Influenza virus
SNGNCRFN

SEQ ID NO: 303482 - protein, 8 aa, Influenza virus
KWLLSSKD

SEQ ID NO: 303483 - protein, 8 aa, Influenza virus
WLLSSKDN

SEQ ID NO: 303484 - protein, 8 aa, Influenza virus
LSSSGNNQ

SEQ ID NO: 303485 - protein, 8 aa, Influenza virus
LSSKDNQV

SEQ ID NO: 303486 - protein, 8 aa, Influenza virus
SSGNNQVF

SEQ ID NO: 303487 - protein, 8 aa, Influenza virus
SGNNQVFP

SEQ ID NO: 303488 - protein, 8 aa, Influenza virus
KDNQVFPQ

SEQ ID NO: 303489 - protein, 8 aa, Influenza virus
GRYSRADK

SEQ ID NO: 303490 - protein, 8 aa, Influenza virus
RYSRADKI

SEQ ID NO: 303491 - protein, 8 aa, Influenza virus
LSNNATDT

SEQ ID NO: 303492 - protein, 8 aa, Influenza virus
SNNSTDKI

SEQ ID NO: 303493 - protein, 8 aa, Influenza virus
NNSTDKID

SEQ ID NO: 303494 - protein, 8 aa, Influenza virus
NSTDKIDT

SEQ ID NO: 303495 - protein, 8 aa, Influenza virus
STDKIDTL

SEQ ID NO: 303496 - protein, 8 aa, Influenza virus
TDKIDTLT

SEQ ID NO: 303497 - protein, 8 aa, Influenza virus
KVDTLTET

SEQ ID NO: 303498 - protein, 8 aa, Influenza virus
SLNGISPV

SEQ ID NO: 303499 - protein, 8 aa, Influenza virus
LNGISPVH

SEQ ID NO: 303500 - protein, 8 aa, Influenza virus
NGISPVHL

SEQ ID NO: 303501 - protein, 8 aa, Influenza virus
GISPVHLG

SEQ ID NO: 303502 - protein, 8 aa, Influenza virus
ISPVHLGD

SEQ ID NO: 303503 - protein, 8 aa, Influenza virus
NAPHKLCY

SEQ ID NO: 303504 - protein, 8 aa, Influenza virus
APHKLCYP

SEQ ID NO: 303505 - protein, 8 aa, Influenza virus
PHKLCYPG

SEQ ID NO: 303506 - protein, 8 aa, Influenza virus
HKLCYPGE

SEQ ID NO: 303507 - protein, 8 aa, Influenza virus
KLCYPGEV

SEQ ID NO: 303508 - protein, 8 aa, Influenza virus
FCYPGELD

SEQ ID NO: 303509 - protein, 8 aa, Influenza virus
CYPGEVDN

SEQ ID NO: 303510 - protein, 8 aa, Influenza virus
YPGEVDNN

SEQ ID NO: 303511 - protein, 8 aa, Influenza virus
RTELINPN

SEQ ID NO: 303512 - protein, 8 aa, Influenza virus
TELINPNK

SEQ ID NO: 303513 - protein, 8 aa, Influenza virus
ELINPNKW

SEQ ID NO: 303514 - protein, 8 aa, Influenza virus
LINPNKWG

SEQ ID NO: 303515 - protein, 8 aa, Influenza virus
PNKWGNVL

SEQ ID NO: 303516 - protein, 8 aa, Influenza virus
NKWGNVLD

SEQ ID NO: 303517 - protein, 8 aa, Influenza virus
KWGDILDG

SEQ ID NO: 303518 - protein, 8 aa, Influenza virus
WGDILDGV

SEQ ID NO: 303519 - protein, 8 aa, Influenza virus
GDILDGVT

SEQ ID NO: 303520 - protein, 8 aa, Influenza virus
DILDGVTA

SEQ ID NO: 303521 - protein, 8 aa, Influenza virus
VTASCRDN

SEQ ID NO: 303522 - protein, 8 aa, Influenza virus
TASCRDNG

SEQ ID NO: 303523 - protein, 8 aa, Influenza virus
ASCLDRGT

SEQ ID NO: 303524 - protein, 8 aa, Influenza virus
GAKSFYRN

SEQ ID NO: 303525 - protein, 8 aa, Influenza virus
ADSFYRNL

SEQ ID NO: 303526 - protein, 8 aa, Influenza virus
KSFYRNLV

SEQ ID NO: 303527 - protein, 8 aa, Influenza virus
RNLIWLVK

SEQ ID NO: 303528 - protein, 8 aa, Influenza virus
VRGDYNNT

SEQ ID NO: 303529 - protein, 8 aa, Influenza virus
IHHPDTEE

SEQ ID NO: 303530 - protein, 8 aa, Influenza virus
HHPDTEEV

SEQ ID NO: 303531 - protein, 8 aa, Influenza virus
HPDTEEVA

SEQ ID NO: 303532 - protein, 8 aa, Influenza virus
ATRLYVNK

SEQ ID NO: 303533 - protein, 8 aa, Influenza virus
TRLYVNKN

SEQ ID NO: 303534 - protein, 8 aa, Influenza virus
RLYVNKNP

SEQ ID NO: 303535 - protein, 8 aa, Influenza virus
KLYWHLMS

SEQ ID NO: 303536 - protein, 8 aa, Influenza virus
LYWHLMSP

SEQ ID NO: 303537 - protein, 8 aa, Influenza virus
LMRPGERT

SEQ ID NO: 303538 - protein, 8 aa, Influenza virus
ERTTFESN

SEQ ID NO: 303539 - protein, 8 aa, Influenza virus
RTTFESNG

SEQ ID NO: 303540 - protein, 8 aa, Influenza virus
TTFESNGG

SEQ ID NO: 303541 - protein, 8 aa, Influenza virus
IFQSRIRM

SEQ ID NO: 303542 - protein, 8 aa, Influenza virus
FQSGVRVA

SEQ ID NO: 303543 - protein, 8 aa, Influenza virus
RMGKCNTK

SEQ ID NO: 303544 - protein, 8 aa, Influenza virus
MGKCNTKC

SEQ ID NO: 303545 - protein, 8 aa, Influenza virus
CQTSMGGV

SEQ ID NO: 303546 - protein, 8 aa, Influenza virus
SERGLFGA

SEQ ID NO: 303547 - protein, 8 aa, Influenza virus
KVSTQKAL

SEQ ID NO: 303548 - protein, 8 aa, Influenza virus
VSTQKAIN

SEQ ID NO: 303549 - protein, 8 aa, Influenza virus
LENGRTLG

SEQ ID NO: 303550 - protein, 8 aa, Influenza virus
ANVKNLHD

SEQ ID NO: 303551 - protein, 8 aa, Influenza virus
NVKNLHDQ

SEQ ID NO: 303552 - protein, 8 aa, Influenza virus
VKNLHEQV

SEQ ID NO: 303553 - protein, 8 aa, Influenza virus
KNLHEQVK

SEQ ID NO: 303554 - protein, 8 aa, Influenza virus
NLHEQVKR

SEQ ID NO: 303555 - protein, 8 aa, Influenza virus
LQNNAIDE

SEQ ID NO: 303556 - protein, 8 aa, Influenza virus
QNNAIDEG

SEQ ID NO: 303557 - protein, 8 aa, Influenza virus
EGDGCFNF

SEQ ID NO: 303558 - protein, 8 aa, Influenza virus
GDGCFNFF

SEQ ID NO: 303559 - protein, 8 aa, Influenza virus
DGCFNFFH

SEQ ID NO: 303560 - protein, 8 aa, Influenza virus
GCFNFFHK

SEQ ID NO: 303561 - protein, 8 aa, Influenza virus
CFNFFHKC

SEQ ID NO: 303562 - protein, 8 aa, Influenza virus
FNFFHKCN

SEQ ID NO: 303563 - protein, 8 aa, Influenza virus
NFFHKCND

SEQ ID NO: 303564 - protein, 8 aa, Influenza virus
SEDNVYKV

SEQ ID NO: 303565 - protein, 8 aa, Influenza virus
DNVYKVLA

SEQ ID NO: 303566 - protein, 8 aa, Influenza virus
NIYKILSI

SEQ ID NO: 303567 - protein, 8 aa, Influenza virus
IYKILSIY

SEQ ID NO: 303568 - protein, 8 aa, Influenza virus
CIASSTVL

SEQ ID NO: 303569 - protein, 8 aa, Influenza virus
IASSTVLV

SEQ ID NO: 303570 - protein, 8 aa, Influenza virus
ASSTVLVG

SEQ ID NO: 303571 - protein, 8 aa, Influenza virus
SSTVLVGL

SEQ ID NO: 303572 - protein, 8 aa, Influenza virus
STVLVGLI

SEQ ID NO: 303573 - protein, 8 aa, Influenza virus
TVLVGLIL

SEQ ID NO: 303574 - protein, 8 aa, Influenza virus
MWACSNGN

SEQ ID NO: 303575 - protein, 8 aa, Influenza virus
SSGNCRFS

SEQ ID NO: 303576 - protein, 8 aa, Influenza virus
SGNCRFSV

SEQ ID NO: 303577 - protein, 8 aa, Influenza virus
ATKMEAIL

SEQ ID NO: 303578 - protein, 8 aa, Influenza virus
TKMKAIIV

SEQ ID NO: 303579 - protein, 8 aa, Influenza virus
ENGWEGMV

SEQ ID NO: 303580 - protein, 8 aa, Influenza virus
NGWEGMVD

SEQ ID NO: 303581 - protein, 8 aa, Influenza virus
GWEGMVDG

SEQ ID NO: 303582 - protein, 8 aa, Influenza virus
WEGMVDGW

SEQ ID NO: 303583 - protein, 8 aa, Influenza virus
EGMVDGWY

SEQ ID NO: 303584 - protein, 8 aa, Influenza virus
GLVAGWYG

SEQ ID NO: 303585 - protein, 8 aa, Influenza virus
MVDGWYGF

SEQ ID NO: 303586 - protein, 8 aa, Influenza virus
VDGWYGFR

SEQ ID NO: 303587 - protein, 8 aa, Influenza virus
AGWYGFQH

SEQ ID NO: 303588 - protein, 8 aa, Influenza virus
GWYGFQHQ

SEQ ID NO: 303589 - protein, 8 aa, Influenza virus
WYGFQHQN

SEQ ID NO: 303590 - protein, 8 aa, Influenza virus
QGTGIAAD

SEQ ID NO: 303591 - protein, 8 aa, Influenza virus
WSYNAKLL

SEQ ID NO: 303592 - protein, 8 aa, Influenza virus
YNAQLLVL

SEQ ID NO: 303593 - protein, 8 aa, Influenza virus
NAQLLVLL

SEQ ID NO: 303594 - protein, 8 aa, Influenza virus
AQLLVLLE

SEQ ID NO: 303595 - protein, 8 aa, Influenza virus
QLLVLLEN

SEQ ID NO: 303596 - protein, 8 aa, Influenza virus
LLVLLENQ

SEQ ID NO: 303597 - protein, 8 aa, Influenza virus
LLENQKTL

SEQ ID NO: 303598 - protein, 8 aa, Influenza virus
LENQKTLD

SEQ ID NO: 303599 - protein, 8 aa, Influenza virus
GDGCFEIL

SEQ ID NO: 303600 - protein, 8 aa, Influenza virus
DGCFEILH

SEQ ID NO: 303601 - protein, 8 aa, Influenza virus
LAIYSTAA

SEQ ID NO: 303602 - protein, 8 aa, Influenza virus
AIYSTAAS

SEQ ID NO: 303603 - protein, 8 aa, Influenza virus
IYSTAASS

SEQ ID NO: 303604 - protein, 8 aa, Influenza virus
CRICIDFR

SEQ ID NO: 303605 - protein, 8 aa, Influenza virus
RICILDQN

SEQ ID NO: 303606 - protein, 8 aa, Influenza virus
EREAKLFV

SEQ ID NO: 303607 - protein, 8 aa, Influenza virus
DTVDTVRE

SEQ ID NO: 303608 - protein, 8 aa, Influenza virus
TVDTLLEK

SEQ ID NO: 303609 - protein, 8 aa, Influenza virus
VDTLLEKN

SEQ ID NO: 303610 - protein, 8 aa, Influenza virus
DTLLEKNV

SEQ ID NO: 303611 - protein, 8 aa, Influenza virus
TLLEKNVT

SEQ ID NO: 303612 - protein, 8 aa, Influenza virus
LLEKNVTV

SEQ ID NO: 303613 - protein, 8 aa, Influenza virus
VAGWLLGN

SEQ ID NO: 303614 - protein, 8 aa, Influenza virus
LGNPKCDL

SEQ ID NO: 303615 - protein, 8 aa, Influenza virus
SWSYIAET

SEQ ID NO: 303616 - protein, 8 aa, Influenza virus
NYEELREH

SEQ ID NO: 303617 - protein, 8 aa, Influenza virus
LREHLSSV

SEQ ID NO: 303618 - protein, 8 aa, Influenza virus
REHLSSVS

SEQ ID NO: 303619 - protein, 8 aa, Influenza virus
SSVSSFKR

SEQ ID NO: 303620 - protein, 8 aa, Influenza virus
SVSSFKRF

SEQ ID NO: 303621 - protein, 8 aa, Influenza virus
SFYKNLLW

SEQ ID NO: 303622 - protein, 8 aa, Influenza virus
FYRNLLWI

SEQ ID NO: 303623 - protein, 8 aa, Influenza virus
VLVLWAIH

SEQ ID NO: 303624 - protein, 8 aa, Influenza virus
LVLWAIHH

SEQ ID NO: 303625 - protein, 8 aa, Influenza virus
VLWAIHHP

SEQ ID NO: 303626 - protein, 8 aa, Influenza virus
GRMDYYWT

SEQ ID NO: 303627 - protein, 8 aa, Influenza virus
RMDYYWTL

SEQ ID NO: 303628 - protein, 8 aa, Influenza virus
QGDTITFE

SEQ ID NO: 303629 - protein, 8 aa, Influenza virus
RDTIIFEA

SEQ ID NO: 303630 - protein, 8 aa, Influenza virus
DTIIFEAS

SEQ ID NO: 303631 - protein, 8 aa, Influenza virus
TIIFEASG

SEQ ID NO: 303632 - protein, 8 aa, Influenza virus
FEATGNLL

SEQ ID NO: 303633 - protein, 8 aa, Influenza virus
EATGNLLV

SEQ ID NO: 303634 - protein, 8 aa, Influenza virus
ATGNLLVP

SEQ ID NO: 303635 - protein, 8 aa, Influenza virus
GALKSNLP

SEQ ID NO: 303636 - protein, 8 aa, Influenza virus
KSNLPFQN

SEQ ID NO: 303637 - protein, 8 aa, Influenza virus
NLPFQNVH

SEQ ID NO: 303638 - protein, 8 aa, Influenza virus
LPFQNIHS

SEQ ID NO: 303639 - protein, 8 aa, Influenza virus
NVHPITIG

SEQ ID NO: 303640 - protein, 8 aa, Influenza virus
HSITIGKC

SEQ ID NO: 303641 - protein, 8 aa, Influenza virus
SITIGKCP

SEQ ID NO: 303642 - protein, 8 aa, Influenza virus
ITIGKCSK

SEQ ID NO: 303643 - protein, 8 aa, Influenza virus
CSKYVKST

SEQ ID NO: 303644 - protein, 8 aa, Influenza virus
QLRMATGL

SEQ ID NO: 303645 - protein, 8 aa, Influenza virus
LATGLRNI

SEQ ID NO: 303646 - protein, 8 aa, Influenza virus
KSTQHAID

SEQ ID NO: 303647 - protein, 8 aa, Influenza virus
DGITNKVN

SEQ ID NO: 303648 - protein, 8 aa, Influenza virus
GISNKVNS

SEQ ID NO: 303649 - protein, 8 aa, Influenza virus
TNKVNSVV

SEQ ID NO: 303650 - protein, 8 aa, Influenza virus
SVVEKMNT

SEQ ID NO: 303651 - protein, 8 aa, Influenza virus
NTQFTSVG

SEQ ID NO: 303652 - protein, 8 aa, Influenza virus
TQFTVVGK

SEQ ID NO: 303653 - protein, 8 aa, Influenza virus
LERRIENL

SEQ ID NO: 303654 - protein, 8 aa, Influenza virus
ERRIENLN

SEQ ID NO: 303655 - protein, 8 aa, Influenza virus
IENLNRKV

SEQ ID NO: 303656 - protein, 8 aa, Influenza virus
NRKVDDGF

SEQ ID NO: 303657 - protein, 8 aa, Influenza virus
KKVDDGLL

SEQ ID NO: 303658 - protein, 8 aa, Influenza virus
KVDDGLLD

SEQ ID NO: 303659 - protein, 8 aa, Influenza virus
DDGLLDVW

SEQ ID NO: 303660 - protein, 8 aa, Influenza virus
DGLLDVWT

SEQ ID NO: 303661 - protein, 8 aa, Influenza virus
GLLDVWTY

SEQ ID NO: 303662 - protein, 8 aa, Influenza virus
LLDVWTYN

SEQ ID NO: 303663 - protein, 8 aa, Influenza virus
IDVWTYNA

SEQ ID NO: 303664 - protein, 8 aa, Influenza virus
RTLDFHDF

SEQ ID NO: 303665 - protein, 8 aa, Influenza virus
EFYHKCNN

SEQ ID NO: 303666 - protein, 8 aa, Influenza virus
PKYSKESK

SEQ ID NO: 303667 - protein, 8 aa, Influenza virus
KYSKESKL

SEQ ID NO: 303668 - protein, 8 aa, Influenza virus
VDGVKLES

SEQ ID NO: 303669 - protein, 8 aa, Influenza virus
VHQILAIY

SEQ ID NO: 303670 - protein, 8 aa, Influenza virus
TVASSLIL

SEQ ID NO: 303671 - protein, 8 aa, Influenza virus
ASSLVLIV

SEQ ID NO: 303672 - protein, 8 aa, Influenza virus
SSLVLIVS

SEQ ID NO: 303673 - protein, 8 aa, Influenza virus
SLVLIVSL

SEQ ID NO: 303674 - protein, 8 aa, Influenza virus
LVLIVSLG

SEQ ID NO: 303675 - protein, 8 aa, Influenza virus
LVSLGAVS

SEQ ID NO: 303676 - protein, 8 aa, Influenza virus
GHSCRICI

SEQ ID NO: 303677 - protein, 8 aa, Influenza virus
AIHTKDNS

SEQ ID NO: 303678 - protein, 8 aa, Influenza virus
YSKDNGIR

SEQ ID NO: 303679 - protein, 8 aa, Influenza virus
SKDNGIRI

SEQ ID NO: 303680 - protein, 8 aa, Influenza virus
SKGDVFVM

SEQ ID NO: 303681 - protein, 8 aa, Influenza virus
KGDVFVMR

SEQ ID NO: 303682 - protein, 8 aa, Influenza virus
FISCSHFE

SEQ ID NO: 303683 - protein, 8 aa, Influenza virus
ISCSHFEC

SEQ ID NO: 303684 - protein, 8 aa, Influenza virus
SCSQLECR

SEQ ID NO: 303685 - protein, 8 aa, Influenza virus
QLECRTFF

SEQ ID NO: 303686 - protein, 8 aa, Influenza virus
DKHSNGTA

SEQ ID NO: 303687 - protein, 8 aa, Influenza virus
KHSNGTAK

SEQ ID NO: 303688 - protein, 8 aa, Influenza virus
HSNGTVKN

SEQ ID NO: 303689 - protein, 8 aa, Influenza virus
SNGTVKNR

SEQ ID NO: 303690 - protein, 8 aa, Influenza virus
NGTVKNRS

SEQ ID NO: 303691 - protein, 8 aa, Influenza virus
GTVKNRSP

SEQ ID NO: 303692 - protein, 8 aa, Influenza virus
KNRSPYRA

SEQ ID NO: 303693 - protein, 8 aa, Influenza virus
DRSPFRAL

SEQ ID NO: 303694 - protein, 8 aa, Influenza virus
RALMSCPI

SEQ ID NO: 303695 - protein, 8 aa, Influenza virus
ALMSCPIG

SEQ ID NO: 303696 - protein, 8 aa, Influenza virus
MSCPVGEA

SEQ ID NO: 303697 - protein, 8 aa, Influenza virus
SCPVGEAP

SEQ ID NO: 303698 - protein, 8 aa, Influenza virus
CPVGEAPS

SEQ ID NO: 303699 - protein, 8 aa, Influenza virus
PVGEAPSP

SEQ ID NO: 303700 - protein, 8 aa, Influenza virus
VGEAPSPY

SEQ ID NO: 303701 - protein, 8 aa, Influenza virus
ASACHDGL

SEQ ID NO: 303702 - protein, 8 aa, Influenza virus
GWITIGIS

SEQ ID NO: 303703 - protein, 8 aa, Influenza virus
KYKGIITG

SEQ ID NO: 303704 - protein, 8 aa, Influenza virus
YNDIITDT

SEQ ID NO: 303705 - protein, 8 aa, Influenza virus
DIITDTIK

SEQ ID NO: 303706 - protein, 8 aa, Influenza virus
VITDTIKS

SEQ ID NO: 303707 - protein, 8 aa, Influenza virus
KILRTQES

SEQ ID NO: 303708 - protein, 8 aa, Influenza virus
QESECVCI

SEQ ID NO: 303709 - protein, 8 aa, Influenza virus
ESECVCIN

SEQ ID NO: 303710 - protein, 8 aa, Influenza virus
SECVCING

SEQ ID NO: 303711 - protein, 8 aa, Influenza virus
ECVCINGS

SEQ ID NO: 303712 - protein, 8 aa, Influenza virus
CVCINGSC

SEQ ID NO: 303713 - protein, 8 aa, Influenza virus
TIMTDGPN

SEQ ID NO: 303714 - protein, 8 aa, Influenza virus
APNSHYEE

SEQ ID NO: 303715 - protein, 8 aa, Influenza virus
PNSHYEEC

SEQ ID NO: 303716 - protein, 8 aa, Influenza virus
NSHYEECS

SEQ ID NO: 303717 - protein, 8 aa, Influenza virus
SHYEECSC

SEQ ID NO: 303718 - protein, 8 aa, Influenza virus
ECSCYPES

SEQ ID NO: 303719 - protein, 8 aa, Influenza virus
IICVCRDN

SEQ ID NO: 303720 - protein, 8 aa, Influenza virus
PWISFDQN

SEQ ID NO: 303721 - protein, 8 aa, Influenza virus
WISFDQNL

SEQ ID NO: 303722 - protein, 8 aa, Influenza virus
YRIGYICS

SEQ ID NO: 303723 - protein, 8 aa, Influenza virus
RIGYICSG

SEQ ID NO: 303724 - protein, 8 aa, Influenza virus
VGYICSGV

SEQ ID NO: 303725 - protein, 8 aa, Influenza virus
GDNPRSND

SEQ ID NO: 303726 - protein, 8 aa, Influenza virus
GTNGVKGF

SEQ ID NO: 303727 - protein, 8 aa, Influenza virus
TNGVKGFS

SEQ ID NO: 303728 - protein, 8 aa, Influenza virus
YGVKGFSF

SEQ ID NO: 303729 - protein, 8 aa, Influenza virus
GVKGFSYR

SEQ ID NO: 303730 - protein, 8 aa, Influenza virus
VKGFSYRY

SEQ ID NO: 303731 - protein, 8 aa, Influenza virus
KGFSYKYD

SEQ ID NO: 303732 - protein, 8 aa, Influenza virus
GFSYKYDN

SEQ ID NO: 303733 - protein, 8 aa, Influenza virus
FSYKYDNG

SEQ ID NO: 303734 - protein, 8 aa, Influenza virus
SYKYDNGV

SEQ ID NO: 303735 - protein, 8 aa, Influenza virus
YKYDNGVW

SEQ ID NO: 303736 - protein, 8 aa, Influenza virus
KYGNGVWM

SEQ ID NO: 303737 - protein, 8 aa, Influenza virus
WMGRTKSN

SEQ ID NO: 303738 - protein, 8 aa, Influenza virus
TNWSGYSG

SEQ ID NO: 303739 - protein, 8 aa, Influenza virus
HPELTGMD

SEQ ID NO: 303740 - protein, 8 aa, Influenza virus
PELTGMDC

SEQ ID NO: 303741 - protein, 8 aa, Influenza virus
ELTGLNCI

SEQ ID NO: 303742 - protein, 8 aa, Influenza virus
NCIKPCFW

SEQ ID NO: 303743 - protein, 8 aa, Influenza virus
TIWTSGSI

SEQ ID NO: 303744 - protein, 8 aa, Influenza virus
IWTSASSI

SEQ ID NO: 303745 - protein, 8 aa, Influenza virus
ISFCGVSS

SEQ ID NO: 303746 - protein, 8 aa, Influenza virus
DWSWPDGA

SEQ ID NO: 303747 - protein, 8 aa, Influenza virus
DGAELPFA

SEQ ID NO: 303748 - protein, 8 aa, Influenza virus
GAELPFAI

SEQ ID NO: 303749 - protein, 8 aa, Influenza virus
DTLCVGYH

SEQ ID NO: 303750 - protein, 8 aa, Influenza virus
TLCIDYHA

SEQ ID NO: 303751 - protein, 8 aa, Influenza virus
DKNVTVTH

SEQ ID NO: 303752 - protein, 8 aa, Influenza virus
KNVAVTHS

SEQ ID NO: 303753 - protein, 8 aa, Influenza virus
KLTVTHSV

SEQ ID NO: 303754 - protein, 8 aa, Influenza virus
LTVTHSVN

SEQ ID NO: 303755 - protein, 8 aa, Influenza virus
HNGKLCRL

SEQ ID NO: 303756 - protein, 8 aa, Influenza virus
VAGWLLGN

SEQ ID NO: 303757 - protein, 8 aa, Influenza virus
GWLLGNPA

SEQ ID NO: 303758 - protein, 8 aa, Influenza virus
WLLGNPAC

SEQ ID NO: 303759 - protein, 8 aa, Influenza virus
DYEELKEQ

SEQ ID NO: 303760 - protein, 8 aa, Influenza virus
EELKEQLS

SEQ ID NO: 303761 - protein, 8 aa, Influenza virus
GRMDYYWA

SEQ ID NO: 303762 - protein, 8 aa, Influenza virus
PFQNIHPI

SEQ ID NO: 303763 - protein, 8 aa, Influenza virus
FQNIHPIT

SEQ ID NO: 303764 - protein, 8 aa, Influenza virus
QNIHPITI

SEQ ID NO: 303765 - protein, 8 aa, Influenza virus
NIHPITIG

SEQ ID NO: 303766 - protein, 8 aa, Influenza virus
HPVTIGKC

SEQ ID NO: 303767 - protein, 8 aa, Influenza virus
PVTIGKCP

SEQ ID NO: 303768 - protein, 8 aa, Influenza virus
VTIGKCPK

SEQ ID NO: 303769 - protein, 8 aa, Influenza virus
LRMARGLR

SEQ ID NO: 303770 - protein, 8 aa, Influenza virus
RMARGLRN

SEQ ID NO: 303771 - protein, 8 aa, Influenza virus
TGLRNTLS

SEQ ID NO: 303772 - protein, 8 aa, Influenza virus
GLRNVPSV

SEQ ID NO: 303773 - protein, 8 aa, Influenza virus
PSIQTRGL

SEQ ID NO: 303774 - protein, 8 aa, Influenza virus
SIHSRGLF

SEQ ID NO: 303775 - protein, 8 aa, Influenza virus
VQSRGLFG

SEQ ID NO: 303776 - protein, 8 aa, Influenza virus
QSKGLFGA

SEQ ID NO: 303777 - protein, 8 aa, Influenza virus
TNKINSVI

SEQ ID NO: 303778 - protein, 8 aa, Influenza virus
ENLNRKVD

SEQ ID NO: 303779 - protein, 8 aa, Influenza virus
NLNRKVDD

SEQ ID NO: 303780 - protein, 8 aa, Influenza virus
LNRKVDDG

SEQ ID NO: 303781 - protein, 8 aa, Influenza virus
NKKIDDGF

SEQ ID NO: 303782 - protein, 8 aa, Influenza virus
RVDDGFLD

SEQ ID NO: 303783 - protein, 8 aa, Influenza virus
RTLDFHDF

SEQ ID NO: 303784 - protein, 8 aa, Influenza virus
TLDFHDFN

SEQ ID NO: 303785 - protein, 8 aa, Influenza virus
LDFHDFNV

SEQ ID NO: 303786 - protein, 8 aa, Influenza virus
QLKNKVKE

SEQ ID NO: 303787 - protein, 8 aa, Influenza virus
NNARELGN

SEQ ID NO: 303788 - protein, 8 aa, Influenza virus
NAKETGNG

SEQ ID NO: 303789 - protein, 8 aa, Influenza virus
AREIGNGC

SEQ ID NO: 303790 - protein, 8 aa, Influenza virus
EFYHKCDN

SEQ ID NO: 303791 - protein, 8 aa, Influenza virus
CMESIKNG

SEQ ID NO: 303792 - protein, 8 aa, Influenza virus
MESIKNGT

SEQ ID NO: 303793 - protein, 8 aa, Influenza virus
ESIKNGTY

SEQ ID NO: 303794 - protein, 8 aa, Influenza virus
SVKNGTYE

SEQ ID NO: 303795 - protein, 8 aa, Influenza virus
VKNGTYEY

SEQ ID NO: 303796 - protein, 8 aa, Influenza virus
YQILAVYS

SEQ ID NO: 303797 - protein, 8 aa, Influenza virus
QILAVYST

SEQ ID NO: 303798 - protein, 8 aa, Influenza virus
ILAIYSAA

SEQ ID NO: 303799 - protein, 8 aa, Influenza virus
SFWMCPNG

SEQ ID NO: 303800 - protein, 8 aa, Influenza virus
PNGSLQCT

SEQ ID NO: 303801 - protein, 8 aa, Influenza virus
NGSLHGRI

SEQ ID NO: 303802 - protein, 8 aa, Influenza virus
GSLHGRIC

SEQ ID NO: 303803 - protein, 8 aa, Influenza virus
SLHGRICI

SEQ ID NO: 303804 - protein, 8 aa, Influenza virus
YRSWSKPQ

SEQ ID NO: 303805 - protein, 8 aa, Influenza virus
RSWSKPQC

SEQ ID NO: 303806 - protein, 8 aa, Influenza virus
INGFAPFS

SEQ ID NO: 303807 - protein, 8 aa, Influenza virus
AGFAPFSK

SEQ ID NO: 303808 - protein, 8 aa, Influenza virus
SAGGAVWV

SEQ ID NO: 303809 - protein, 8 aa, Influenza virus
AGGAVWVT

SEQ ID NO: 303810 - protein, 8 aa, Influenza virus
GGAVWVTR

SEQ ID NO: 303811 - protein, 8 aa, Influenza virus
GDIWATRE

SEQ ID NO: 303812 - protein, 8 aa, Influenza virus
DIWVTRKP

SEQ ID NO: 303813 - protein, 8 aa, Influenza virus
REPYVSCG

SEQ ID NO: 303814 - protein, 8 aa, Influenza virus
LGQGTTLS

SEQ ID NO: 303815 - protein, 8 aa, Influenza virus
GQGTTLSN

SEQ ID NO: 303816 - protein, 8 aa, Influenza virus
DRTSYRTL

SEQ ID NO: 303817 - protein, 8 aa, Influenza virus
RTSYRTLL

SEQ ID NO: 303818 - protein, 8 aa, Influenza virus
TSYRTLLM

SEQ ID NO: 303819 - protein, 8 aa, Influenza virus
PHRTLLMS

SEQ ID NO: 303820 - protein, 8 aa, Influenza virus
IPFHLGTR

SEQ ID NO: 303821 - protein, 8 aa, Influenza virus
PFYLGTKQ

SEQ ID NO: 303822 - protein, 8 aa, Influenza virus
FYLGTKQV

SEQ ID NO: 303823 - protein, 8 aa, Influenza virus
YLGTRQVC

SEQ ID NO: 303824 - protein, 8 aa, Influenza virus
LGTKQVCM

SEQ ID NO: 303825 - protein, 8 aa, Influenza virus
GTKQVCMA

SEQ ID NO: 303826 - protein, 8 aa, Influenza virus
TKQVCMAW

SEQ ID NO: 303827 - protein, 8 aa, Influenza virus
KQVCMAWS

SEQ ID NO: 303828 - protein, 8 aa, Influenza virus
SSCHDGKS

SEQ ID NO: 303829 - protein, 8 aa, Influenza virus
SCHDGKSW

SEQ ID NO: 303830 - protein, 8 aa, Influenza virus
CHDGKSWL

SEQ ID NO: 303831 - protein, 8 aa, Influenza virus
HDGKSWLH

SEQ ID NO: 303832 - protein, 8 aa, Influenza virus
DGKAWLHI

SEQ ID NO: 303833 - protein, 8 aa, Influenza virus
AWLHICVT

SEQ ID NO: 303834 - protein, 8 aa, Influenza virus
NATASLIY

SEQ ID NO: 303835 - protein, 8 aa, Influenza virus
KILRTHES

SEQ ID NO: 303836 - protein, 8 aa, Influenza virus
HESECVCI

SEQ ID NO: 303837 - protein, 8 aa, Influenza virus
ESECVCID

SEQ ID NO: 303838 - protein, 8 aa, Influenza virus
TCAVVMTD

SEQ ID NO: 303839 - protein, 8 aa, Influenza virus
VMTDGSAT

SEQ ID NO: 303840 - protein, 8 aa, Influenza virus
MTDGSASE

SEQ ID NO: 303841 - protein, 8 aa, Influenza virus
GNAQHVEE

SEQ ID NO: 303842 - protein, 8 aa, Influenza virus
NAQHVEEC

SEQ ID NO: 303843 - protein, 8 aa, Influenza virus
CSCYPRYS

SEQ ID NO: 303844 - protein, 8 aa, Influenza virus
RGSNRPIV

SEQ ID NO: 303845 - protein, 8 aa, Influenza virus
GSNRPVID

SEQ ID NO: 303846 - protein, 8 aa, Influenza virus
SNRPVIDI

SEQ ID NO: 303847 - protein, 8 aa, Influenza virus
GDHGVKGW

SEQ ID NO: 303848 - protein, 8 aa, Influenza virus
DHGVKGWA

SEQ ID NO: 303849 - protein, 8 aa, Influenza virus
VKGWAFDS

SEQ ID NO: 303850 - protein, 8 aa, Influenza virus
SRLGYETF

SEQ ID NO: 303851 - protein, 8 aa, Influenza virus
GYETFRVT

SEQ ID NO: 303852 - protein, 8 aa, Influenza virus
WSGYSGVF

SEQ ID NO: 303853 - protein, 8 aa, Influenza virus
GYFGVFSV

SEQ ID NO: 303854 - protein, 8 aa, Influenza virus
YFGVFSVE

SEQ ID NO: 303855 - protein, 8 aa, Influenza virus
SCVNRCFY

SEQ ID NO: 303856 - protein, 8 aa, Influenza virus
VELIRGRP

SEQ ID NO: 303857 - protein, 8 aa, Influenza virus
IVEFCGTS

SEQ ID NO: 303858 - protein, 8 aa, Influenza virus
VFCGASGT

SEQ ID NO: 303859 - protein, 8 aa, Influenza virus
TSGTYGAG

SEQ ID NO: 303860 - protein, 8 aa, Influenza virus
GTCGTGSW

SEQ ID NO: 303861 - protein, 8 aa, Influenza virus
TYGTGAWP

SEQ ID NO: 303862 - protein, 8 aa, Influenza virus
YGAGSWPD

SEQ ID NO: 303863 - protein, 8 aa, Influenza virus
GKGSWPDG

SEQ ID NO: 303864 - protein, 8 aa, Influenza virus
TGAWPDGA

SEQ ID NO: 303865 - protein, 8 aa, Influenza virus
GSWPDGRT

SEQ ID NO: 303866 - protein, 8 aa, Influenza virus
AWPDGADI

SEQ ID NO: 303867 - protein, 8 aa, Influenza virus
MDKQTKTM

SEQ ID NO: 303868 - protein, 8 aa, Influenza virus
DNQTKKMT

SEQ ID NO: 303869 - protein, 8 aa, Influenza virus
NKTKKMTI

SEQ ID NO: 303870 - protein, 8 aa, Influenza virus
RICIGYHA

SEQ ID NO: 303871 - protein, 8 aa, Influenza virus
HANNSTER

SEQ ID NO: 303872 - protein, 8 aa, Influenza virus
NNSTEKID

SEQ ID NO: 303873 - protein, 8 aa, Influenza virus
NSTKKVDT

SEQ ID NO: 303874 - protein, 8 aa, Influenza virus
VDTNLERN

SEQ ID NO: 303875 - protein, 8 aa, Influenza virus
VTVTHAQN

SEQ ID NO: 303876 - protein, 8 aa, Influenza virus
HAQDILER

SEQ ID NO: 303877 - protein, 8 aa, Influenza virus
DILERTHN

SEQ ID NO: 303878 - protein, 8 aa, Influenza virus
LEKMHNGK

SEQ ID NO: 303879 - protein, 8 aa, Influenza virus
EKMHNGKL

SEQ ID NO: 303880 - protein, 8 aa, Influenza virus
KAHNGKLC

SEQ ID NO: 303881 - protein, 8 aa, Influenza virus
MHNGKLCR

SEQ ID NO: 303882 - protein, 8 aa, Influenza virus
NGKLCKLS

SEQ ID NO: 303883 - protein, 8 aa, Influenza virus
GKLCKLSG

SEQ ID NO: 303884 - protein, 8 aa, Influenza virus
LSGIPPLV

SEQ ID NO: 303885 - protein, 8 aa, Influenza virus
SGIPPLVL

SEQ ID NO: 303886 - protein, 8 aa, Influenza virus
GVPPLELG

SEQ ID NO: 303887 - protein, 8 aa, Influenza virus
VPPLELGD

SEQ ID NO: 303888 - protein, 8 aa, Influenza virus
LGNPKCDR

SEQ ID NO: 303889 - protein, 8 aa, Influenza virus
GNPECDLF

SEQ ID NO: 303890 - protein, 8 aa, Influenza virus
NPECDLFL

SEQ ID NO: 303891 - protein, 8 aa, Influenza virus
EWSYIIEK

SEQ ID NO: 303892 - protein, 8 aa, Influenza virus
WSYIIEKE

SEQ ID NO: 303893 - protein, 8 aa, Influenza virus
FNGYEELK

SEQ ID NO: 303894 - protein, 8 aa, Influenza virus
NGYEELKH

SEQ ID NO: 303895 - protein, 8 aa, Influenza virus
HFEKVRIM

SEQ ID NO: 303896 - protein, 8 aa, Influenza virus
NNTSGKQM

SEQ ID NO: 303897 - protein, 8 aa, Influenza virus
NTSGKQML

SEQ ID NO: 303898 - protein, 8 aa, Influenza virus
TSKLNKRS

SEQ ID NO: 303899 - protein, 8 aa, Influenza virus
GQRGRMEF

SEQ ID NO: 303900 - protein, 8 aa, Influenza virus
GRMEFYWT

SEQ ID NO: 303901 - protein, 8 aa, Influenza virus
FRISKRGS

SEQ ID NO: 303902 - protein, 8 aa, Influenza virus
KISKRGNS

SEQ ID NO: 303903 - protein, 8 aa, Influenza virus
SKRGSSGV

SEQ ID NO: 303904 - protein, 8 aa, Influenza virus
KRGNSGIM

SEQ ID NO: 303905 - protein, 8 aa, Influenza virus
RGSSGIVK

SEQ ID NO: 303906 - protein, 8 aa, Influenza virus
GNSGIMKT

SEQ ID NO: 303907 - protein, 8 aa, Influenza virus
CETKCQSP

SEQ ID NO: 303908 - protein, 8 aa, Influenza virus
ETKCQSPL

SEQ ID NO: 303909 - protein, 8 aa, Influenza virus
TKCQSPLG

SEQ ID NO: 303910 - protein, 8 aa, Influenza virus
KCQSPLGA

SEQ ID NO: 303911 - protein, 8 aa, Influenza virus
LVLAAGLR

SEQ ID NO: 303912 - protein, 8 aa, Influenza virus
ILATGLRN

SEQ ID NO: 303913 - protein, 8 aa, Influenza virus
PQIEARGL

SEQ ID NO: 303914 - protein, 8 aa, Influenza virus
QTESRGLF

SEQ ID NO: 303915 - protein, 8 aa, Influenza virus
TESRGLFG

SEQ ID NO: 303916 - protein, 8 aa, Influenza virus
NSIIEKMN

SEQ ID NO: 303917 - protein, 8 aa, Influenza virus
SIIEKMNT

SEQ ID NO: 303918 - protein, 8 aa, Influenza virus
VIEKMNIQ

SEQ ID NO: 303919 - protein, 8 aa, Influenza virus
IEKMNTQS

SEQ ID NO: 303920 - protein, 8 aa, Influenza virus
EKMNIQFE

SEQ ID NO: 303921 - protein, 8 aa, Influenza virus
VGKEFGNL

SEQ ID NO: 303922 - protein, 8 aa, Influenza virus
GKEFGNLE

SEQ ID NO: 303923 - protein, 8 aa, Influenza virus
LENLDKKM

SEQ ID NO: 303924 - protein, 8 aa, Influenza virus
ENLDKKME

SEQ ID NO: 303925 - protein, 8 aa, Influenza virus
SKRMEDGF

SEQ ID NO: 303926 - protein, 8 aa, Influenza virus
KRMEDGFI

SEQ ID NO: 303927 - protein, 8 aa, Influenza virus
VWTYNTEL

SEQ ID NO: 303928 - protein, 8 aa, Influenza virus
ENERILDF

SEQ ID NO: 303929 - protein, 8 aa, Influenza virus
NERILDFH

SEQ ID NO: 303930 - protein, 8 aa, Influenza virus
ERTLGFHD

SEQ ID NO: 303931 - protein, 8 aa, Influenza virus
RTLGFHDS

SEQ ID NO: 303932 - protein, 8 aa, Influenza virus
ILDFHDSN

SEQ ID NO: 303933 - protein, 8 aa, Influenza virus
DFHDSSVK

SEQ ID NO: 303934 - protein, 8 aa, Influenza virus
YHDSNVKN

SEQ ID NO: 303935 - protein, 8 aa, Influenza virus
SNVKNLYN

SEQ ID NO: 303936 - protein, 8 aa, Influenza virus
NLYEKVRM

SEQ ID NO: 303937 - protein, 8 aa, Influenza virus
LYDRVRMQ

SEQ ID NO: 303938 - protein, 8 aa, Influenza virus
YEKVRMQL

SEQ ID NO: 303939 - protein, 8 aa, Influenza virus
EKVRMQLR

SEQ ID NO: 303940 - protein, 8 aa, Influenza virus
LKDNAKEV

SEQ ID NO: 303941 - protein, 8 aa, Influenza virus
KDNAKEVG

SEQ ID NO: 303942 - protein, 8 aa, Influenza virus
DNAKEVGN

SEQ ID NO: 303943 - protein, 8 aa, Influenza virus
NAKEVGNG

SEQ ID NO: 303944 - protein, 8 aa, Influenza virus
AKEVGNGC

SEQ ID NO: 303945 - protein, 8 aa, Influenza virus
KETGNGCF

SEQ ID NO: 303946 - protein, 8 aa, Influenza virus
EVGNGCFE

SEQ ID NO: 303947 - protein, 8 aa, Influenza virus
VGNGCFEF

SEQ ID NO: 303948 - protein, 8 aa, Influenza virus
KCDDECMS

SEQ ID NO: 303949 - protein, 8 aa, Influenza virus
CDDECMSS

SEQ ID NO: 303950 - protein, 8 aa, Influenza virus
SIRNGTYD

SEQ ID NO: 303951 - protein, 8 aa, Influenza virus
IRNGTYDY

SEQ ID NO: 303952 - protein, 8 aa, Influenza virus
NGTYYYPK

SEQ ID NO: 303953 - protein, 8 aa, Influenza virus
GTYYYPKY

SEQ ID NO: 303954 - protein, 8 aa, Influenza virus
TYYYPKYE

SEQ ID NO: 303955 - protein, 8 aa, Influenza virus
YYYPKYEE

SEQ ID NO: 303956 - protein, 8 aa, Influenza virus
YYPKYEEE

SEQ ID NO: 303957 - protein, 8 aa, Influenza virus
EESRLNRN

SEQ ID NO: 303958 - protein, 8 aa, Influenza virus
ESRLNRNE

SEQ ID NO: 303959 - protein, 8 aa, Influenza virus
SRLNRNEI

SEQ ID NO: 303960 - protein, 8 aa, Influenza virus
RLNRNEIK

SEQ ID NO: 303961 - protein, 8 aa, Influenza virus
LNRSEIKG

SEQ ID NO: 303962 - protein, 8 aa, Influenza virus
NEIKGVEL

SEQ ID NO: 303963 - protein, 8 aa, Influenza virus
EIKGIKLS

SEQ ID NO: 303964 - protein, 8 aa, Influenza virus
AIMIAGIF

SEQ ID NO: 303965 - protein, 8 aa, Influenza virus
AGIFLWMC

SEQ ID NO: 303966 - protein, 8 aa, Influenza virus
GIFLWMCS

SEQ ID NO: 303967 - protein, 8 aa, Influenza virus
IFLWMCSN

SEQ ID NO: 303968 - protein, 8 aa, Influenza virus
FLWMCSNG

SEQ ID NO: 303969 - protein, 8 aa, Influenza virus
VKGDRICI

SEQ ID NO: 303970 - protein, 8 aa, Influenza virus
KGDRICIG

SEQ ID NO: 303971 - protein, 8 aa, Influenza virus
RICIGYHA

SEQ ID NO: 303972 - protein, 8 aa, Influenza virus
HSNNSTKK

SEQ ID NO: 303973 - protein, 8 aa, Influenza virus
NNSTEMVD

SEQ ID NO: 303974 - protein, 8 aa, Influenza virus
NSTEKIDT

SEQ ID NO: 303975 - protein, 8 aa, Influenza virus
MVDTILER

SEQ ID NO: 303976 - protein, 8 aa, Influenza virus
HAQNILEK

SEQ ID NO: 303977 - protein, 8 aa, Influenza virus
AQDILERT

SEQ ID NO: 303978 - protein, 8 aa, Influenza virus
QNILEKTH

SEQ ID NO: 303979 - protein, 8 aa, Influenza virus
PECDRLLN

SEQ ID NO: 303980 - protein, 8 aa, Influenza virus
LNVPEWSY

SEQ ID NO: 303981 - protein, 8 aa, Influenza virus
NVPEWSYI

SEQ ID NO: 303982 - protein, 8 aa, Influenza virus
EWSYIIEK

SEQ ID NO: 303983 - protein, 8 aa, Influenza virus
WSYIIEKE

SEQ ID NO: 303984 - protein, 8 aa, Influenza virus
SYIVEKEN

SEQ ID NO: 303985 - protein, 8 aa, Influenza virus
YIVEKENP

SEQ ID NO: 303986 - protein, 8 aa, Influenza virus
YSLCYPGN

SEQ ID NO: 303987 - protein, 8 aa, Influenza virus
SLCYPGNF

SEQ ID NO: 303988 - protein, 8 aa, Influenza virus
CYPGNFND

SEQ ID NO: 303989 - protein, 8 aa, Influenza virus
YPGSLNDY

SEQ ID NO: 303990 - protein, 8 aa, Influenza virus
PGSLNDYE

SEQ ID NO: 303991 - protein, 8 aa, Influenza virus
GNFNDYEE

SEQ ID NO: 303992 - protein, 8 aa, Influenza virus
SLNDYEEL

SEQ ID NO: 303993 - protein, 8 aa, Influenza virus
NDYEELKY

SEQ ID NO: 303994 - protein, 8 aa, Influenza virus
EYEELKHL

SEQ ID NO: 303995 - protein, 8 aa, Influenza virus
YEELKLLL

SEQ ID NO: 303996 - protein, 8 aa, Influenza virus
RVTHFEKV

SEQ ID NO: 303997 - protein, 8 aa, Influenza virus
VRHFEKVK

SEQ ID NO: 303998 - protein, 8 aa, Influenza virus
RHFEKVKI

SEQ ID NO: 303999 - protein, 8 aa, Influenza virus
FEKIKILP

SEQ ID NO: 304000 - protein, 8 aa, Influenza virus
EKVKILAR

SEQ ID NO: 304001 - protein, 8 aa, Influenza virus
KIKILPRD

SEQ ID NO: 304002 - protein, 8 aa, Influenza virus
VAQGSYNN

SEQ ID NO: 304003 - protein, 8 aa, Influenza virus
AQGSYNNT

SEQ ID NO: 304004 - protein, 8 aa, Influenza virus
KGSYNNTN

SEQ ID NO: 304005 - protein, 8 aa, Influenza virus
TSGEQVLV

SEQ ID NO: 304006 - protein, 8 aa, Influenza virus
SGEQVLVI

SEQ ID NO: 304007 - protein, 8 aa, Influenza virus
GEQVLVIW

SEQ ID NO: 304008 - protein, 8 aa, Influenza virus
KQMLIIWG

SEQ ID NO: 304009 - protein, 8 aa, Influenza virus
IWGVHHPK

SEQ ID NO: 304010 - protein, 8 aa, Influenza virus
WGVHHPKD

SEQ ID NO: 304011 - protein, 8 aa, Influenza virus
GVHHPKDE

SEQ ID NO: 304012 - protein, 8 aa, Influenza virus
LYQNVETY

SEQ ID NO: 304013 - protein, 8 aa, Influenza virus
YQNVETYV

SEQ ID NO: 304014 - protein, 8 aa, Influenza virus
QNVETYVS

SEQ ID NO: 304015 - protein, 8 aa, Influenza virus
GLGRRMEF

SEQ ID NO: 304016 - protein, 8 aa, Influenza virus
RMEFSWIL

SEQ ID NO: 304017 - protein, 8 aa, Influenza virus
MEFSWILL

SEQ ID NO: 304018 - protein, 8 aa, Influenza virus
LDTINFES

SEQ ID NO: 304019 - protein, 8 aa, Influenza virus
DTISFEST

SEQ ID NO: 304020 - protein, 8 aa, Influenza virus
TISFESTG

SEQ ID NO: 304021 - protein, 8 aa, Influenza virus
SSGVMKTE

SEQ ID NO: 304022 - protein, 8 aa, Influenza virus
SGVMKTEG

SEQ ID NO: 304023 - protein, 8 aa, Influenza virus
GVMKTEGT

SEQ ID NO: 304024 - protein, 8 aa, Influenza virus
VMKTEGTL

SEQ ID NO: 304025 - protein, 8 aa, Influenza virus
MKTGGTLE

SEQ ID NO: 304026 - protein, 8 aa, Influenza virus
ENCDTKCQ

SEQ ID NO: 304027 - protein, 8 aa, Influenza virus
NCDTKCQT

SEQ ID NO: 304028 - protein, 8 aa, Influenza virus
CETQCQTP

SEQ ID NO: 304029 - protein, 8 aa, Influenza virus
EIKCQTPL

SEQ ID NO: 304030 - protein, 8 aa, Influenza virus
CPKYVKSK

SEQ ID NO: 304031 - protein, 8 aa, Influenza virus
PKYVRSEK

SEQ ID NO: 304032 - protein, 8 aa, Influenza virus
KYVRSEKL

SEQ ID NO: 304033 - protein, 8 aa, Influenza virus
YVRSEKLV

SEQ ID NO: 304034 - protein, 8 aa, Influenza virus
VRSEKLVL

SEQ ID NO: 304035 - protein, 8 aa, Influenza virus
RSEKLVLA

SEQ ID NO: 304036 - protein, 8 aa, Influenza virus
SKRLVLAT

SEQ ID NO: 304037 - protein, 8 aa, Influenza virus
DRLVLAIG

SEQ ID NO: 304038 - protein, 8 aa, Influenza virus
LATGLRNA

SEQ ID NO: 304039 - protein, 8 aa, Influenza virus
ATGLRNAH

SEQ ID NO: 304040 - protein, 8 aa, Influenza virus
TGLRNAHK

SEQ ID NO: 304041 - protein, 8 aa, Influenza virus
GLRNVPQM

SEQ ID NO: 304042 - protein, 8 aa, Influenza virus
LRNVPQME

SEQ ID NO: 304043 - protein, 8 aa, Influenza virus
RNVPQIEP

SEQ ID NO: 304044 - protein, 8 aa, Influenza virus
NVPQIEAR

SEQ ID NO: 304045 - protein, 8 aa, Influenza virus
VPQIEARG

SEQ ID NO: 304046 - protein, 8 aa, Influenza virus
HKMESRGL

SEQ ID NO: 304047 - protein, 8 aa, Influenza virus
QIEPRGLF

SEQ ID NO: 304048 - protein, 8 aa, Influenza virus
KESTQRAF

SEQ ID NO: 304049 - protein, 8 aa, Influenza virus
VNSMIEKM

SEQ ID NO: 304050 - protein, 8 aa, Influenza virus
NSMIEKMN

SEQ ID NO: 304051 - protein, 8 aa, Influenza virus
FVIEKMNT

SEQ ID NO: 304052 - protein, 8 aa, Influenza virus
VIEKINTQ

SEQ ID NO: 304053 - protein, 8 aa, Influenza virus
IEKINTQF

SEQ ID NO: 304054 - protein, 8 aa, Influenza virus
EKMNTQSE

SEQ ID NO: 304055 - protein, 8 aa, Influenza virus
SVGKEFSN

SEQ ID NO: 304056 - protein, 8 aa, Influenza virus
VGKEFGNL

SEQ ID NO: 304057 - protein, 8 aa, Influenza virus
GKEFGNLE

SEQ ID NO: 304058 - protein, 8 aa, Influenza virus
KEFNNLEK

SEQ ID NO: 304059 - protein, 8 aa, Influenza virus
EFNNLEKR

SEQ ID NO: 304060 - protein, 8 aa, Influenza virus
FNNLEKRL

SEQ ID NO: 304061 - protein, 8 aa, Influenza virus
NNLEKRLE

SEQ ID NO: 304062 - protein, 8 aa, Influenza virus
ERRLENLS

SEQ ID NO: 304063 - protein, 8 aa, Influenza virus
KRLGNLNK

SEQ ID NO: 304064 - protein, 8 aa, Influenza virus
RLENLDKK

SEQ ID NO: 304065 - protein, 8 aa, Influenza virus
LGNLNKKM

SEQ ID NO: 304066 - protein, 8 aa, Influenza virus
ENLDKKME

SEQ ID NO: 304067 - protein, 8 aa, Influenza virus
NLDKKMED

SEQ ID NO: 304068 - protein, 8 aa, Influenza virus
LDKKMEDG

SEQ ID NO: 304069 - protein, 8 aa, Influenza virus
SKRMEDGF

SEQ ID NO: 304070 - protein, 8 aa, Influenza virus
MEDGLLDV

SEQ ID NO: 304071 - protein, 8 aa, Influenza virus
EDGLLDVW

SEQ ID NO: 304072 - protein, 8 aa, Influenza virus
DGLLDVWT

SEQ ID NO: 304073 - protein, 8 aa, Influenza virus
GFLGVWTY

SEQ ID NO: 304074 - protein, 8 aa, Influenza virus
FRDVWTYN

SEQ ID NO: 304075 - protein, 8 aa, Influenza virus
RDVWTYNA

SEQ ID NO: 304076 - protein, 8 aa, Influenza virus
SNVKNLYE

SEQ ID NO: 304077 - protein, 8 aa, Influenza virus
VKNLYEKV

SEQ ID NO: 304078 - protein, 8 aa, Influenza virus
KNLYEKVR

SEQ ID NO: 304079 - protein, 8 aa, Influenza virus
NLYEKVRM

SEQ ID NO: 304080 - protein, 8 aa, Influenza virus
DRVRMQLR

SEQ ID NO: 304081 - protein, 8 aa, Influenza virus
CMSSVKNG

SEQ ID NO: 304082 - protein, 8 aa, Influenza virus
MSSVKNGT

SEQ ID NO: 304083 - protein, 8 aa, Influenza virus
SSVKNGTY

SEQ ID NO: 304084 - protein, 8 aa, Influenza virus
SVKTGTYD

SEQ ID NO: 304085 - protein, 8 aa, Influenza virus
VRNGTYNY

SEQ ID NO: 304086 - protein, 8 aa, Influenza virus
KNGTYDYS

SEQ ID NO: 304087 - protein, 8 aa, Influenza virus
NGTYNYPK

SEQ ID NO: 304088 - protein, 8 aa, Influenza virus
YDYSKYEE

SEQ ID NO: 304089 - protein, 8 aa, Influenza virus
NYPKYEEE

SEQ ID NO: 304090 - protein, 8 aa, Influenza virus
EEESKLNK

SEQ ID NO: 304091 - protein, 8 aa, Influenza virus
KESKLNRN

SEQ ID NO: 304092 - protein, 8 aa, Influenza virus
VKLSSMGI

SEQ ID NO: 304093 - protein, 8 aa, Influenza virus
KLSSMGIY

SEQ ID NO: 304094 - protein, 8 aa, Influenza virus
LSSMGIYQ

SEQ ID NO: 304095 - protein, 8 aa, Influenza virus
SSMGIYQI

SEQ ID NO: 304096 - protein, 8 aa, Influenza virus
SMGIYQIL

SEQ ID NO: 304097 - protein, 8 aa, Influenza virus
AIMIAGIF

SEQ ID NO: 304098 - protein, 8 aa, Influenza virus
AGIFFWMC

SEQ ID NO: 304099 - protein, 8 aa, Influenza virus
GIFFWMCS

SEQ ID NO: 304100 - protein, 8 aa, Influenza virus
IFFWMCSN

SEQ ID NO: 304101 - protein, 8 aa, Influenza virus
FFWMCSNG

SEQ ID NO: 304102 - protein, 8 aa, Influenza virus
QKIITIGF

SEQ ID NO: 304103 - protein, 8 aa, Influenza virus
KIITMGSV

SEQ ID NO: 304104 - protein, 8 aa, Influenza virus
IITIGFVS

SEQ ID NO: 304105 - protein, 8 aa, Influenza virus
ITIDSVSL

SEQ ID NO: 304106 - protein, 8 aa, Influenza virus
TMGSVSLT

SEQ ID NO: 304107 - protein, 8 aa, Influenza virus
HIAILATT

SEQ ID NO: 304108 - protein, 8 aa, Influenza virus
IAILAATV

SEQ ID NO: 304109 - protein, 8 aa, Influenza virus
AILAATVT

SEQ ID NO: 304110 - protein, 8 aa, Influenza virus
ILAATVTL

SEQ ID NO: 304111 - protein, 8 aa, Influenza virus
LAATVTLH

SEQ ID NO: 304112 - protein, 8 aa, Influenza virus
ATTITLHF

SEQ ID NO: 304113 - protein, 8 aa, Influenza virus
TLHFKQHK

SEQ ID NO: 304114 - protein, 8 aa, Influenza virus
LHFKQHKC

SEQ ID NO: 304115 - protein, 8 aa, Influenza virus
HFKQHDCD

SEQ ID NO: 304116 - protein, 8 aa, Influenza virus
CDPIIIER

SEQ ID NO: 304117 - protein, 8 aa, Influenza virus
DPIIIERN

SEQ ID NO: 304118 - protein, 8 aa, Influenza virus
TEIMYLNN

SEQ ID NO: 304119 - protein, 8 aa, Influenza virus
EIMYLNNT

SEQ ID NO: 304120 - protein, 8 aa, Influenza virus
IVYLNNTI

SEQ ID NO: 304121 - protein, 8 aa, Influenza virus
YLNNTIIE

SEQ ID NO: 304122 - protein, 8 aa, Influenza virus
SKTQCQIT

SEQ ID NO: 304123 - protein, 8 aa, Influenza virus
KTQCQITG

SEQ ID NO: 304124 - protein, 8 aa, Influenza virus
PQCHITGF

SEQ ID NO: 304125 - protein, 8 aa, Influenza virus
SGGGDIWV

SEQ ID NO: 304126 - protein, 8 aa, Influenza virus
AGGDIWVM

SEQ ID NO: 304127 - protein, 8 aa, Influenza virus
GGDIWVMR

SEQ ID NO: 304128 - protein, 8 aa, Influenza virus
EPYVSCDS

SEQ ID NO: 304129 - protein, 8 aa, Influenza virus
NKCYQFAL

SEQ ID NO: 304130 - protein, 8 aa, Influenza virus
LENKHSNG

SEQ ID NO: 304131 - protein, 8 aa, Influenza virus
ENKHSNGT

SEQ ID NO: 304132 - protein, 8 aa, Influenza virus
NKHSNGTK

SEQ ID NO: 304133 - protein, 8 aa, Influenza virus
KHSNGTKH

SEQ ID NO: 304134 - protein, 8 aa, Influenza virus
HSNGTKHD

SEQ ID NO: 304135 - protein, 8 aa, Influenza virus
SNGTKHDR

SEQ ID NO: 304136 - protein, 8 aa, Influenza virus
TKHDRIPH

SEQ ID NO: 304137 - protein, 8 aa, Influenza virus
KHDRIPHR

SEQ ID NO: 304138 - protein, 8 aa, Influenza virus
LGTRQVCV

SEQ ID NO: 304139 - protein, 8 aa, Influenza virus
GTRQVCVA

SEQ ID NO: 304140 - protein, 8 aa, Influenza virus
TRQVCVAW

SEQ ID NO: 304141 - protein, 8 aa, Influenza virus
RQVCVAWS

SEQ ID NO: 304142 - protein, 8 aa, Influenza virus
KAWLHICV

SEQ ID NO: 304143 - protein, 8 aa, Influenza virus
CITGDDRN

SEQ ID NO: 304144 - protein, 8 aa, Influenza virus
ITGDDRNA

SEQ ID NO: 304145 - protein, 8 aa, Influenza virus
EKNATASF

SEQ ID NO: 304146 - protein, 8 aa, Influenza virus
RNATASFV

SEQ ID NO: 304147 - protein, 8 aa, Influenza virus
ATASFVYD

SEQ ID NO: 304148 - protein, 8 aa, Influenza virus
TASFVYDG

SEQ ID NO: 304149 - protein, 8 aa, Influenza virus
DSIGSWSH

SEQ ID NO: 304150 - protein, 8 aa, Influenza virus
SVGSWSQN

SEQ ID NO: 304151 - protein, 8 aa, Influenza virus
VGSWSQNI

SEQ ID NO: 304152 - protein, 8 aa, Influenza virus
ECVCISGT

SEQ ID NO: 304153 - protein, 8 aa, Influenza virus
CVCISGTC

SEQ ID NO: 304154 - protein, 8 aa, Influenza virus
VCISGTCA

SEQ ID NO: 304155 - protein, 8 aa, Influenza virus
CISGTCAV

SEQ ID NO: 304156 - protein, 8 aa, Influenza virus
ISGTCAVV

SEQ ID NO: 304157 - protein, 8 aa, Influenza virus
SGTCAVVM

SEQ ID NO: 304158 - protein, 8 aa, Influenza virus
GTCAVVMT

SEQ ID NO: 304159 - protein, 8 aa, Influenza virus
TCAVVMTD

SEQ ID NO: 304160 - protein, 8 aa, Influenza virus
DTRILFIR

SEQ ID NO: 304161 - protein, 8 aa, Influenza virus
TRILFIRE

SEQ ID NO: 304162 - protein, 8 aa, Influenza virus
RILFIREG

SEQ ID NO: 304163 - protein, 8 aa, Influenza virus
ILFIREGK

SEQ ID NO: 304164 - protein, 8 aa, Influenza virus
LFIREGKI

SEQ ID NO: 304165 - protein, 8 aa, Influenza virus
EGKVVHIS

SEQ ID NO: 304166 - protein, 8 aa, Influenza virus
GKVVHISP

SEQ ID NO: 304167 - protein, 8 aa, Influenza virus
KVVHISPL

SEQ ID NO: 304168 - protein, 8 aa, Influenza virus
VHISPLAG

SEQ ID NO: 304169 - protein, 8 aa, Influenza virus
HVSPLSGS

SEQ ID NO: 304170 - protein, 8 aa, Influenza virus
VSPLSGSA

SEQ ID NO: 304171 - protein, 8 aa, Influenza virus
SCYPQYPD

SEQ ID NO: 304172 - protein, 8 aa, Influenza virus
CYSRYPNV

SEQ ID NO: 304173 - protein, 8 aa, Influenza virus
YSRYPNVR

SEQ ID NO: 304174 - protein, 8 aa, Influenza virus
PQYPDVRC

SEQ ID NO: 304175 - protein, 8 aa, Influenza virus
RYPDVRCV

SEQ ID NO: 304176 - protein, 8 aa, Influenza virus
YPDVRCVC

SEQ ID NO: 304177 - protein, 8 aa, Influenza virus
PDVRCVCR

SEQ ID NO: 304178 - protein, 8 aa, Influenza virus
DVRCVCRD

SEQ ID NO: 304179 - protein, 8 aa, Influenza virus
CTCRDNWK

SEQ ID NO: 304180 - protein, 8 aa, Influenza virus
TCRDNWKG

SEQ ID NO: 304181 - protein, 8 aa, Influenza virus
GSNRPVLD

SEQ ID NO: 304182 - protein, 8 aa, Influenza virus
SNRPVLDI

SEQ ID NO: 304183 - protein, 8 aa, Influenza virus
NRPVLDIS

SEQ ID NO: 304184 - protein, 8 aa, Influenza virus
DINIAEYS

SEQ ID NO: 304185 - protein, 8 aa, Influenza virus
INIAEYSI

SEQ ID NO: 304186 - protein, 8 aa, Influenza virus
NIAEYSID

SEQ ID NO: 304187 - protein, 8 aa, Influenza virus
MVDYSIDS

SEQ ID NO: 304188 - protein, 8 aa, Influenza virus
DYSIDSNY

SEQ ID NO: 304189 - protein, 8 aa, Influenza virus
YSIDSGYV

SEQ ID NO: 304190 - protein, 8 aa, Influenza virus
SIDSNYVC

SEQ ID NO: 304191 - protein, 8 aa, Influenza virus
IDSGYVCS

SEQ ID NO: 304192 - protein, 8 aa, Influenza virus
DSGYVCSG

SEQ ID NO: 304193 - protein, 8 aa, Influenza virus
SNYVCSGL

SEQ ID NO: 304194 - protein, 8 aa, Influenza virus
GYVCSGLV

SEQ ID NO: 304195 - protein, 8 aa, Influenza virus
DTPRNNDG

SEQ ID NO: 304196 - protein, 8 aa, Influenza virus
TPRNGDSS

SEQ ID NO: 304197 - protein, 8 aa, Influenza virus
PRNGDSSS

SEQ ID NO: 304198 - protein, 8 aa, Influenza virus
DRFSNSNC

SEQ ID NO: 304199 - protein, 8 aa, Influenza virus
SNSNCKDP

SEQ ID NO: 304200 - protein, 8 aa, Influenza virus
NSNCKDPN

SEQ ID NO: 304201 - protein, 8 aa, Influenza virus
CKDPNNER

SEQ ID NO: 304202 - protein, 8 aa, Influenza virus
KDPNNERG

SEQ ID NO: 304203 - protein, 8 aa, Influenza virus
NPNNERGT

SEQ ID NO: 304204 - protein, 8 aa, Influenza virus
PNNERGTQ

SEQ ID NO: 304205 - protein, 8 aa, Influenza virus
NNERGTQG

SEQ ID NO: 304206 - protein, 8 aa, Influenza virus
NERGTQGV

SEQ ID NO: 304207 - protein, 8 aa, Influenza virus
ERGTQGVK

SEQ ID NO: 304208 - protein, 8 aa, Influenza virus
RGTQGVKG

SEQ ID NO: 304209 - protein, 8 aa, Influenza virus
GYPGVKGW

SEQ ID NO: 304210 - protein, 8 aa, Influenza virus
NHGVKGWA

SEQ ID NO: 304211 - protein, 8 aa, Influenza virus
VKGWAFDY

SEQ ID NO: 304212 - protein, 8 aa, Influenza virus
KGWAFDYG

SEQ ID NO: 304213 - protein, 8 aa, Influenza virus
GNDLWMGR

SEQ ID NO: 304214 - protein, 8 aa, Influenza virus
NDLWMGRT

SEQ ID NO: 304215 - protein, 8 aa, Influenza virus
LWMGTTIS

SEQ ID NO: 304216 - protein, 8 aa, Influenza virus
WMGTTISK

SEQ ID NO: 304217 - protein, 8 aa, Influenza virus
KESRSGYE

SEQ ID NO: 304218 - protein, 8 aa, Influenza virus
FRVIGGWT

SEQ ID NO: 304219 - protein, 8 aa, Influenza virus
RVIGGWTT

SEQ ID NO: 304220 - protein, 8 aa, Influenza virus
VIGGWSTA

SEQ ID NO: 304221 - protein, 8 aa, Influenza virus
SKSQTSRQ

SEQ ID NO: 304222 - protein, 8 aa, Influenza virus
RQIIVDNN

SEQ ID NO: 304223 - protein, 8 aa, Influenza virus
SNNRSGYS

SEQ ID NO: 304224 - protein, 8 aa, Influenza virus
KSCVNRCF

SEQ ID NO: 304225 - protein, 8 aa, Influenza virus
SCVNRCFY

SEQ ID NO: 304226 - protein, 8 aa, Influenza virus
VELIRGRS

SEQ ID NO: 304227 - protein, 8 aa, Influenza virus
ELIRGRSQ

SEQ ID NO: 304228 - protein, 8 aa, Influenza virus
LIRGRSQE

SEQ ID NO: 304229 - protein, 8 aa, Influenza virus
SQETRVWW

SEQ ID NO: 304230 - protein, 8 aa, Influenza virus
WPDGANTN

SEQ ID NO: 304231 - protein, 8 aa, Influenza virus
PDGANIDF

SEQ ID NO: 304232 - protein, 8 aa, Influenza virus
DGANIDFM

SEQ ID NO: 304233 - protein, 8 aa, Influenza virus
GANIDFMP

SEQ ID NO: 304234 - protein, 8 aa, Influenza virus
ANISFMPI

SEQ ID NO: 304235 - protein, 8 aa, Influenza virus
LGHHAVSN

SEQ ID NO: 304236 - protein, 8 aa, Influenza virus
DRIEVTNA

SEQ ID NO: 304237 - protein, 8 aa, Influenza virus
NATELVQG

SEQ ID NO: 304238 - protein, 8 aa, Influenza virus
CTLVDALL

SEQ ID NO: 304239 - protein, 8 aa, Influenza virus
TLVDALLG

SEQ ID NO: 304240 - protein, 8 aa, Influenza virus
LVDALLGD

SEQ ID NO: 304241 - protein, 8 aa, Influenza virus
VDALLGDP

SEQ ID NO: 304242 - protein, 8 aa, Influenza virus
WDLFVERN

SEQ ID NO: 304243 - protein, 8 aa, Influenza virus
SSCYPYDV

SEQ ID NO: 304244 - protein, 8 aa, Influenza virus
CYPYDVPE

SEQ ID NO: 304245 - protein, 8 aa, Influenza virus
TLRSLVAS

SEQ ID NO: 304246 - protein, 8 aa, Influenza virus
SLVASSGN

SEQ ID NO: 304247 - protein, 8 aa, Influenza virus
IVASSGTV

SEQ ID NO: 304248 - protein, 8 aa, Influenza virus
VASSGNLE

SEQ ID NO: 304249 - protein, 8 aa, Influenza virus
SFFSKLNW

SEQ ID NO: 304250 - protein, 8 aa, Influenza virus
FRRLNWLT

SEQ ID NO: 304251 - protein, 8 aa, Influenza virus
SVYWTIVK

SEQ ID NO: 304252 - protein, 8 aa, Influenza virus
HWTIVKPG

SEQ ID NO: 304253 - protein, 8 aa, Influenza virus
CTGNLIAP

SEQ ID NO: 304254 - protein, 8 aa, Influenza virus
APRGYFKV

SEQ ID NO: 304255 - protein, 8 aa, Influenza virus
FECITPNG

SEQ ID NO: 304256 - protein, 8 aa, Influenza virus
PNGSIPNN

SEQ ID NO: 304257 - protein, 8 aa, Influenza virus
NGSIPNNK

SEQ ID NO: 304258 - protein, 8 aa, Influenza virus
GSIPNNKP

SEQ ID NO: 304259 - protein, 8 aa, Influenza virus
SIPNNKPF

SEQ ID NO: 304260 - protein, 8 aa, Influenza virus
IPNNKPFQ

SEQ ID NO: 304261 - protein, 8 aa, Influenza virus
PNNKPFQN

SEQ ID NO: 304262 - protein, 8 aa, Influenza virus
NGKPFQNV

SEQ ID NO: 304263 - protein, 8 aa, Influenza virus
GKPFQNVN

SEQ ID NO: 304264 - protein, 8 aa, Influenza virus
TYGPCPRY

SEQ ID NO: 304265 - protein, 8 aa, Influenza virus
QGTLKLAT

SEQ ID NO: 304266 - protein, 8 aa, Influenza virus
GMRNVPET

SEQ ID NO: 304267 - protein, 8 aa, Influenza virus
MRNVPETQ

SEQ ID NO: 304268 - protein, 8 aa, Influenza virus
QTKGLFGA

SEQ ID NO: 304269 - protein, 8 aa, Influenza virus
TKGLFGAI

SEQ ID NO: 304270 - protein, 8 aa, Influenza virus
WEGMVNGW

SEQ ID NO: 304271 - protein, 8 aa, Influenza virus
EGMVNGWY

SEQ ID NO: 304272 - protein, 8 aa, Influenza virus
GMVNGWYG

SEQ ID NO: 304273 - protein, 8 aa, Influenza virus
MVNGWYGF

SEQ ID NO: 304274 - protein, 8 aa, Influenza virus
VNGWYGFR

SEQ ID NO: 304275 - protein, 8 aa, Influenza virus
YGFRHHNS

SEQ ID NO: 304276 - protein, 8 aa, Influenza virus
GFRHHNSE

SEQ ID NO: 304277 - protein, 8 aa, Influenza virus
FRHHNSEG

SEQ ID NO: 304278 - protein, 8 aa, Influenza virus
HNSEGTGQ

SEQ ID NO: 304279 - protein, 8 aa, Influenza virus
SEGMGQAA

SEQ ID NO: 304280 - protein, 8 aa, Influenza virus
GMGQAADL

SEQ ID NO: 304281 - protein, 8 aa, Influenza virus
MGQAADLK

SEQ ID NO: 304282 - protein, 8 aa, Influenza virus
TQAAIDQV

SEQ ID NO: 304283 - protein, 8 aa, Influenza virus
QINGKLNK

SEQ ID NO: 304284 - protein, 8 aa, Influenza virus
IKKTNEKF

SEQ ID NO: 304285 - protein, 8 aa, Influenza virus
KKTNEKFH

SEQ ID NO: 304286 - protein, 8 aa, Influenza virus
NAEFLVAL

SEQ ID NO: 304287 - protein, 8 aa, Influenza virus
AEFLVALE

SEQ ID NO: 304288 - protein, 8 aa, Influenza virus
EFLVALEN

SEQ ID NO: 304289 - protein, 8 aa, Influenza virus
HTIDLADS

SEQ ID NO: 304290 - protein, 8 aa, Influenza virus
IDLADSEM

SEQ ID NO: 304291 - protein, 8 aa, Influenza virus
HLTDSEMN

SEQ ID NO: 304292 - protein, 8 aa, Influenza virus
LADSEMNK

SEQ ID NO: 304293 - protein, 8 aa, Influenza virus
ADSEMNKL

SEQ ID NO: 304294 - protein, 8 aa, Influenza virus
EMSKLFER

SEQ ID NO: 304295 - protein, 8 aa, Influenza virus
MSKLFERT

SEQ ID NO: 304296 - protein, 8 aa, Influenza virus
ENAEDIGN

SEQ ID NO: 304297 - protein, 8 aa, Influenza virus
NAEDIGNG

SEQ ID NO: 304298 - protein, 8 aa, Influenza virus
AEDIGNGC

SEQ ID NO: 304299 - protein, 8 aa, Influenza virus
EDMGDGCF

SEQ ID NO: 304300 - protein, 8 aa, Influenza virus
GDGCFKIY

SEQ ID NO: 304301 - protein, 8 aa, Influenza virus
DGCFKIYH

SEQ ID NO: 304302 - protein, 8 aa, Influenza virus
GCFRIYHK

SEQ ID NO: 304303 - protein, 8 aa, Influenza virus
CFRIYHKC

SEQ ID NO: 304304 - protein, 8 aa, Influenza virus
FRIYHKCD

SEQ ID NO: 304305 - protein, 8 aa, Influenza virus
KIYHRCDN

SEQ ID NO: 304306 - protein, 8 aa, Influenza virus
IYHKCDNV

SEQ ID NO: 304307 - protein, 8 aa, Influenza virus
YHKCDNVC

SEQ ID NO: 304308 - protein, 8 aa, Influenza virus
ESIRTGTY

SEQ ID NO: 304309 - protein, 8 aa, Influenza virus
SIRNETYD

SEQ ID NO: 304310 - protein, 8 aa, Influenza virus
IRNETYDH

SEQ ID NO: 304311 - protein, 8 aa, Influenza virus
YRDEALSN

SEQ ID NO: 304312 - protein, 8 aa, Influenza virus
RDEALSNR

SEQ ID NO: 304313 - protein, 8 aa, Influenza virus
DEALNNRS

SEQ ID NO: 304314 - protein, 8 aa, Influenza virus
EALNNRSQ

SEQ ID NO: 304315 - protein, 8 aa, Influenza virus
GYKDWFLW

SEQ ID NO: 304316 - protein, 8 aa, Influenza virus
ILWISFAM

SEQ ID NO: 304317 - protein, 8 aa, Influenza virus
FAMSCFLL

SEQ ID NO: 304318 - protein, 8 aa, Influenza virus
AMSCFLLC

SEQ ID NO: 304319 - protein, 8 aa, Influenza virus
FIMWTCQK

SEQ ID NO: 304320 - protein, 8 aa, Influenza virus
IMWTCQKG

SEQ ID NO: 304321 - protein, 8 aa, Influenza virus
QKGNIRCD

SEQ ID NO: 304322 - protein, 8 aa, Influenza virus
KGNIRCDI

SEQ ID NO: 304323 - protein, 8 aa, Influenza virus
VPNGTIVR

SEQ ID NO: 304324 - protein, 8 aa, Influenza virus
PNGTIVRT

SEQ ID NO: 304325 - protein, 8 aa, Influenza virus
NGTIVRTI

SEQ ID NO: 304326 - protein, 8 aa, Influenza virus
GTIVRTIT

SEQ ID NO: 304327 - protein, 8 aa, Influenza virus
WDLFVERN

SEQ ID NO: 304328 - protein, 8 aa, Influenza virus
SDCYPYDV

SEQ ID NO: 304329 - protein, 8 aa, Influenza virus
CYPYDVQD

SEQ ID NO: 304330 - protein, 8 aa, Influenza virus
YPYDVPEY

SEQ ID NO: 304331 - protein, 8 aa, Influenza virus
SSGTLEFV

SEQ ID NO: 304332 - protein, 8 aa, Influenza virus
FRRLNWLT

SEQ ID NO: 304333 - protein, 8 aa, Influenza virus
WGVHHPIT

SEQ ID NO: 304334 - protein, 8 aa, Influenza virus
ISIHWTIV

SEQ ID NO: 304335 - protein, 8 aa, Influenza virus
SVYWTIVK

SEQ ID NO: 304336 - protein, 8 aa, Influenza virus
VYWTIVKP

SEQ ID NO: 304337 - protein, 8 aa, Influenza virus
APRGYYKM

SEQ ID NO: 304338 - protein, 8 aa, Influenza virus
GRSSIMRS

SEQ ID NO: 304339 - protein, 8 aa, Influenza virus
KSSVMRSD

SEQ ID NO: 304340 - protein, 8 aa, Influenza virus
SSVMRSDA

SEQ ID NO: 304341 - protein, 8 aa, Influenza virus
FECITPNG

SEQ ID NO: 304342 - protein, 8 aa, Influenza virus
PNGSIPNG

SEQ ID NO: 304343 - protein, 8 aa, Influenza virus
NGSIPNGK

SEQ ID NO: 304344 - protein, 8 aa, Influenza virus
GSIPNGKP

SEQ ID NO: 304345 - protein, 8 aa, Influenza virus
SIPNNKPF

SEQ ID NO: 304346 - protein, 8 aa, Influenza virus
IPNNKPFQ

SEQ ID NO: 304347 - protein, 8 aa, Influenza virus
PNGKPFQN

SEQ ID NO: 304348 - protein, 8 aa, Influenza virus
NGKPFQNV

SEQ ID NO: 304349 - protein, 8 aa, Influenza virus
GKPFQNVN

SEQ ID NO: 304350 - protein, 8 aa, Influenza virus
VNRITYGV

SEQ ID NO: 304351 - protein, 8 aa, Influenza virus
NRITYGVC

SEQ ID NO: 304352 - protein, 8 aa, Influenza virus
RITYGVCP

SEQ ID NO: 304353 - protein, 8 aa, Influenza virus
ITYGVCPR

SEQ ID NO: 304354 - protein, 8 aa, Influenza virus
YGACPKYI

SEQ ID NO: 304355 - protein, 8 aa, Influenza virus
YVKQKTLK

SEQ ID NO: 304356 - protein, 8 aa, Influenza virus
VKQKTLKL

SEQ ID NO: 304357 - protein, 8 aa, Influenza virus
GMRNVPER

SEQ ID NO: 304358 - protein, 8 aa, Influenza virus
MRNVPERQ

SEQ ID NO: 304359 - protein, 8 aa, Influenza virus
RNIPEKQT

SEQ ID NO: 304360 - protein, 8 aa, Influenza virus
NIPEKQTR

SEQ ID NO: 304361 - protein, 8 aa, Influenza virus
IPEKQTRG

SEQ ID NO: 304362 - protein, 8 aa, Influenza virus
PERQTRGI

SEQ ID NO: 304363 - protein, 8 aa, Influenza virus
ERQTRGIF

SEQ ID NO: 304364 - protein, 8 aa, Influenza virus
RQTRGIFG

SEQ ID NO: 304365 - protein, 8 aa, Influenza virus
NGWEGMVN

SEQ ID NO: 304366 - protein, 8 aa, Influenza virus
GWEGMVNG

SEQ ID NO: 304367 - protein, 8 aa, Influenza virus
WEGMVNGW

SEQ ID NO: 304368 - protein, 8 aa, Influenza virus
EGMVNGWY

SEQ ID NO: 304369 - protein, 8 aa, Influenza virus
GMVNGWYG

SEQ ID NO: 304370 - protein, 8 aa, Influenza virus
MVNGWYGF

SEQ ID NO: 304371 - protein, 8 aa, Influenza virus
VNGWYGFR

SEQ ID NO: 304372 - protein, 8 aa, Influenza virus
RHHNSEGT

SEQ ID NO: 304373 - protein, 8 aa, Influenza virus
HHNSEGTG

SEQ ID NO: 304374 - protein, 8 aa, Influenza virus
HNSEGTGQ

SEQ ID NO: 304375 - protein, 8 aa, Influenza virus
TQAAVNQI

SEQ ID NO: 304376 - protein, 8 aa, Influenza virus
DQVNGKLN

SEQ ID NO: 304377 - protein, 8 aa, Influenza virus
QVNGKLNR

SEQ ID NO: 304378 - protein, 8 aa, Influenza virus
VEKTNEKF

SEQ ID NO: 304379 - protein, 8 aa, Influenza virus
NAEILVAL

SEQ ID NO: 304380 - protein, 8 aa, Influenza virus
AEILVALE

SEQ ID NO: 304381 - protein, 8 aa, Influenza virus
EILVALEN

SEQ ID NO: 304382 - protein, 8 aa, Influenza virus
EMSKLFEK

SEQ ID NO: 304383 - protein, 8 aa, Influenza virus
MSKLFEKT

SEQ ID NO: 304384 - protein, 8 aa, Influenza virus
DMGNGCFR

SEQ ID NO: 304385 - protein, 8 aa, Influenza virus
MGNGCFRI

SEQ ID NO: 304386 - protein, 8 aa, Influenza virus
FRIYHKCD

SEQ ID NO: 304387 - protein, 8 aa, Influenza virus
IYHKCNNA

SEQ ID NO: 304388 - protein, 8 aa, Influenza virus
HKCDNSCI

SEQ ID NO: 304389 - protein, 8 aa, Influenza virus
CMESIRNG

SEQ ID NO: 304390 - protein, 8 aa, Influenza virus
MESIRNGT

SEQ ID NO: 304391 - protein, 8 aa, Influenza virus
RNETYDHD

SEQ ID NO: 304392 - protein, 8 aa, Influenza virus
DEALNNRS

SEQ ID NO: 304393 - protein, 8 aa, Influenza virus
EALSNRFQ

SEQ ID NO: 304394 - protein, 8 aa, Influenza virus
ALSNRFQI

SEQ ID NO: 304395 - protein, 8 aa, Influenza virus
LSNRFQIK

SEQ ID NO: 304396 - protein, 8 aa, Influenza virus
SNRFQIKS

SEQ ID NO: 304397 - protein, 8 aa, Influenza virus
NRFQIKGI

SEQ ID NO: 304398 - protein, 8 aa, Influenza virus
LKSGYKNW

SEQ ID NO: 304399 - protein, 8 aa, Influenza virus
GYKDWFLW

SEQ ID NO: 304400 - protein, 8 aa, Influenza virus
ILWISFAM

SEQ ID NO: 304401 - protein, 8 aa, Influenza virus
FIVWACQR

SEQ ID NO: 304402 - protein, 8 aa, Influenza virus
IVWACQRG

SEQ ID NO: 304403 - protein, 8 aa, Influenza virus
QKGNIRCD

SEQ ID NO: 304404 - protein, 8 aa, Influenza virus
KGNIRCDI

SEQ ID NO: 304405 - protein, 8 aa, Influenza virus
MNPNQRII

SEQ ID NO: 304406 - protein, 8 aa, Influenza virus
YPIKKIIT

SEQ ID NO: 304407 - protein, 8 aa, Influenza virus
PNKKIITI

SEQ ID NO: 304408 - protein, 8 aa, Influenza virus
QKIITIGA

SEQ ID NO: 304409 - protein, 8 aa, Influenza virus
KIITIGAV

SEQ ID NO: 304410 - protein, 8 aa, Influenza virus
TTVTLHFR

SEQ ID NO: 304411 - protein, 8 aa, Influenza virus
TVTLHFRQ

SEQ ID NO: 304412 - protein, 8 aa, Influenza virus
YRSWSKPQ

SEQ ID NO: 304413 - protein, 8 aa, Influenza virus
RSWSKPQC

SEQ ID NO: 304414 - protein, 8 aa, Influenza virus
REPYVSCG

SEQ ID NO: 304415 - protein, 8 aa, Influenza virus
NKCYQFAL

SEQ ID NO: 304416 - protein, 8 aa, Influenza virus
NENATASF

SEQ ID NO: 304417 - protein, 8 aa, Influenza virus
NNATASFI

SEQ ID NO: 304418 - protein, 8 aa, Influenza virus
ATASFVYD

SEQ ID NO: 304419 - protein, 8 aa, Influenza virus
TASFVYDG

SEQ ID NO: 304420 - protein, 8 aa, Influenza virus
LVDSISSW

SEQ ID NO: 304421 - protein, 8 aa, Influenza virus
VDSISSWS

SEQ ID NO: 304422 - protein, 8 aa, Influenza virus
DILRTQES

SEQ ID NO: 304423 - protein, 8 aa, Influenza virus
VCISGTCA

SEQ ID NO: 304424 - protein, 8 aa, Influenza virus
INGTCTVI

SEQ ID NO: 304425 - protein, 8 aa, Influenza virus
NGTCTVIM

SEQ ID NO: 304426 - protein, 8 aa, Influenza virus
LFVEEGKI

SEQ ID NO: 304427 - protein, 8 aa, Influenza virus
LSGNAQHV

SEQ ID NO: 304428 - protein, 8 aa, Influenza virus
SGNAQHVE

SEQ ID NO: 304429 - protein, 8 aa, Influenza virus
SCYPRFPG

SEQ ID NO: 304430 - protein, 8 aa, Influenza virus
DVRCVCRD

SEQ ID NO: 304431 - protein, 8 aa, Influenza virus
KGSNRPII

SEQ ID NO: 304432 - protein, 8 aa, Influenza virus
GSNRPIID

SEQ ID NO: 304433 - protein, 8 aa, Influenza virus
SNRPIIDI

SEQ ID NO: 304434 - protein, 8 aa, Influenza virus
NRPIIDIN

SEQ ID NO: 304435 - protein, 8 aa, Influenza virus
SSYLCSGL

SEQ ID NO: 304436 - protein, 8 aa, Influenza virus
SYLCSGLV

SEQ ID NO: 304437 - protein, 8 aa, Influenza virus
KGWAFDYG

SEQ ID NO: 304438 - protein, 8 aa, Influenza virus
GNDIWMGR

SEQ ID NO: 304439 - protein, 8 aa, Influenza virus
IWMGRTIS

SEQ ID NO: 304440 - protein, 8 aa, Influenza virus
WMGRTIGE

SEQ ID NO: 304441 - protein, 8 aa, Influenza virus
FRSGYETF

SEQ ID NO: 304442 - protein, 8 aa, Influenza virus
QINKQVIV

SEQ ID NO: 304443 - protein, 8 aa, Influenza virus
RSGYSGVF

SEQ ID NO: 304444 - protein, 8 aa, Influenza virus
SGVFSVEG

SEQ ID NO: 304445 - protein, 8 aa, Influenza virus
GVFSVEGK

SEQ ID NO: 304446 - protein, 8 aa, Influenza virus
FSVEGKNC

SEQ ID NO: 304447 - protein, 8 aa, Influenza virus
KVWWTSNS

SEQ ID NO: 304448 - protein, 8 aa, Influenza virus
SWPDGAEI

SEQ ID NO: 304449 - protein, 8 aa, Influenza virus
GHHSVPNG

SEQ ID NO: 304450 - protein, 8 aa, Influenza virus
HHSVPNGT

SEQ ID NO: 304451 - protein, 8 aa, Influenza virus
VANGTIVK

SEQ ID NO: 304452 - protein, 8 aa, Influenza virus
ANGTIVKT

SEQ ID NO: 304453 - protein, 8 aa, Influenza virus
TVVKTLTD

SEQ ID NO: 304454 - protein, 8 aa, Influenza virus
VKTLTNDQ

SEQ ID NO: 304455 - protein, 8 aa, Influenza virus
VEVVAAQE

SEQ ID NO: 304456 - protein, 8 aa, Influenza virus
SELCPSPL

SEQ ID NO: 304457 - protein, 8 aa, Influenza virus
CPSPLKLV

SEQ ID NO: 304458 - protein, 8 aa, Influenza virus
PSPLKLVD

SEQ ID NO: 304459 - protein, 8 aa, Influenza virus
SPLKLVDG

SEQ ID NO: 304460 - protein, 8 aa, Influenza virus
PLKLIDGQ

SEQ ID NO: 304461 - protein, 8 aa, Influenza virus
CDIVNAAL

SEQ ID NO: 304462 - protein, 8 aa, Influenza virus
DIVNAALG

SEQ ID NO: 304463 - protein, 8 aa, Influenza virus
IVNAALGS

SEQ ID NO: 304464 - protein, 8 aa, Influenza virus
EWDVFVER

SEQ ID NO: 304465 - protein, 8 aa, Influenza virus
YPFDVPNY

SEQ ID NO: 304466 - protein, 8 aa, Influenza virus
PFDVPNYQ

SEQ ID NO: 304467 - protein, 8 aa, Influenza virus
FDVPGYQS

SEQ ID NO: 304468 - protein, 8 aa, Influenza virus
DVPGYQSL

SEQ ID NO: 304469 - protein, 8 aa, Influenza virus
VPDYQSIR

SEQ ID NO: 304470 - protein, 8 aa, Influenza virus
PGYQSLRS

SEQ ID NO: 304471 - protein, 8 aa, Influenza virus
NYQSLRSI

SEQ ID NO: 304472 - protein, 8 aa, Influenza virus
NGKLEFIA

SEQ ID NO: 304473 - protein, 8 aa, Influenza virus
GKLEFIAE

SEQ ID NO: 304474 - protein, 8 aa, Influenza virus
KLEFIAEE

SEQ ID NO: 304475 - protein, 8 aa, Influenza virus
LEFIAEEF

SEQ ID NO: 304476 - protein, 8 aa, Influenza virus
FIVEKFQW

SEQ ID NO: 304477 - protein, 8 aa, Influenza virus
AVKQNGKS

SEQ ID NO: 304478 - protein, 8 aa, Influenza virus
IKQNGKSG

SEQ ID NO: 304479 - protein, 8 aa, Influenza virus
RADVNDFF

SEQ ID NO: 304480 - protein, 8 aa, Influenza virus
NDFFKRLN

SEQ ID NO: 304481 - protein, 8 aa, Influenza virus
LNWLIKSD

SEQ ID NO: 304482 - protein, 8 aa, Influenza virus
PIQNLTKV

SEQ ID NO: 304483 - protein, 8 aa, Influenza virus
IQNLTKVN

SEQ ID NO: 304484 - protein, 8 aa, Influenza virus
QNLTKTNN

SEQ ID NO: 304485 - protein, 8 aa, Influenza virus
NLTKTNNG

SEQ ID NO: 304486 - protein, 8 aa, Influenza virus
LTKVNNGN

SEQ ID NO: 304487 - protein, 8 aa, Influenza virus
TKVNSGDY

SEQ ID NO: 304488 - protein, 8 aa, Influenza virus
NNGNYARL

SEQ ID NO: 304489 - protein, 8 aa, Influenza virus
NGNYARLY

SEQ ID NO: 304490 - protein, 8 aa, Influenza virus
LYKSNPGR

SEQ ID NO: 304491 - protein, 8 aa, Influenza virus
YKSNPGRV

SEQ ID NO: 304492 - protein, 8 aa, Influenza virus
KNNPGRVS

SEQ ID NO: 304493 - protein, 8 aa, Influenza virus
SNPGRVTV

SEQ ID NO: 304494 - protein, 8 aa, Influenza virus
GRVTVSTR

SEQ ID NO: 304495 - protein, 8 aa, Influenza virus
QTSVIPNI

SEQ ID NO: 304496 - protein, 8 aa, Influenza virus
TSVVPDIG

SEQ ID NO: 304497 - protein, 8 aa, Influenza virus
SIVPNIGI

SEQ ID NO: 304498 - protein, 8 aa, Influenza virus
GPWVRGQS

SEQ ID NO: 304499 - protein, 8 aa, Influenza virus
VRGLSSRI

SEQ ID NO: 304500 - protein, 8 aa, Influenza virus
GLSSRISF

SEQ ID NO: 304501 - protein, 8 aa, Influenza virus
PGDVIVFN

SEQ ID NO: 304502 - protein, 8 aa, Influenza virus
GNLIVFNT

SEQ ID NO: 304503 - protein, 8 aa, Influenza virus
DVIVFNTI

SEQ ID NO: 304504 - protein, 8 aa, Influenza virus
IGSCISKC

SEQ ID NO: 304505 - protein, 8 aa, Influenza virus
GSCISKCH

SEQ ID NO: 304506 - protein, 8 aa, Influenza virus
SCVSRCHT

SEQ ID NO: 304507 - protein, 8 aa, Influenza virus
SKCHTEKG

SEQ ID NO: 304508 - protein, 8 aa, Influenza virus
KCHTEKGS

SEQ ID NO: 304509 - protein, 8 aa, Influenza virus
PFQNVSRT

SEQ ID NO: 304510 - protein, 8 aa, Influenza virus
FQNVSRIA

SEQ ID NO: 304511 - protein, 8 aa, Influenza virus
GDCPRYVK

SEQ ID NO: 304512 - protein, 8 aa, Influenza virus
DCPRYVKQ

SEQ ID NO: 304513 - protein, 8 aa, Influenza virus
QAAIDQIS

SEQ ID NO: 304514 - protein, 8 aa, Influenza virus
AAIDKING

SEQ ID NO: 304515 - protein, 8 aa, Influenza virus
AIDKINGK

SEQ ID NO: 304516 - protein, 8 aa, Influenza virus
INQINGKL

SEQ ID NO: 304517 - protein, 8 aa, Influenza virus
DQISGKLN

SEQ ID NO: 304518 - protein, 8 aa, Influenza virus
QVEGRIQN

SEQ ID NO: 304519 - protein, 8 aa, Influenza virus
QYLEKYVE

SEQ ID NO: 304520 - protein, 8 aa, Influenza virus
DLEEYVED

SEQ ID NO: 304521 - protein, 8 aa, Influenza virus
DVADSEMN

SEQ ID NO: 304522 - protein, 8 aa, Influenza virus
MTDSEMNK

SEQ ID NO: 304523 - protein, 8 aa, Influenza virus
TDSEMSKL

SEQ ID NO: 304524 - protein, 8 aa, Influenza virus
MSKLFERV

SEQ ID NO: 304525 - protein, 8 aa, Influenza virus
NRLFERVR

SEQ ID NO: 304526 - protein, 8 aa, Influenza virus
RLFERVRR

SEQ ID NO: 304527 - protein, 8 aa, Influenza virus
EIFHQCNN

SEQ ID NO: 304528 - protein, 8 aa, Influenza virus
CNNNCIES

SEQ ID NO: 304529 - protein, 8 aa, Influenza virus
NNNCIESI

SEQ ID NO: 304530 - protein, 8 aa, Influenza virus
RNGTYNHN

SEQ ID NO: 304531 - protein, 8 aa, Influenza virus
TYDHNVYR

SEQ ID NO: 304532 - protein, 8 aa, Influenza virus
HNIYRDEA

SEQ ID NO: 304533 - protein, 8 aa, Influenza virus
NIYRDEAI

SEQ ID NO: 304534 - protein, 8 aa, Influenza virus
IYRDEAIS

SEQ ID NO: 304535 - protein, 8 aa, Influenza virus
YRDEAINS

SEQ ID NO: 304536 - protein, 8 aa, Influenza virus
RDEAINSR

SEQ ID NO: 304537 - protein, 8 aa, Influenza virus
DEAINSRF

SEQ ID NO: 304538 - protein, 8 aa, Influenza virus
DAINNRFQ

SEQ ID NO: 304539 - protein, 8 aa, Influenza virus
QIQGVKLI

SEQ ID NO: 304540 - protein, 8 aa, Influenza virus
IQGVKLIQ

SEQ ID NO: 304541 - protein, 8 aa, Influenza virus
QGVKLIQG

SEQ ID NO: 304542 - protein, 8 aa, Influenza virus
GVKLIQGY

SEQ ID NO: 304543 - protein, 8 aa, Influenza virus
VKLIQGYK

SEQ ID NO: 304544 - protein, 8 aa, Influenza virus
KLIQGYKD

SEQ ID NO: 304545 - protein, 8 aa, Influenza virus
CFLLVALF

SEQ ID NO: 304546 - protein, 8 aa, Influenza virus
FLLIALLL

SEQ ID NO: 304547 - protein, 8 aa, Influenza virus
ALLLAFML

SEQ ID NO: 304548 - protein, 8 aa, Influenza virus
LLLAFVLW

SEQ ID NO: 304549 - protein, 8 aa, Influenza virus
LLAFVLWA

SEQ ID NO: 304550 - protein, 8 aa, Influenza virus
LAFVLWAC

SEQ ID NO: 304551 - protein, 8 aa, Influenza virus
ILWACQTG

SEQ ID NO: 304552 - protein, 8 aa, Influenza virus
WACQTGNI

SEQ ID NO: 304553 - protein, 8 aa, Influenza virus
CQTGNIRC

SEQ ID NO: 304554 - protein, 8 aa, Influenza virus
QTGNIRCQ

SEQ ID NO: 304555 - protein, 8 aa, Influenza virus
SGNIRCQI

SEQ ID NO: 304556 - protein, 8 aa, Influenza virus
GDRICIGY

SEQ ID NO: 304557 - protein, 8 aa, Influenza virus
DQICVGYH

SEQ ID NO: 304558 - protein, 8 aa, Influenza virus
QICVGYHA

SEQ ID NO: 304559 - protein, 8 aa, Influenza virus
HANNSTEH

SEQ ID NO: 304560 - protein, 8 aa, Influenza virus
STERVDTI

SEQ ID NO: 304561 - protein, 8 aa, Influenza virus
EHVDTIME

SEQ ID NO: 304562 - protein, 8 aa, Influenza virus
HVDTIMEK

SEQ ID NO: 304563 - protein, 8 aa, Influenza virus
ITVTHAQD

SEQ ID NO: 304564 - protein, 8 aa, Influenza virus
TVTHAQDL

SEQ ID NO: 304565 - protein, 8 aa, Influenza virus
HAKDILEK

SEQ ID NO: 304566 - protein, 8 aa, Influenza virus
GVRPLILR

SEQ ID NO: 304567 - protein, 8 aa, Influenza virus
RPLILRDC

SEQ ID NO: 304568 - protein, 8 aa, Influenza virus
LILGDCSV

SEQ ID NO: 304569 - protein, 8 aa, Influenza virus
ILKDCSVS

SEQ ID NO: 304570 - protein, 8 aa, Influenza virus
LGDCSVAG

SEQ ID NO: 304571 - protein, 8 aa, Influenza virus
GDCSVAGW

SEQ ID NO: 304572 - protein, 8 aa, Influenza virus
GNPTCDEF

SEQ ID NO: 304573 - protein, 8 aa, Influenza virus
KVPEWSYI

SEQ ID NO: 304574 - protein, 8 aa, Influenza virus
DYGELKHL

SEQ ID NO: 304575 - protein, 8 aa, Influenza virus
AFFRNVVW

SEQ ID NO: 304576 - protein, 8 aa, Influenza virus
FFRNVVWI

SEQ ID NO: 304577 - protein, 8 aa, Influenza virus
LLVMWGIH

SEQ ID NO: 304578 - protein, 8 aa, Influenza virus
LVMWGIHH

SEQ ID NO: 304579 - protein, 8 aa, Influenza virus
YVSIGTST

SEQ ID NO: 304580 - protein, 8 aa, Influenza virus
VSIGTSTL

SEQ ID NO: 304581 - protein, 8 aa, Influenza virus
TSTLNQKL

SEQ ID NO: 304582 - protein, 8 aa, Influenza virus
ITPEYAYK

SEQ ID NO: 304583 - protein, 8 aa, Influenza virus
TPEYAYKI

SEQ ID NO: 304584 - protein, 8 aa, Influenza virus
CQTPLGAI

SEQ ID NO: 304585 - protein, 8 aa, Influenza virus
QTPLGAIN

SEQ ID NO: 304586 - protein, 8 aa, Influenza virus
GAINSSKP

SEQ ID NO: 304587 - protein, 8 aa, Influenza virus
SSSMPFHN

SEQ ID NO: 304588 - protein, 8 aa, Influenza virus
SSMPLHNI

SEQ ID NO: 304589 - protein, 8 aa, Influenza virus
SMPLHNIH

SEQ ID NO: 304590 - protein, 8 aa, Influenza virus
LHNIHPLT

SEQ ID NO: 304591 - protein, 8 aa, Influenza virus
HNVHPLAI

SEQ ID NO: 304592 - protein, 8 aa, Influenza virus
IHPLTIGK

SEQ ID NO: 304593 - protein, 8 aa, Influenza virus
LTIGKCPK

SEQ ID NO: 304594 - protein, 8 aa, Influenza virus
KRKKRGLF

SEQ ID NO: 304595 - protein, 8 aa, Influenza virus
KTRGLFGA

SEQ ID NO: 304596 - protein, 8 aa, Influenza virus
WYGYHHIN

SEQ ID NO: 304597 - protein, 8 aa, Influenza virus
SGYAADRE

SEQ ID NO: 304598 - protein, 8 aa, Influenza virus
GYAADRES

SEQ ID NO: 304599 - protein, 8 aa, Influenza virus
YAADREST

SEQ ID NO: 304600 - protein, 8 aa, Influenza virus
AADRESTQ

SEQ ID NO: 304601 - protein, 8 aa, Influenza virus
ADKKSTQK

SEQ ID NO: 304602 - protein, 8 aa, Influenza virus
DKKSTQKA

SEQ ID NO: 304603 - protein, 8 aa, Influenza virus
KSTQKAID

SEQ ID NO: 304604 - protein, 8 aa, Influenza virus
STQKAVDG

SEQ ID NO: 304605 - protein, 8 aa, Influenza virus
NGVTNKVN

SEQ ID NO: 304606 - protein, 8 aa, Influenza virus
NKINSIID

SEQ ID NO: 304607 - protein, 8 aa, Influenza virus
KINSIIDK

SEQ ID NO: 304608 - protein, 8 aa, Influenza virus
INSIIDKM

SEQ ID NO: 304609 - protein, 8 aa, Influenza virus
SIIDKMNI

SEQ ID NO: 304610 - protein, 8 aa, Influenza virus
IIDKMNTR

SEQ ID NO: 304611 - protein, 8 aa, Influenza virus
IDKMNTRF

SEQ ID NO: 304612 - protein, 8 aa, Influenza virus
LEGRIENL

SEQ ID NO: 304613 - protein, 8 aa, Influenza virus
EGRIENLN

SEQ ID NO: 304614 - protein, 8 aa, Influenza virus
DLNKKMED

SEQ ID NO: 304615 - protein, 8 aa, Influenza virus
LNKKMEEG

SEQ ID NO: 304616 - protein, 8 aa, Influenza virus
NKKMEEGF

SEQ ID NO: 304617 - protein, 8 aa, Influenza virus
EDDFLDVW

SEQ ID NO: 304618 - protein, 8 aa, Influenza virus
DFLDVWTY

SEQ ID NO: 304619 - protein, 8 aa, Influenza virus
FLGVWTYN

SEQ ID NO: 304620 - protein, 8 aa, Influenza virus
LGVWTYNA

SEQ ID NO: 304621 - protein, 8 aa, Influenza virus
SNVKNLYN

SEQ ID NO: 304622 - protein, 8 aa, Influenza virus
NVKNLYNK

SEQ ID NO: 304623 - protein, 8 aa, Influenza virus
VKNLYNKV

SEQ ID NO: 304624 - protein, 8 aa, Influenza virus
KNLYDRVR

SEQ ID NO: 304625 - protein, 8 aa, Influenza virus
NLYDRVRL

SEQ ID NO: 304626 - protein, 8 aa, Influenza virus
LYNKVRLQ

SEQ ID NO: 304627 - protein, 8 aa, Influenza virus
YNKVRLQL

SEQ ID NO: 304628 - protein, 8 aa, Influenza virus
KVRHQLRD

SEQ ID NO: 304629 - protein, 8 aa, Influenza virus
HQLRDNAK

SEQ ID NO: 304630 - protein, 8 aa, Influenza virus
EFYHKCNN

SEQ ID NO: 304631 - protein, 8 aa, Influenza virus
CIESVRNG

SEQ ID NO: 304632 - protein, 8 aa, Influenza virus
IESVRNGT

SEQ ID NO: 304633 - protein, 8 aa, Influenza virus
TYQILSLY

SEQ ID NO: 304634 - protein, 8 aa, Influenza virus
LSIYSTVT

SEQ ID NO: 304635 - protein, 8 aa, Influenza virus
SIYSTVTS

SEQ ID NO: 304636 - protein, 8 aa, Influenza virus
IYSTVTSS

SEQ ID NO: 304637 - protein, 8 aa, Influenza virus
VSSLVLAI

SEQ ID NO: 304638 - protein, 8 aa, Influenza virus
SSLALAII

SEQ ID NO: 304639 - protein, 8 aa, Influenza virus
LAIIVAGL

SEQ ID NO: 304640 - protein, 8 aa, Influenza virus
AGLLLWMC

SEQ ID NO: 304641 - protein, 8 aa, Influenza virus
GLLLWMCS

SEQ ID NO: 304642 - protein, 8 aa, Influenza virus
LLLWMCSN

SEQ ID NO: 304643 - protein, 8 aa, Influenza virus
LLWMCSNG

SEQ ID NO: 304644 - protein, 8 aa, Influenza virus
GSLQCKIC

SEQ ID NO: 304645 - protein, 8 aa, Influenza virus
CIYFCEFR

SEQ ID NO: 304646 - protein, 8 aa, Influenza virus
SDQICVGY

SEQ ID NO: 304647 - protein, 8 aa, Influenza virus
HANNSTEH

SEQ ID NO: 304648 - protein, 8 aa, Influenza virus
ANNSTERV

SEQ ID NO: 304649 - protein, 8 aa, Influenza virus
NNSTERVD

SEQ ID NO: 304650 - protein, 8 aa, Influenza virus
NSTEHVDT

SEQ ID NO: 304651 - protein, 8 aa, Influenza virus
STERVDTI

SEQ ID NO: 304652 - protein, 8 aa, Influenza virus
TERVDTIM

SEQ ID NO: 304653 - protein, 8 aa, Influenza virus
ERVDTIME

SEQ ID NO: 304654 - protein, 8 aa, Influenza virus
DILEKEHN

SEQ ID NO: 304655 - protein, 8 aa, Influenza virus
ILEKEHNG

SEQ ID NO: 304656 - protein, 8 aa, Influenza virus
HNGRLCDL

SEQ ID NO: 304657 - protein, 8 aa, Influenza virus
LDGVRPLI

SEQ ID NO: 304658 - protein, 8 aa, Influenza virus
DGVRPLIL

SEQ ID NO: 304659 - protein, 8 aa, Influenza virus
GVRPLILR

SEQ ID NO: 304660 - protein, 8 aa, Influenza virus
VRPLILRD

SEQ ID NO: 304661 - protein, 8 aa, Influenza virus
RPLILKDC

SEQ ID NO: 304662 - protein, 8 aa, Influenza virus
WSYIVEKV

SEQ ID NO: 304663 - protein, 8 aa, Influenza virus
FSDYEELK

SEQ ID NO: 304664 - protein, 8 aa, Influenza virus
ELKHLLNR

SEQ ID NO: 304665 - protein, 8 aa, Influenza virus
LKHLLNRI

SEQ ID NO: 304666 - protein, 8 aa, Influenza virus
KHLLNRIT

SEQ ID NO: 304667 - protein, 8 aa, Influenza virus
FFRNVVWI

SEQ ID NO: 304668 - protein, 8 aa, Influenza virus
EDLLIIWG

SEQ ID NO: 304669 - protein, 8 aa, Influenza virus
LLIIWGIH

SEQ ID NO: 304670 - protein, 8 aa, Influenza virus
LIIWGIHH

SEQ ID NO: 304671 - protein, 8 aa, Influenza virus
IWGIHHPN

SEQ ID NO: 304672 - protein, 8 aa, Influenza virus
WGIHHSNN

SEQ ID NO: 304673 - protein, 8 aa, Influenza virus
TYVSIGTS

SEQ ID NO: 304674 - protein, 8 aa, Influenza virus
YVSIGTST

SEQ ID NO: 304675 - protein, 8 aa, Influenza virus
VSIGTSTL

SEQ ID NO: 304676 - protein, 8 aa, Influenza virus
RVNGQSGR

SEQ ID NO: 304677 - protein, 8 aa, Influenza virus
INFDSNGN

SEQ ID NO: 304678 - protein, 8 aa, Influenza virus
NFDSNGNF

SEQ ID NO: 304679 - protein, 8 aa, Influenza virus
TPEYAYKI

SEQ ID NO: 304680 - protein, 8 aa, Influenza virus
PEYAYKVV

SEQ ID NO: 304681 - protein, 8 aa, Influenza virus
EYAYKVVK

SEQ ID NO: 304682 - protein, 8 aa, Influenza virus
YAYIVKKG

SEQ ID NO: 304683 - protein, 8 aa, Influenza virus
AYKIIKKG

SEQ ID NO: 304684 - protein, 8 aa, Influenza virus
YKIVKTGD

SEQ ID NO: 304685 - protein, 8 aa, Influenza virus
KIIKKGDS

SEQ ID NO: 304686 - protein, 8 aa, Influenza virus
CDTKCQTP

SEQ ID NO: 304687 - protein, 8 aa, Influenza virus
CQTPLGAI

SEQ ID NO: 304688 - protein, 8 aa, Influenza virus
QTPLGAIN

SEQ ID NO: 304689 - protein, 8 aa, Influenza virus
TPLGAINS

SEQ ID NO: 304690 - protein, 8 aa, Influenza virus
PLGAINSS

SEQ ID NO: 304691 - protein, 8 aa, Influenza virus
LGAINSSM

SEQ ID NO: 304692 - protein, 8 aa, Influenza virus
CPKYVKST

SEQ ID NO: 304693 - protein, 8 aa, Influenza virus
KLILATGL

SEQ ID NO: 304694 - protein, 8 aa, Influenza virus
LATGLRNV

SEQ ID NO: 304695 - protein, 8 aa, Influenza virus
YGYHHNNE

SEQ ID NO: 304696 - protein, 8 aa, Influenza virus
GYHHNNEQ

SEQ ID NO: 304697 - protein, 8 aa, Influenza virus
YHHNNEQG

SEQ ID NO: 304698 - protein, 8 aa, Influenza virus
HHSKEQGS

SEQ ID NO: 304699 - protein, 8 aa, Influenza virus
ADRESTQK

SEQ ID NO: 304700 - protein, 8 aa, Influenza virus
DRESTQKA

SEQ ID NO: 304701 - protein, 8 aa, Influenza virus
RESTQKAI

SEQ ID NO: 304702 - protein, 8 aa, Influenza virus
ESTQKAMD

SEQ ID NO: 304703 - protein, 8 aa, Influenza virus
TQKAINGV

SEQ ID NO: 304704 - protein, 8 aa, Influenza virus
QKAINGVT

SEQ ID NO: 304705 - protein, 8 aa, Influenza virus
KAINGVTN

SEQ ID NO: 304706 - protein, 8 aa, Influenza virus
IDGITNKI

SEQ ID NO: 304707 - protein, 8 aa, Influenza virus
IQFEAVGR

SEQ ID NO: 304708 - protein, 8 aa, Influenza virus
EAIGREFN

SEQ ID NO: 304709 - protein, 8 aa, Influenza virus
EFNSLERR

SEQ ID NO: 304710 - protein, 8 aa, Influenza virus
RRIENLNR

SEQ ID NO: 304711 - protein, 8 aa, Influenza virus
NVKNLYDR

SEQ ID NO: 304712 - protein, 8 aa, Influenza virus
VKNLYDRV

SEQ ID NO: 304713 - protein, 8 aa, Influenza virus
KNLYDRVR

SEQ ID NO: 304714 - protein, 8 aa, Influenza virus
DRVRLQLR

SEQ ID NO: 304715 - protein, 8 aa, Influenza virus
EFYHKCDD

SEQ ID NO: 304716 - protein, 8 aa, Influenza virus
CIESVRNG

SEQ ID NO: 304717 - protein, 8 aa, Influenza virus
IESVRNGT

SEQ ID NO: 304718 - protein, 8 aa, Influenza virus
SVRNGTYN

SEQ ID NO: 304719 - protein, 8 aa, Influenza virus
VRNGTYNY

SEQ ID NO: 304720 - protein, 8 aa, Influenza virus
RNGTYSYP

SEQ ID NO: 304721 - protein, 8 aa, Influenza virus
NGTYDYPR

SEQ ID NO: 304722 - protein, 8 aa, Influenza virus
GTYDYPRY

SEQ ID NO: 304723 - protein, 8 aa, Influenza virus
GVYQILSI

SEQ ID NO: 304724 - protein, 8 aa, Influenza virus
STVASSLT

SEQ ID NO: 304725 - protein, 8 aa, Influenza virus
TVASSLTL

SEQ ID NO: 304726 - protein, 8 aa, Influenza virus
VASSLTLA

SEQ ID NO: 304727 - protein, 8 aa, Influenza virus
VSSLALAI

SEQ ID NO: 304728 - protein, 8 aa, Influenza virus
SSLALAII

SEQ ID NO: 304729 - protein, 8 aa, Influenza virus
LAIIVAGL

SEQ ID NO: 304730 - protein, 8 aa, Influenza virus
AGLLLWMC

SEQ ID NO: 304731 - protein, 8 aa, Influenza virus
GLLLWMCS

SEQ ID NO: 304732 - protein, 8 aa, Influenza virus
LLLWMCSN

SEQ ID NO: 304733 - protein, 8 aa, Influenza virus
GSLQCKIC

SEQ ID NO: 304734 - protein, 8 aa, Influenza virus
CIKICESR

SEQ ID NO: 304735 - protein, 8 aa, Influenza virus
ITYKNNTW

SEQ ID NO: 304736 - protein, 8 aa, Influenza virus
YENNTWGN

SEQ ID NO: 304737 - protein, 8 aa, Influenza virus
ENNTWGNQ

SEQ ID NO: 304738 - protein, 8 aa, Influenza virus
STWVSQTY

SEQ ID NO: 304739 - protein, 8 aa, Influenza virus
TWVNQTYL

SEQ ID NO: 304740 - protein, 8 aa, Influenza virus
GNSSLCSI

SEQ ID NO: 304741 - protein, 8 aa, Influenza virus
GWAIYSKD

SEQ ID NO: 304742 - protein, 8 aa, Influenza virus
WAIYSKDN

SEQ ID NO: 304743 - protein, 8 aa, Influenza virus
HSKDNNIR

SEQ ID NO: 304744 - protein, 8 aa, Influenza virus
NNIRIGSK

SEQ ID NO: 304745 - protein, 8 aa, Influenza virus
NIRIGSKG

SEQ ID NO: 304746 - protein, 8 aa, Influenza virus
GDVFIIRE

SEQ ID NO: 304747 - protein, 8 aa, Influenza virus
DVFIIREP

SEQ ID NO: 304748 - protein, 8 aa, Influenza virus
VFVTREPF

SEQ ID NO: 304749 - protein, 8 aa, Influenza virus
FIIREPFI

SEQ ID NO: 304750 - protein, 8 aa, Influenza virus
VTREPFIS

SEQ ID NO: 304751 - protein, 8 aa, Influenza virus
TREPFISC

SEQ ID NO: 304752 - protein, 8 aa, Influenza virus
PFVSCSHL

SEQ ID NO: 304753 - protein, 8 aa, Influenza virus
FISCSHSE

SEQ ID NO: 304754 - protein, 8 aa, Influenza virus
ISCSHSEC

SEQ ID NO: 304755 - protein, 8 aa, Influenza virus
CSYLECRT

SEQ ID NO: 304756 - protein, 8 aa, Influenza virus
SYLECRTF

SEQ ID NO: 304757 - protein, 8 aa, Influenza virus
YLECRTFF

SEQ ID NO: 304758 - protein, 8 aa, Influenza virus
DKHSNGTA

SEQ ID NO: 304759 - protein, 8 aa, Influenza virus
KHSNETVK

SEQ ID NO: 304760 - protein, 8 aa, Influenza virus
HSNGTVND

SEQ ID NO: 304761 - protein, 8 aa, Influenza virus
SNETVKDR

SEQ ID NO: 304762 - protein, 8 aa, Influenza virus
NETVKDRS

SEQ ID NO: 304763 - protein, 8 aa, Influenza virus
GTVNDRSP

SEQ ID NO: 304764 - protein, 8 aa, Influenza virus
VNDRSPHR

SEQ ID NO: 304765 - protein, 8 aa, Influenza virus
NDRSPHRT

SEQ ID NO: 304766 - protein, 8 aa, Influenza virus
DRSPQRTL

SEQ ID NO: 304767 - protein, 8 aa, Influenza virus
RSPQRTLM

SEQ ID NO: 304768 - protein, 8 aa, Influenza virus
SPQRTLMS

SEQ ID NO: 304769 - protein, 8 aa, Influenza virus
PQRTLMSC

SEQ ID NO: 304770 - protein, 8 aa, Influenza virus
QRTLMSCP

SEQ ID NO: 304771 - protein, 8 aa, Influenza virus
RTLMSCPI

SEQ ID NO: 304772 - protein, 8 aa, Influenza virus
TLMSCPIG

SEQ ID NO: 304773 - protein, 8 aa, Influenza virus
LMSCPVGV

SEQ ID NO: 304774 - protein, 8 aa, Influenza virus
PVGEVPSP

SEQ ID NO: 304775 - protein, 8 aa, Influenza virus
VGEVPSPY

SEQ ID NO: 304776 - protein, 8 aa, Influenza virus
SACHDGSS

SEQ ID NO: 304777 - protein, 8 aa, Influenza virus
ACHDGSSW

SEQ ID NO: 304778 - protein, 8 aa, Influenza virus
CHDGSSWL

SEQ ID NO: 304779 - protein, 8 aa, Influenza virus
HDGSSWLT

SEQ ID NO: 304780 - protein, 8 aa, Influenza virus
DGSSWLTI

SEQ ID NO: 304781 - protein, 8 aa, Influenza virus
GVSGPDNG

SEQ ID NO: 304782 - protein, 8 aa, Influenza virus
VSGPDNGA

SEQ ID NO: 304783 - protein, 8 aa, Influenza virus
DNGAVAVV

SEQ ID NO: 304784 - protein, 8 aa, Influenza virus
NGAVAVVK

SEQ ID NO: 304785 - protein, 8 aa, Influenza virus
AVAVLKYK

SEQ ID NO: 304786 - protein, 8 aa, Influenza virus
VAVLKYKG

SEQ ID NO: 304787 - protein, 8 aa, Influenza virus
KYKGIITD

SEQ ID NO: 304788 - protein, 8 aa, Influenza virus
YKGIITDT

SEQ ID NO: 304789 - protein, 8 aa, Influenza virus
KGIITDTI

SEQ ID NO: 304790 - protein, 8 aa, Influenza virus
GIITDTIR

SEQ ID NO: 304791 - protein, 8 aa, Influenza virus
IITDTIRS

SEQ ID NO: 304792 - protein, 8 aa, Influenza virus
TDTIKSWK

SEQ ID NO: 304793 - protein, 8 aa, Influenza virus
SILRTQES

SEQ ID NO: 304794 - protein, 8 aa, Influenza virus
GYCFTVMT

SEQ ID NO: 304795 - protein, 8 aa, Influenza virus
YCFTVMTD

SEQ ID NO: 304796 - protein, 8 aa, Influenza virus
CSCYPNAG

SEQ ID NO: 304797 - protein, 8 aa, Influenza virus
SCYPDAGK

SEQ ID NO: 304798 - protein, 8 aa, Influenza virus
NRPWVSFD

SEQ ID NO: 304799 - protein, 8 aa, Influenza virus
RPWVSFDQ

SEQ ID NO: 304800 - protein, 8 aa, Influenza virus
YQMGYICS

SEQ ID NO: 304801 - protein, 8 aa, Influenza virus
QTGYICSG

SEQ ID NO: 304802 - protein, 8 aa, Influenza virus
MGYICSGV

SEQ ID NO: 304803 - protein, 8 aa, Influenza virus
CSGVFGDS

SEQ ID NO: 304804 - protein, 8 aa, Influenza virus
SGVFGDSP

SEQ ID NO: 304805 - protein, 8 aa, Influenza virus
GVFGDSPR

SEQ ID NO: 304806 - protein, 8 aa, Influenza virus
VFGDSPRP

SEQ ID NO: 304807 - protein, 8 aa, Influenza virus
FGDNPRPS

SEQ ID NO: 304808 - protein, 8 aa, Influenza virus
GDNPRPSD

SEQ ID NO: 304809 - protein, 8 aa, Influenza virus
DNPRPSDG

SEQ ID NO: 304810 - protein, 8 aa, Influenza virus
PRPSDGTG

SEQ ID NO: 304811 - protein, 8 aa, Influenza virus
DGTGSCDP

SEQ ID NO: 304812 - protein, 8 aa, Influenza virus
GAHGVKGF

SEQ ID NO: 304813 - protein, 8 aa, Influenza virus
AYGVKGFA

SEQ ID NO: 304814 - protein, 8 aa, Influenza virus
HGVKGFSF

SEQ ID NO: 304815 - protein, 8 aa, Influenza virus
GVKGFSFR

SEQ ID NO: 304816 - protein, 8 aa, Influenza virus
VKGFAFKY

SEQ ID NO: 304817 - protein, 8 aa, Influenza virus
GFSFKYGD

SEQ ID NO: 304818 - protein, 8 aa, Influenza virus
FSFKYGDG

SEQ ID NO: 304819 - protein, 8 aa, Influenza virus
FKYGNGAW

SEQ ID NO: 304820 - protein, 8 aa, Influenza virus
KYGNGAWI

SEQ ID NO: 304821 - protein, 8 aa, Influenza virus
WIGRTKSA

SEQ ID NO: 304822 - protein, 8 aa, Influenza virus
TSRSGFEM

SEQ ID NO: 304823 - protein, 8 aa, Influenza virus
ITEWSGYS

SEQ ID NO: 304824 - protein, 8 aa, Influenza virus
HPELTGVD

SEQ ID NO: 304825 - protein, 8 aa, Influenza virus
PELTGVDC

SEQ ID NO: 304826 - protein, 8 aa, Influenza virus
TGLNCMRP

SEQ ID NO: 304827 - protein, 8 aa, Influenza virus
GLNCMRPC

SEQ ID NO: 304828 - protein, 8 aa, Influenza virus
LNCMRPCF

SEQ ID NO: 304829 - protein, 8 aa, Influenza virus
NCMRPCFW

SEQ ID NO: 304830 - protein, 8 aa, Influenza virus
WIELIRGR

SEQ ID NO: 304831 - protein, 8 aa, Influenza virus
IELIRGRP

SEQ ID NO: 304832 - protein, 8 aa, Influenza virus
ELIRGRPE

SEQ ID NO: 304833 - protein, 8 aa, Influenza virus
LIRGRPEE

SEQ ID NO: 304834 - protein, 8 aa, Influenza virus
TIWASGSS

SEQ ID NO: 304835 - protein, 8 aa, Influenza virus
IWASGSSI

SEQ ID NO: 304836 - protein, 8 aa, Influenza virus
IISFCGVN

SEQ ID NO: 304837 - protein, 8 aa, Influenza virus
ISFCGVSS

SEQ ID NO: 304838 - protein, 8 aa, Influenza virus
TVDWSWPD

SEQ ID NO: 304839 - protein, 8 aa, Influenza virus
SWSWPDDA

SEQ ID NO: 304840 - protein, 8 aa, Influenza virus
PDGADLPF

SEQ ID NO: 304841 - protein, 8 aa, Influenza virus
AELPFTTD

SEQ ID NO: 304842 - protein, 8 aa, Influenza virus
GDRICVGY

SEQ ID NO: 304843 - protein, 8 aa, Influenza virus
QICIGHHA

SEQ ID NO: 304844 - protein, 8 aa, Influenza virus
YHANNSKK

SEQ ID NO: 304845 - protein, 8 aa, Influenza virus
ANNSKKQI

SEQ ID NO: 304846 - protein, 8 aa, Influenza virus
NNSKKQID

SEQ ID NO: 304847 - protein, 8 aa, Influenza virus
NSKKQIDT

SEQ ID NO: 304848 - protein, 8 aa, Influenza virus
SKKQIDTI

SEQ ID NO: 304849 - protein, 8 aa, Influenza virus
EQIDTIME

SEQ ID NO: 304850 - protein, 8 aa, Influenza virus
VDTIREKN

SEQ ID NO: 304851 - protein, 8 aa, Influenza virus
DTTMEKNV

SEQ ID NO: 304852 - protein, 8 aa, Influenza virus
TTMEKNVT

SEQ ID NO: 304853 - protein, 8 aa, Influenza virus
IMEKSVTV

SEQ ID NO: 304854 - protein, 8 aa, Influenza virus
MEKIVTVT

SEQ ID NO: 304855 - protein, 8 aa, Influenza virus
KNVTVTRA

SEQ ID NO: 304856 - protein, 8 aa, Influenza virus
NVTVTHTQ

SEQ ID NO: 304857 - protein, 8 aa, Influenza virus
VTVSHAQD

SEQ ID NO: 304858 - protein, 8 aa, Influenza virus
HNGKLCDL

SEQ ID NO: 304859 - protein, 8 aa, Influenza virus
DCSAAGWL

SEQ ID NO: 304860 - protein, 8 aa, Influenza virus
AGWILGNP

SEQ ID NO: 304861 - protein, 8 aa, Influenza virus
GLVLGNPM

SEQ ID NO: 304862 - protein, 8 aa, Influenza virus
WILGNPMC

SEQ ID NO: 304863 - protein, 8 aa, Influenza virus
SYIVEKDK

SEQ ID NO: 304864 - protein, 8 aa, Influenza virus
YIVEKDKP

SEQ ID NO: 304865 - protein, 8 aa, Influenza virus
TSGVSSAC

SEQ ID NO: 304866 - protein, 8 aa, Influenza virus
AGVSSACP

SEQ ID NO: 304867 - protein, 8 aa, Influenza virus
SSFFRNIV

SEQ ID NO: 304868 - protein, 8 aa, Influenza virus
YRNVVWLI

SEQ ID NO: 304869 - protein, 8 aa, Influenza virus
SVTSTLNQ

SEQ ID NO: 304870 - protein, 8 aa, Influenza virus
GTLTLNQR

SEQ ID NO: 304871 - protein, 8 aa, Influenza virus
TPTLNQRS

SEQ ID NO: 304872 - protein, 8 aa, Influenza virus
IATRSKVN

SEQ ID NO: 304873 - protein, 8 aa, Influenza virus
ATRSKVNG

SEQ ID NO: 304874 - protein, 8 aa, Influenza virus
TRSKVNGQ

SEQ ID NO: 304875 - protein, 8 aa, Influenza virus
RSKVNGQS

SEQ ID NO: 304876 - protein, 8 aa, Influenza virus
SKVNGQSG

SEQ ID NO: 304877 - protein, 8 aa, Influenza virus
NVNGQSGR

SEQ ID NO: 304878 - protein, 8 aa, Influenza virus
VNGQSGRV

SEQ ID NO: 304879 - protein, 8 aa, Influenza virus
PEYAFKIA

SEQ ID NO: 304880 - protein, 8 aa, Influenza virus
EYAFKIAK

SEQ ID NO: 304881 - protein, 8 aa, Influenza virus
YGNCDAKC

SEQ ID NO: 304882 - protein, 8 aa, Influenza virus
GNCDAKCQ

SEQ ID NO: 304883 - protein, 8 aa, Influenza virus
NCDAKCQT

SEQ ID NO: 304884 - protein, 8 aa, Influenza virus
CDAKCQTP

SEQ ID NO: 304885 - protein, 8 aa, Influenza virus
KCQTPIGA

SEQ ID NO: 304886 - protein, 8 aa, Influenza virus
KPFHNIHP

SEQ ID NO: 304887 - protein, 8 aa, Influenza virus
PFSNIHPL

SEQ ID NO: 304888 - protein, 8 aa, Influenza virus
FHNVHPLA

SEQ ID NO: 304889 - protein, 8 aa, Influenza virus
ETKGLFGA

SEQ ID NO: 304890 - protein, 8 aa, Influenza virus
WYGYHHNN

SEQ ID NO: 304891 - protein, 8 aa, Influenza virus
NAQGSGYA

SEQ ID NO: 304892 - protein, 8 aa, Influenza virus
AQGSGYAA

SEQ ID NO: 304893 - protein, 8 aa, Influenza virus
SGYAADKA

SEQ ID NO: 304894 - protein, 8 aa, Influenza virus
GYAANKES

SEQ ID NO: 304895 - protein, 8 aa, Influenza virus
YAADKAST

SEQ ID NO: 304896 - protein, 8 aa, Influenza virus
AADKDSTQ

SEQ ID NO: 304897 - protein, 8 aa, Influenza virus
ADRKSTQK

SEQ ID NO: 304898 - protein, 8 aa, Influenza virus
DRKSTQKA

SEQ ID NO: 304899 - protein, 8 aa, Influenza virus
KESTQKAV

SEQ ID NO: 304900 - protein, 8 aa, Influenza virus
ESTQRAID

SEQ ID NO: 304901 - protein, 8 aa, Influenza virus
STQKAVDG

SEQ ID NO: 304902 - protein, 8 aa, Influenza virus
TQKAIDGV

SEQ ID NO: 304903 - protein, 8 aa, Influenza virus
QKAIDGVT

SEQ ID NO: 304904 - protein, 8 aa, Influenza virus
KAIDGVTN

SEQ ID NO: 304905 - protein, 8 aa, Influenza virus
NSIINKMN

SEQ ID NO: 304906 - protein, 8 aa, Influenza virus
EVWTYNAE

SEQ ID NO: 304907 - protein, 8 aa, Influenza virus
NAELFVLM

SEQ ID NO: 304908 - protein, 8 aa, Influenza virus
AELFVLME

SEQ ID NO: 304909 - protein, 8 aa, Influenza virus
KLYDRVRL

SEQ ID NO: 304910 - protein, 8 aa, Influenza virus
LYDKVRFQ

SEQ ID NO: 304911 - protein, 8 aa, Influenza virus
YDKVRFQL

SEQ ID NO: 304912 - protein, 8 aa, Influenza virus
VRFQLKDN

SEQ ID NO: 304913 - protein, 8 aa, Influenza virus
RIQLRDNA

SEQ ID NO: 304914 - protein, 8 aa, Influenza virus
QLRDNARE

SEQ ID NO: 304915 - protein, 8 aa, Influenza virus
DNAKEWGN

SEQ ID NO: 304916 - protein, 8 aa, Influenza virus
KEWGNGCF

SEQ ID NO: 304917 - protein, 8 aa, Influenza virus
EFYHRCDD

SEQ ID NO: 304918 - protein, 8 aa, Influenza virus
VCMESVRN

SEQ ID NO: 304919 - protein, 8 aa, Influenza virus
SVKNGTYN

SEQ ID NO: 304920 - protein, 8 aa, Influenza virus
VKNGTYNY

SEQ ID NO: 304921 - protein, 8 aa, Influenza virus
YRILSIYS

SEQ ID NO: 304922 - protein, 8 aa, Influenza virus
ILSVYSTV

SEQ ID NO: 304923 - protein, 8 aa, Influenza virus
LTIYSTVA

SEQ ID NO: 304924 - protein, 8 aa, Influenza virus
TIYSTVAS

SEQ ID NO: 304925 - protein, 8 aa, Influenza virus
VYSTVASS

SEQ ID NO: 304926 - protein, 8 aa, Influenza virus
VASSLTLA

SEQ ID NO: 304927 - protein, 8 aa, Influenza virus
ASSLTLAI

SEQ ID NO: 304928 - protein, 8 aa, Influenza virus
SSLALAII

SEQ ID NO: 304929 - protein, 8 aa, Influenza virus
LAIIIAGL

SEQ ID NO: 304930 - protein, 8 aa, Influenza virus
AIMIAGLF

SEQ ID NO: 304931 - protein, 8 aa, Influenza virus
IMIAGLFF

SEQ ID NO: 304932 - protein, 8 aa, Influenza virus
MIAGLFFW

SEQ ID NO: 304933 - protein, 8 aa, Influenza virus
IAGLFFWM

SEQ ID NO: 304934 - protein, 8 aa, Influenza virus
QKIIAIGS

SEQ ID NO: 304935 - protein, 8 aa, Influenza virus
IITVGSVS

SEQ ID NO: 304936 - protein, 8 aa, Influenza virus
ITVGSVSL

SEQ ID NO: 304937 - protein, 8 aa, Influenza virus
YRGWSKPQ

SEQ ID NO: 304938 - protein, 8 aa, Influenza virus
RSWSKPQC

SEQ ID NO: 304939 - protein, 8 aa, Influenza virus
WSKPQCKI

SEQ ID NO: 304940 - protein, 8 aa, Influenza virus
KPQCEITG

SEQ ID NO: 304941 - protein, 8 aa, Influenza virus
PQCEITGF

SEQ ID NO: 304942 - protein, 8 aa, Influenza virus
QCEITGFA

SEQ ID NO: 304943 - protein, 8 aa, Influenza virus
CEITGFAP

SEQ ID NO: 304944 - protein, 8 aa, Influenza virus
EITGFAPF

SEQ ID NO: 304945 - protein, 8 aa, Influenza virus
RLSAGGGI

SEQ ID NO: 304946 - protein, 8 aa, Influenza virus
LSAGGGIW

SEQ ID NO: 304947 - protein, 8 aa, Influenza virus
GQGTTLKD

SEQ ID NO: 304948 - protein, 8 aa, Influenza virus
HNHSNGTI

SEQ ID NO: 304949 - protein, 8 aa, Influenza virus
NGTTHDRT

SEQ ID NO: 304950 - protein, 8 aa, Influenza virus
SHRTLLMN

SEQ ID NO: 304951 - protein, 8 aa, Influenza virus
LGTKQVCV

SEQ ID NO: 304952 - protein, 8 aa, Influenza virus
SSSCYDGK

SEQ ID NO: 304953 - protein, 8 aa, Influenza virus
SSCYDGKA

SEQ ID NO: 304954 - protein, 8 aa, Influenza virus
SCYDGKAW

SEQ ID NO: 304955 - protein, 8 aa, Influenza virus
DGKAWLHI

SEQ ID NO: 304956 - protein, 8 aa, Influenza virus
GKAWLHIC

SEQ ID NO: 304957 - protein, 8 aa, Influenza virus
KAWLHICV

SEQ ID NO: 304958 - protein, 8 aa, Influenza virus
TGDDSNAT

SEQ ID NO: 304959 - protein, 8 aa, Influenza virus
GNDRNATA

SEQ ID NO: 304960 - protein, 8 aa, Influenza virus
HDKNATAS

SEQ ID NO: 304961 - protein, 8 aa, Influenza virus
NATASLIY

SEQ ID NO: 304962 - protein, 8 aa, Influenza virus
SCSQNILR

SEQ ID NO: 304963 - protein, 8 aa, Influenza virus
ESECVCVN

SEQ ID NO: 304964 - protein, 8 aa, Influenza virus
TVIMTDGS

SEQ ID NO: 304965 - protein, 8 aa, Influenza virus
TDGSASRR

SEQ ID NO: 304966 - protein, 8 aa, Influenza virus
DGSATGKA

SEQ ID NO: 304967 - protein, 8 aa, Influenza virus
SPLSGNAQ

SEQ ID NO: 304968 - protein, 8 aa, Influenza virus
PLSGGAQH

SEQ ID NO: 304969 - protein, 8 aa, Influenza virus
PLGSAQAT

SEQ ID NO: 304970 - protein, 8 aa, Influenza virus
SGSAQHIQ

SEQ ID NO: 304971 - protein, 8 aa, Influenza virus
EECSCYPK

SEQ ID NO: 304972 - protein, 8 aa, Influenza virus
VTCVCRDN

SEQ ID NO: 304973 - protein, 8 aa, Influenza virus
WKSSNRPV

SEQ ID NO: 304974 - protein, 8 aa, Influenza virus
SHYVCSGL

SEQ ID NO: 304975 - protein, 8 aa, Influenza virus
HYVCSGLV

SEQ ID NO: 304976 - protein, 8 aa, Influenza virus
DTPRNDDI

SEQ ID NO: 304977 - protein, 8 aa, Influenza virus
SSSNCKDP

SEQ ID NO: 304978 - protein, 8 aa, Influenza virus
SSNCKDPN

SEQ ID NO: 304979 - protein, 8 aa, Influenza virus
CRDPNNEK

SEQ ID NO: 304980 - protein, 8 aa, Influenza virus
RDPNNEKG

SEQ ID NO: 304981 - protein, 8 aa, Influenza virus
GSPGVKGW

SEQ ID NO: 304982 - protein, 8 aa, Influenza virus
SPGVKGWA

SEQ ID NO: 304983 - protein, 8 aa, Influenza virus
VKGWAFDI

SEQ ID NO: 304984 - protein, 8 aa, Influenza virus
DDIWMGRT

SEQ ID NO: 304985 - protein, 8 aa, Influenza virus
VWLGRTIS

SEQ ID NO: 304986 - protein, 8 aa, Influenza virus
WMGRTISE

SEQ ID NO: 304987 - protein, 8 aa, Influenza virus
GRTISRDS

SEQ ID NO: 304988 - protein, 8 aa, Influenza virus
RTISRDSR

SEQ ID NO: 304989 - protein, 8 aa, Influenza virus
SKDSRLGY

SEQ ID NO: 304990 - protein, 8 aa, Influenza virus
GYETFRVL

SEQ ID NO: 304991 - protein, 8 aa, Influenza virus
KNWSGYSG

SEQ ID NO: 304992 - protein, 8 aa, Influenza virus
NCINRCFY

SEQ ID NO: 304993 - protein, 8 aa, Influenza virus
GADINFMP

SEQ ID NO: 304994 - protein, 8 aa, Influenza virus
SKSDKICI

SEQ ID NO: 304995 - protein, 8 aa, Influenza virus
NNSTTQID

SEQ ID NO: 304996 - protein, 8 aa, Influenza virus
NSTTQIDT

SEQ ID NO: 304997 - protein, 8 aa, Influenza virus
STTQVNTI

SEQ ID NO: 304998 - protein, 8 aa, Influenza virus
TQVNTILE

SEQ ID NO: 304999 - protein, 8 aa, Influenza virus
VNTILEKN

SEQ ID NO: 305000 - protein, 8 aa, Influenza virus
DTILEKNI

SEQ ID NO: 305001 - protein, 8 aa, Influenza virus
TILEKNIT

SEQ ID NO: 305002 - protein, 8 aa, Influenza virus
ILEKNITV

SEQ ID NO: 305003 - protein, 8 aa, Influenza virus
HSIELLES

SEQ ID NO: 305004 - protein, 8 aa, Influenza virus
ILGNPKCD

SEQ ID NO: 305005 - protein, 8 aa, Influenza virus
QRWSYIVE

SEQ ID NO: 305006 - protein, 8 aa, Influenza virus
SWSCIVER

SEQ ID NO: 305007 - protein, 8 aa, Influenza virus
AKNGICYP

SEQ ID NO: 305008 - protein, 8 aa, Influenza virus
KNGICYPG

SEQ ID NO: 305009 - protein, 8 aa, Influenza virus
GICYPGIL

SEQ ID NO: 305010 - protein, 8 aa, Influenza virus
IERFEMFP

SEQ ID NO: 305011 - protein, 8 aa, Influenza virus
ERFEMFPQ

SEQ ID NO: 305012 - protein, 8 aa, Influenza virus
SILYFWGV

SEQ ID NO: 305013 - protein, 8 aa, Influenza virus
YVRLGTES

SEQ ID NO: 305014 - protein, 8 aa, Influenza virus
SQRGRIDY

SEQ ID NO: 305015 - protein, 8 aa, Influenza virus
RSRIDYYW

SEQ ID NO: 305016 - protein, 8 aa, Influenza virus
ARIDYYWS

SEQ ID NO: 305017 - protein, 8 aa, Influenza virus
RIDYYWSM

SEQ ID NO: 305018 - protein, 8 aa, Influenza virus
IDYYWSML

SEQ ID NO: 305019 - protein, 8 aa, Influenza virus
WSVLNPGE

SEQ ID NO: 305020 - protein, 8 aa, Influenza virus
SVLNPGET

SEQ ID NO: 305021 - protein, 8 aa, Influenza virus
VLNPGETL

SEQ ID NO: 305022 - protein, 8 aa, Influenza virus
KPGETLNI

SEQ ID NO: 305023 - protein, 8 aa, Influenza virus
IAPWYAFR

SEQ ID NO: 305024 - protein, 8 aa, Influenza virus
KTNKTFQN

SEQ ID NO: 305025 - protein, 8 aa, Influenza virus
TNKTFQNA

SEQ ID NO: 305026 - protein, 8 aa, Influenza virus
TFQNVSPI

SEQ ID NO: 305027 - protein, 8 aa, Influenza virus
FQNVSPIW

SEQ ID NO: 305028 - protein, 8 aa, Influenza virus
QNVSPIWI

SEQ ID NO: 305029 - protein, 8 aa, Influenza virus
NVSPIWIG

SEQ ID NO: 305030 - protein, 8 aa, Influenza virus
WVGECPKY

SEQ ID NO: 305031 - protein, 8 aa, Influenza virus
VGECPKYV

SEQ ID NO: 305032 - protein, 8 aa, Influenza virus
GGCPKYVK

SEQ ID NO: 305033 - protein, 8 aa, Influenza virus
GCPKYVKS

SEQ ID NO: 305034 - protein, 8 aa, Influenza virus
ARGLFGAI

SEQ ID NO: 305035 - protein, 8 aa, Influenza virus
ADKESTQR

SEQ ID NO: 305036 - protein, 8 aa, Influenza virus
DKESTQRA

SEQ ID NO: 305037 - protein, 8 aa, Influenza virus
ESTQKAVD

SEQ ID NO: 305038 - protein, 8 aa, Influenza virus
ITNKANSI

SEQ ID NO: 305039 - protein, 8 aa, Influenza virus
TNKANSII

SEQ ID NO: 305040 - protein, 8 aa, Influenza virus
NSIIDKVN

SEQ ID NO: 305041 - protein, 8 aa, Influenza virus
SIIDKVNT

SEQ ID NO: 305042 - protein, 8 aa, Influenza virus
IIDKVNTQ

SEQ ID NO: 305043 - protein, 8 aa, Influenza virus
IDKVNTQF

SEQ ID NO: 305044 - protein, 8 aa, Influenza virus
DKVNTQFE

SEQ ID NO: 305045 - protein, 8 aa, Influenza virus
KMNAQFEA

SEQ ID NO: 305046 - protein, 8 aa, Influenza virus
SLNKRMED

SEQ ID NO: 305047 - protein, 8 aa, Influenza virus
LNKRMENG

SEQ ID NO: 305048 - protein, 8 aa, Influenza virus
NKRMENGF

SEQ ID NO: 305049 - protein, 8 aa, Influenza virus
KRMENGFL

SEQ ID NO: 305050 - protein, 8 aa, Influenza virus
NGFLDVWT

SEQ ID NO: 305051 - protein, 8 aa, Influenza virus
GLLDVWTY

SEQ ID NO: 305052 - protein, 8 aa, Influenza virus
LLDVWTYN

SEQ ID NO: 305053 - protein, 8 aa, Influenza virus
LVLLEDER

SEQ ID NO: 305054 - protein, 8 aa, Influenza virus
VLLEDERT

SEQ ID NO: 305055 - protein, 8 aa, Influenza virus
ENERTLDQ

SEQ ID NO: 305056 - protein, 8 aa, Influenza virus
NERTLDQH

SEQ ID NO: 305057 - protein, 8 aa, Influenza virus
DMHDVNVK

SEQ ID NO: 305058 - protein, 8 aa, Influenza virus
HDVNVKNL

SEQ ID NO: 305059 - protein, 8 aa, Influenza virus
VKSLLRDN

SEQ ID NO: 305060 - protein, 8 aa, Influenza virus
KSLLRDNA

SEQ ID NO: 305061 - protein, 8 aa, Influenza virus
SLLRDNAK

SEQ ID NO: 305062 - protein, 8 aa, Influenza virus
LLRDNAKD

SEQ ID NO: 305063 - protein, 8 aa, Influenza virus
LKDNANDL

SEQ ID NO: 305064 - protein, 8 aa, Influenza virus
KDNANDLG

SEQ ID NO: 305065 - protein, 8 aa, Influenza virus
FWHKCNNE

SEQ ID NO: 305066 - protein, 8 aa, Influenza virus
WHKCNNEC

SEQ ID NO: 305067 - protein, 8 aa, Influenza virus
SIKNGTYD

SEQ ID NO: 305068 - protein, 8 aa, Influenza virus
VKNGTYKY

SEQ ID NO: 305069 - protein, 8 aa, Influenza virus
KNGTYKYP

SEQ ID NO: 305070 - protein, 8 aa, Influenza virus
IGVYQILA

SEQ ID NO: 305071 - protein, 8 aa, Influenza virus
MCQNGSMQ

SEQ ID NO: 305072 - protein, 8 aa, Influenza virus
SNSSMQCR

SEQ ID NO: 305073 - protein, 8 aa, Influenza virus
NSSMQCRI

SEQ ID NO: 305074 - protein, 8 aa, Influenza virus
SSMQCRIC

SEQ ID NO: 305075 - protein, 8 aa, Influenza virus
SMQCRVCI

SEQ ID NO: 305076 - protein, 8 aa, Influenza virus
RGYKMNTK

SEQ ID NO: 305077 - protein, 8 aa, Influenza virus
GYKMNIQI

SEQ ID NO: 305078 - protein, 8 aa, Influenza virus
YKMNIQIL

SEQ ID NO: 305079 - protein, 8 aa, Influenza virus
NGTKINTL

SEQ ID NO: 305080 - protein, 8 aa, Influenza virus
GTKINTLT

SEQ ID NO: 305081 - protein, 8 aa, Influenza virus
THTERGVE

SEQ ID NO: 305082 - protein, 8 aa, Influenza virus
LTGRGIEV

SEQ ID NO: 305083 - protein, 8 aa, Influenza virus
ERGVEVVD

SEQ ID NO: 305084 - protein, 8 aa, Influenza virus
RGVEVVDA

SEQ ID NO: 305085 - protein, 8 aa, Influenza virus
DATETVER

SEQ ID NO: 305086 - protein, 8 aa, Influenza virus
GPPQCDKF

SEQ ID NO: 305087 - protein, 8 aa, Influenza virus
PPQCDKFL

SEQ ID NO: 305088 - protein, 8 aa, Influenza virus
PQCDKFLE

SEQ ID NO: 305089 - protein, 8 aa, Influenza virus
QCDKFLEF

SEQ ID NO: 305090 - protein, 8 aa, Influenza virus
DICYPGRF

SEQ ID NO: 305091 - protein, 8 aa, Influenza virus
GPSFYAEM

SEQ ID NO: 305092 - protein, 8 aa, Influenza virus
ALIVWGVH

SEQ ID NO: 305093 - protein, 8 aa, Influenza virus
LIVWGVHH

SEQ ID NO: 305094 - protein, 8 aa, Influenza virus
VNGQFGRI

SEQ ID NO: 305095 - protein, 8 aa, Influenza virus
DGQSGRID

SEQ ID NO: 305096 - protein, 8 aa, Influenza virus
QSGRINFH

SEQ ID NO: 305097 - protein, 8 aa, Influenza virus
SGRINFHW

SEQ ID NO: 305098 - protein, 8 aa, Influenza virus
GRINFHWL

SEQ ID NO: 305099 - protein, 8 aa, Influenza virus
NFSFNGAF

SEQ ID NO: 305100 - protein, 8 aa, Influenza virus
FNFNGAFI

SEQ ID NO: 305101 - protein, 8 aa, Influenza virus
NFNGAFIA

SEQ ID NO: 305102 - protein, 8 aa, Influenza virus
AFVAPDRV

SEQ ID NO: 305103 - protein, 8 aa, Influenza virus
FVAPDRVS

SEQ ID NO: 305104 - protein, 8 aa, Influenza virus
VAPDRVSF

SEQ ID NO: 305105 - protein, 8 aa, Influenza virus
LPFQSINS

SEQ ID NO: 305106 - protein, 8 aa, Influenza virus
VGKCPKYV

SEQ ID NO: 305107 - protein, 8 aa, Influenza virus
GKCPKYVK

SEQ ID NO: 305108 - protein, 8 aa, Influenza virus
KCPKYVKQ

SEQ ID NO: 305109 - protein, 8 aa, Influenza virus
QMTRGLFG

SEQ ID NO: 305110 - protein, 8 aa, Influenza virus
LIDGWYGY

SEQ ID NO: 305111 - protein, 8 aa, Influenza virus
IDGWYGYR

SEQ ID NO: 305112 - protein, 8 aa, Influenza virus
DGWYGFKH

SEQ ID NO: 305113 - protein, 8 aa, Influenza virus
YGFKHQNA

SEQ ID NO: 305114 - protein, 8 aa, Influenza virus
GFKHQNAQ

SEQ ID NO: 305115 - protein, 8 aa, Influenza virus
FKHQNAQG

SEQ ID NO: 305116 - protein, 8 aa, Influenza virus
TQSAVDQI

SEQ ID NO: 305117 - protein, 8 aa, Influenza virus
QSAVDQIT

SEQ ID NO: 305118 - protein, 8 aa, Influenza virus
SAVDQITG

SEQ ID NO: 305119 - protein, 8 aa, Influenza virus
AVDQITGK

SEQ ID NO: 305120 - protein, 8 aa, Influenza virus
VDQITGKL

SEQ ID NO: 305121 - protein, 8 aa, Influenza virus
ITGKLNHL

SEQ ID NO: 305122 - protein, 8 aa, Influenza virus
ISKTNQQF

SEQ ID NO: 305123 - protein, 8 aa, Influenza virus
RTNQQFEL

SEQ ID NO: 305124 - protein, 8 aa, Influenza virus
TNQQFGLI

SEQ ID NO: 305125 - protein, 8 aa, Influenza virus
EIEKQIGN

SEQ ID NO: 305126 - protein, 8 aa, Influenza virus
EKQLGNVI

SEQ ID NO: 305127 - protein, 8 aa, Influenza virus
KQLGNVIN

SEQ ID NO: 305128 - protein, 8 aa, Influenza virus
TELWSYNA

SEQ ID NO: 305129 - protein, 8 aa, Influenza virus
EMWSYNAE

SEQ ID NO: 305130 - protein, 8 aa, Influenza virus
AELLVALE

SEQ ID NO: 305131 - protein, 8 aa, Influenza virus
ELLVALEN

SEQ ID NO: 305132 - protein, 8 aa, Influenza virus
LLVALENQ

SEQ ID NO: 305133 - protein, 8 aa, Influenza virus
LVALENQH

SEQ ID NO: 305134 - protein, 8 aa, Influenza virus
VALENQHT

SEQ ID NO: 305135 - protein, 8 aa, Influenza virus
DSEMNSCF

SEQ ID NO: 305136 - protein, 8 aa, Influenza virus
SEMNSCFE

SEQ ID NO: 305137 - protein, 8 aa, Influenza virus
EMDKLYER

SEQ ID NO: 305138 - protein, 8 aa, Influenza virus
MDKLYERV

SEQ ID NO: 305139 - protein, 8 aa, Influenza virus
KLYERVRR

SEQ ID NO: 305140 - protein, 8 aa, Influenza virus
VKRQLREN

SEQ ID NO: 305141 - protein, 8 aa, Influenza virus
KRQLRENA

SEQ ID NO: 305142 - protein, 8 aa, Influenza virus
YRKEAIQN

SEQ ID NO: 305143 - protein, 8 aa, Influenza virus
RKEAIQNR

SEQ ID NO: 305144 - protein, 8 aa, Influenza virus
VKLSNGYK

SEQ ID NO: 305145 - protein, 8 aa, Influenza virus
KLSNGYKD

SEQ ID NO: 305146 - protein, 8 aa, Influenza virus
SGGYKDII

SEQ ID NO: 305147 - protein, 8 aa, Influenza virus
GGYKDIIL

SEQ ID NO: 305148 - protein, 8 aa, Influenza virus
FGASCLIL

SEQ ID NO: 305149 - protein, 8 aa, Influenza virus
GASCFLFL

SEQ ID NO: 305150 - protein, 8 aa, Influenza virus
ASCFLFLA

SEQ ID NO: 305151 - protein, 8 aa, Influenza virus
FICVRNGN

SEQ ID NO: 305152 - protein, 8 aa, Influenza virus
ICVRNGNM

SEQ ID NO: 305153 - protein, 8 aa, Influenza virus
CVRNGNMR

SEQ ID NO: 305154 - protein, 8 aa, Influenza virus
GTKGDKIC

SEQ ID NO: 305155 - protein, 8 aa, Influenza virus
TKGDKICL

SEQ ID NO: 305156 - protein, 8 aa, Influenza virus
ATETVETV

SEQ ID NO: 305157 - protein, 8 aa, Influenza virus
QCGLLGIL

SEQ ID NO: 305158 - protein, 8 aa, Influenza virus
CGLLGILI

SEQ ID NO: 305159 - protein, 8 aa, Influenza virus
GLLGILIG

SEQ ID NO: 305160 - protein, 8 aa, Influenza virus
LLGILIGP

SEQ ID NO: 305161 - protein, 8 aa, Influenza virus
LGILIGPP

SEQ ID NO: 305162 - protein, 8 aa, Influenza virus
VTGPPQCD

SEQ ID NO: 305163 - protein, 8 aa, Influenza virus
IGPPHCDQ

SEQ ID NO: 305164 - protein, 8 aa, Influenza virus
CDKFLEFS

SEQ ID NO: 305165 - protein, 8 aa, Influenza virus
IIERREGA

SEQ ID NO: 305166 - protein, 8 aa, Influenza virus
IERKEGTD

SEQ ID NO: 305167 - protein, 8 aa, Influenza virus
EGADVCYP

SEQ ID NO: 305168 - protein, 8 aa, Influenza virus
GADVCYPG

SEQ ID NO: 305169 - protein, 8 aa, Influenza virus
DVCYPGGF

SEQ ID NO: 305170 - protein, 8 aa, Influenza virus
CYPGKFAN

SEQ ID NO: 305171 - protein, 8 aa, Influenza virus
YPGKFVNG

SEQ ID NO: 305172 - protein, 8 aa, Influenza virus
PGKFVNGE

SEQ ID NO: 305173 - protein, 8 aa, Influenza virus
FTNEEPLR

SEQ ID NO: 305174 - protein, 8 aa, Influenza virus
ANEESLRQ

SEQ ID NO: 305175 - protein, 8 aa, Influenza virus
NEEPLRQI

SEQ ID NO: 305176 - protein, 8 aa, Influenza virus
EESLRQVL

SEQ ID NO: 305177 - protein, 8 aa, Influenza virus
ESLRQIIR

SEQ ID NO: 305178 - protein, 8 aa, Influenza virus
LRQILRKS

SEQ ID NO: 305179 - protein, 8 aa, Influenza virus
RQILRKSG

SEQ ID NO: 305180 - protein, 8 aa, Influenza virus
QILRKSGG

SEQ ID NO: 305181 - protein, 8 aa, Influenza virus
ILRKSGGI

SEQ ID NO: 305182 - protein, 8 aa, Influenza virus
RESGGIDK

SEQ ID NO: 305183 - protein, 8 aa, Influenza virus
ESGGIDKE

SEQ ID NO: 305184 - protein, 8 aa, Influenza virus
GFIYSGIR

SEQ ID NO: 305185 - protein, 8 aa, Influenza virus
SGIRTNGV

SEQ ID NO: 305186 - protein, 8 aa, Influenza virus
GIRTNGVT

SEQ ID NO: 305187 - protein, 8 aa, Influenza virus
IRTNGVTS

SEQ ID NO: 305188 - protein, 8 aa, Influenza virus
RLGPSFYA

SEQ ID NO: 305189 - protein, 8 aa, Influenza virus
LGPSFYAE

SEQ ID NO: 305190 - protein, 8 aa, Influenza virus
MKWLLSST

SEQ ID NO: 305191 - protein, 8 aa, Influenza virus
KWLLSSTD

SEQ ID NO: 305192 - protein, 8 aa, Influenza virus
WLLSSTDN

SEQ ID NO: 305193 - protein, 8 aa, Influenza virus
ALIVWGVH

SEQ ID NO: 305194 - protein, 8 aa, Influenza virus
LIVWGVHH

SEQ ID NO: 305195 - protein, 8 aa, Influenza virus
IVWGVHHS

SEQ ID NO: 305196 - protein, 8 aa, Influenza virus
DEQTKLYG

SEQ ID NO: 305197 - protein, 8 aa, Influenza virus
YGNGNKLI

SEQ ID NO: 305198 - protein, 8 aa, Influenza virus
SSKYQQAF

SEQ ID NO: 305199 - protein, 8 aa, Influenza virus
TGARRIDF

SEQ ID NO: 305200 - protein, 8 aa, Influenza virus
GARRIDFN

SEQ ID NO: 305201 - protein, 8 aa, Influenza virus
ARRIDFNW

SEQ ID NO: 305202 - protein, 8 aa, Influenza virus
RIDFNWLL

SEQ ID NO: 305203 - protein, 8 aa, Influenza virus
IDFNWLLL

SEQ ID NO: 305204 - protein, 8 aa, Influenza virus
NDTITFSF

SEQ ID NO: 305205 - protein, 8 aa, Influenza virus
DTVTFNFN

SEQ ID NO: 305206 - protein, 8 aa, Influenza virus
TVTFNFNG

SEQ ID NO: 305207 - protein, 8 aa, Influenza virus
PDRASFFK

SEQ ID NO: 305208 - protein, 8 aa, Influenza virus
DRASFFKG

SEQ ID NO: 305209 - protein, 8 aa, Influenza virus
RASFFRGA

SEQ ID NO: 305210 - protein, 8 aa, Influenza virus
CFHGGGTI

SEQ ID NO: 305211 - protein, 8 aa, Influenza virus
GGTIASNL

SEQ ID NO: 305212 - protein, 8 aa, Influenza virus
ISSLPFQN

SEQ ID NO: 305213 - protein, 8 aa, Influenza virus
PFQNISPR

SEQ ID NO: 305214 - protein, 8 aa, Influenza virus
FQNISPRT

SEQ ID NO: 305215 - protein, 8 aa, Influenza virus
KTVGKCPR

SEQ ID NO: 305216 - protein, 8 aa, Influenza virus
AVGKCPKY

SEQ ID NO: 305217 - protein, 8 aa, Influenza virus
VGKCPRYI

SEQ ID NO: 305218 - protein, 8 aa, Influenza virus
GKCPRYIK

SEQ ID NO: 305219 - protein, 8 aa, Influenza virus
KCPRYIKQ

SEQ ID NO: 305220 - protein, 8 aa, Influenza virus
CPKYVKQE

SEQ ID NO: 305221 - protein, 8 aa, Influenza virus
PRYIKQKS

SEQ ID NO: 305222 - protein, 8 aa, Influenza virus
VKQESLML

SEQ ID NO: 305223 - protein, 8 aa, Influenza virus
KQESLMLA

SEQ ID NO: 305224 - protein, 8 aa, Influenza virus
QESLMLAT

SEQ ID NO: 305225 - protein, 8 aa, Influenza virus
ESLMLATG

SEQ ID NO: 305226 - protein, 8 aa, Influenza virus
GMRNIPEN

SEQ ID NO: 305227 - protein, 8 aa, Influenza virus
MRNIPENP

SEQ ID NO: 305228 - protein, 8 aa, Influenza virus
RNIPENPK

SEQ ID NO: 305229 - protein, 8 aa, Influenza virus
PKGRGLFG

SEQ ID NO: 305230 - protein, 8 aa, Influenza virus
KGRGLFGA

SEQ ID NO: 305231 - protein, 8 aa, Influenza virus
GRGLFGAI

SEQ ID NO: 305232 - protein, 8 aa, Influenza virus
GKLNRLIE

SEQ ID NO: 305233 - protein, 8 aa, Influenza virus
KLNRLIEK

SEQ ID NO: 305234 - protein, 8 aa, Influenza virus
LNRLIEKT

SEQ ID NO: 305235 - protein, 8 aa, Influenza virus
NRLISKTN

SEQ ID NO: 305236 - protein, 8 aa, Influenza virus
RLIEKTNQ

SEQ ID NO: 305237 - protein, 8 aa, Influenza virus
LISKTNQQ

SEQ ID NO: 305238 - protein, 8 aa, Influenza virus
IEKTNQQF

SEQ ID NO: 305239 - protein, 8 aa, Influenza virus
EKTNQQFE

SEQ ID NO: 305240 - protein, 8 aa, Influenza virus
QQFGLIDN

SEQ ID NO: 305241 - protein, 8 aa, Influenza virus
QFELIDSE

SEQ ID NO: 305242 - protein, 8 aa, Influenza virus
ELIDNEFS

SEQ ID NO: 305243 - protein, 8 aa, Influenza virus
LIDNEFSE

SEQ ID NO: 305244 - protein, 8 aa, Influenza virus
NEFSEIEQ

SEQ ID NO: 305245 - protein, 8 aa, Influenza virus
EFSEIEQQ

SEQ ID NO: 305246 - protein, 8 aa, Influenza virus
FSEIEQQI

SEQ ID NO: 305247 - protein, 8 aa, Influenza virus
SEIEQQIG

SEQ ID NO: 305248 - protein, 8 aa, Influenza virus
INWTRDSI

SEQ ID NO: 305249 - protein, 8 aa, Influenza virus
NWTRDSIT

SEQ ID NO: 305250 - protein, 8 aa, Influenza virus
WTRDSITE

SEQ ID NO: 305251 - protein, 8 aa, Influenza virus
TRDAMTEV

SEQ ID NO: 305252 - protein, 8 aa, Influenza virus
RDAMTEVW

SEQ ID NO: 305253 - protein, 8 aa, Influenza virus
DSITEVWS

SEQ ID NO: 305254 - protein, 8 aa, Influenza virus
SITEVWSY

SEQ ID NO: 305255 - protein, 8 aa, Influenza virus
DLADSEMK

SEQ ID NO: 305256 - protein, 8 aa, Influenza virus
LTDSEMNK

SEQ ID NO: 305257 - protein, 8 aa, Influenza virus
TDSEMNKL

SEQ ID NO: 305258 - protein, 8 aa, Influenza virus
NKLYERVK

SEQ ID NO: 305259 - protein, 8 aa, Influenza virus
KLYERVKR

SEQ ID NO: 305260 - protein, 8 aa, Influenza virus
LYERVKRQ

SEQ ID NO: 305261 - protein, 8 aa, Influenza virus
YERVKRQL

SEQ ID NO: 305262 - protein, 8 aa, Influenza virus
ERVKRQLR

SEQ ID NO: 305263 - protein, 8 aa, Influenza virus
RVKRQLRE

SEQ ID NO: 305264 - protein, 8 aa, Influenza virus
VKRQLREN

SEQ ID NO: 305265 - protein, 8 aa, Influenza virus
KRQLRENA

SEQ ID NO: 305266 - protein, 8 aa, Influenza virus
IFHKCDNQ

SEQ ID NO: 305267 - protein, 8 aa, Influenza virus
FHKCDNQC

SEQ ID NO: 305268 - protein, 8 aa, Influenza virus
HKCDNQCM

SEQ ID NO: 305269 - protein, 8 aa, Influenza virus
KCDNQCME

SEQ ID NO: 305270 - protein, 8 aa, Influenza virus
CDNQCMES

SEQ ID NO: 305271 - protein, 8 aa, Influenza virus
DNQCMESI

SEQ ID NO: 305272 - protein, 8 aa, Influenza virus
NQCMESIR

SEQ ID NO: 305273 - protein, 8 aa, Influenza virus
NNTYDHTK

SEQ ID NO: 305274 - protein, 8 aa, Influenza virus
NTYNHTQY

SEQ ID NO: 305275 - protein, 8 aa, Influenza virus
TYDHTKYR

SEQ ID NO: 305276 - protein, 8 aa, Influenza virus
YNHTQYRT

SEQ ID NO: 305277 - protein, 8 aa, Influenza virus
HSRYREEA

SEQ ID NO: 305278 - protein, 8 aa, Influenza virus
SRYREEAM

SEQ ID NO: 305279 - protein, 8 aa, Influenza virus
RYREEAMQ

SEQ ID NO: 305280 - protein, 8 aa, Influenza virus
IDPVKLSG

SEQ ID NO: 305281 - protein, 8 aa, Influenza virus
DPVKLSGG

SEQ ID NO: 305282 - protein, 8 aa, Influenza virus
PVKLSGGY

SEQ ID NO: 305283 - protein, 8 aa, Influenza virus
CFLLLAVV

SEQ ID NO: 305284 - protein, 8 aa, Influenza virus
LLAIAIGL

SEQ ID NO: 305285 - protein, 8 aa, Influenza virus
IAIAMGLV

SEQ ID NO: 305286 - protein, 8 aa, Influenza virus
AIAMGFVF

SEQ ID NO: 305287 - protein, 8 aa, Influenza virus
VVMGLVFI

SEQ ID NO: 305288 - protein, 8 aa, Influenza virus
MGLVFICM

SEQ ID NO: 305289 - protein, 8 aa, Influenza virus
ICMKNGNM

SEQ ID NO: 305290 - protein, 8 aa, Influenza virus
CIKNGNVR

SEQ ID NO: 305291 - protein, 8 aa, Influenza virus
IKNGNVRC

SEQ ID NO: 305292 - protein, 8 aa, Influenza virus
SVSLIIAT

SEQ ID NO: 305293 - protein, 8 aa, Influenza virus
TICFLMQI

SEQ ID NO: 305294 - protein, 8 aa, Influenza virus
ACFLMQIA

SEQ ID NO: 305295 - protein, 8 aa, Influenza virus
CFFMQIAI

SEQ ID NO: 305296 - protein, 8 aa, Influenza virus
FFMQIAIL

SEQ ID NO: 305297 - protein, 8 aa, Influenza virus
ERNVTETL

SEQ ID NO: 305298 - protein, 8 aa, Influenza virus
KNITKIVY

SEQ ID NO: 305299 - protein, 8 aa, Influenza virus
TEIVYLNS

SEQ ID NO: 305300 - protein, 8 aa, Influenza virus
EIVYLNHT

SEQ ID NO: 305301 - protein, 8 aa, Influenza virus
YRIWSKPQ

SEQ ID NO: 305302 - protein, 8 aa, Influenza virus
RIWSKPQC

SEQ ID NO: 305303 - protein, 8 aa, Influenza virus
IWSKPQCQ

SEQ ID NO: 305304 - protein, 8 aa, Influenza virus
SKPQCRIT

SEQ ID NO: 305305 - protein, 8 aa, Influenza virus
KQQCQITG

SEQ ID NO: 305306 - protein, 8 aa, Influenza virus
QCQIKGFA

SEQ ID NO: 305307 - protein, 8 aa, Influenza virus
CQIAGFAP

SEQ ID NO: 305308 - protein, 8 aa, Influenza virus
VRLSAGGD

SEQ ID NO: 305309 - protein, 8 aa, Influenza virus
RLSASGDI

SEQ ID NO: 305310 - protein, 8 aa, Influenza virus
LSAGGNIW

SEQ ID NO: 305311 - protein, 8 aa, Influenza virus
SAGGNIWI

SEQ ID NO: 305312 - protein, 8 aa, Influenza virus
ASGDIWIT

SEQ ID NO: 305313 - protein, 8 aa, Influenza virus
GGNIWITR

SEQ ID NO: 305314 - protein, 8 aa, Influenza virus
GNIWITRE

SEQ ID NO: 305315 - protein, 8 aa, Influenza virus
NIWITREP

SEQ ID NO: 305316 - protein, 8 aa, Influenza virus
EPYVSCSP

SEQ ID NO: 305317 - protein, 8 aa, Influenza virus
DKCYQFAL

SEQ ID NO: 305318 - protein, 8 aa, Influenza virus
LGQGTTLN

SEQ ID NO: 305319 - protein, 8 aa, Influenza virus
GQGTTLNN

SEQ ID NO: 305320 - protein, 8 aa, Influenza virus
QGTTLENK

SEQ ID NO: 305321 - protein, 8 aa, Influenza virus
GTTLENKH

SEQ ID NO: 305322 - protein, 8 aa, Influenza virus
TTLENKHS

SEQ ID NO: 305323 - protein, 8 aa, Influenza virus
TLENKHSN

SEQ ID NO: 305324 - protein, 8 aa, Influenza virus
LENKHSNG

SEQ ID NO: 305325 - protein, 8 aa, Influenza virus
ENKHSNGT

SEQ ID NO: 305326 - protein, 8 aa, Influenza virus
NGTTHDRT

SEQ ID NO: 305327 - protein, 8 aa, Influenza virus
HDRISHRT

SEQ ID NO: 305328 - protein, 8 aa, Influenza virus
DRISHRTL

SEQ ID NO: 305329 - protein, 8 aa, Influenza virus
RISHRTLL

SEQ ID NO: 305330 - protein, 8 aa, Influenza virus
ISHRTLLM

SEQ ID NO: 305331 - protein, 8 aa, Influenza virus
VCITGDDR

SEQ ID NO: 305332 - protein, 8 aa, Influenza virus
TASFIYNE

SEQ ID NO: 305333 - protein, 8 aa, Influenza virus
VCINGTCA

SEQ ID NO: 305334 - protein, 8 aa, Influenza virus
CINGTCAV

SEQ ID NO: 305335 - protein, 8 aa, Influenza virus
INGTCAVV

SEQ ID NO: 305336 - protein, 8 aa, Influenza virus
NGTCAVVM

SEQ ID NO: 305337 - protein, 8 aa, Influenza virus
GSCAVVMT

SEQ ID NO: 305338 - protein, 8 aa, Influenza virus
SCAVVMTD

SEQ ID NO: 305339 - protein, 8 aa, Influenza virus
TDGSASRK

SEQ ID NO: 305340 - protein, 8 aa, Influenza virus
DGSASRKA

SEQ ID NO: 305341 - protein, 8 aa, Influenza virus
GSASGRAD

SEQ ID NO: 305342 - protein, 8 aa, Influenza virus
SASGRADT

SEQ ID NO: 305343 - protein, 8 aa, Influenza virus
ASRKADTR

SEQ ID NO: 305344 - protein, 8 aa, Influenza virus
SRKADTRI

SEQ ID NO: 305345 - protein, 8 aa, Influenza virus
ADTRIIFV

SEQ ID NO: 305346 - protein, 8 aa, Influenza virus
IIFVKEGK

SEQ ID NO: 305347 - protein, 8 aa, Influenza virus
LFIREGKI

SEQ ID NO: 305348 - protein, 8 aa, Influenza virus
EGKISHIS

SEQ ID NO: 305349 - protein, 8 aa, Influenza virus
GKISHISP

SEQ ID NO: 305350 - protein, 8 aa, Influenza virus
KISHISPL

SEQ ID NO: 305351 - protein, 8 aa, Influenza virus
ISHISPLS

SEQ ID NO: 305352 - protein, 8 aa, Influenza virus
SHISPLSG

SEQ ID NO: 305353 - protein, 8 aa, Influenza virus
SNRPVVDI

SEQ ID NO: 305354 - protein, 8 aa, Influenza virus
DYSIDSGY

SEQ ID NO: 305355 - protein, 8 aa, Influenza virus
IGSSYVCS

SEQ ID NO: 305356 - protein, 8 aa, Influenza virus
DSSYLCSG

SEQ ID NO: 305357 - protein, 8 aa, Influenza virus
RNEDSSSN

SEQ ID NO: 305358 - protein, 8 aa, Influenza virus
NDDSSSNS

SEQ ID NO: 305359 - protein, 8 aa, Influenza virus
EDSSSNSN

SEQ ID NO: 305360 - protein, 8 aa, Influenza virus
SNSNCRDP

SEQ ID NO: 305361 - protein, 8 aa, Influenza virus
NSNCKDPN

SEQ ID NO: 305362 - protein, 8 aa, Influenza virus
SNCKDPNN

SEQ ID NO: 305363 - protein, 8 aa, Influenza virus
NCKDPNNE

SEQ ID NO: 305364 - protein, 8 aa, Influenza virus
DPNNEKGN

SEQ ID NO: 305365 - protein, 8 aa, Influenza virus
PNNEKGNP

SEQ ID NO: 305366 - protein, 8 aa, Influenza virus
NNEKGNPG

SEQ ID NO: 305367 - protein, 8 aa, Influenza virus
NEKGNPGV

SEQ ID NO: 305368 - protein, 8 aa, Influenza virus
GWAFDNGN

SEQ ID NO: 305369 - protein, 8 aa, Influenza virus
WAFDNGND

SEQ ID NO: 305370 - protein, 8 aa, Influenza virus
NGNDVWMG

SEQ ID NO: 305371 - protein, 8 aa, Influenza virus
YETFKVIG

SEQ ID NO: 305372 - protein, 8 aa, Influenza virus
ETFKVIGG

SEQ ID NO: 305373 - protein, 8 aa, Influenza virus
TFKVIGGW

SEQ ID NO: 305374 - protein, 8 aa, Influenza virus
FRVIDGWT

SEQ ID NO: 305375 - protein, 8 aa, Influenza virus
VISGWTTA

SEQ ID NO: 305376 - protein, 8 aa, Influenza virus
ISGWTTAN

SEQ ID NO: 305377 - protein, 8 aa, Influenza virus
SGWTTANS

SEQ ID NO: 305378 - protein, 8 aa, Influenza virus
TTANSKSK

SEQ ID NO: 305379 - protein, 8 aa, Influenza virus
TANSKSQI

SEQ ID NO: 305380 - protein, 8 aa, Influenza virus
QVIVDNNS

SEQ ID NO: 305381 - protein, 8 aa, Influenza virus
VIVDNNSW

SEQ ID NO: 305382 - protein, 8 aa, Influenza virus
IVDNNSWS

SEQ ID NO: 305383 - protein, 8 aa, Influenza virus
VDNNSWSG

SEQ ID NO: 305384 - protein, 8 aa, Influenza virus
DNNSWSGY

SEQ ID NO: 305385 - protein, 8 aa, Influenza virus
GIFFVEHK

SEQ ID NO: 305386 - protein, 8 aa, Influenza virus
IRGRPQEN

SEQ ID NO: 305387 - protein, 8 aa, Influenza virus
PQEDRVWW

SEQ ID NO: 305388 - protein, 8 aa, Influenza virus
QEDRVWWT

SEQ ID NO: 305389 - protein, 8 aa, Influenza virus
TRVWWTSS

SEQ ID NO: 305390 - protein, 8 aa, Influenza virus
PDGANINL

SEQ ID NO: 305391 - protein, 8 aa, Influenza virus
DGANINLM

SEQ ID NO: 305392 - protein, 8 aa, Influenza virus
GANINLMP

SEQ ID NO: 305393 - protein, 8 aa, Influenza virus
KMNTQILI

SEQ ID NO: 305394 - protein, 8 aa, Influenza virus
CLGHHAVT

SEQ ID NO: 305395 - protein, 8 aa, Influenza virus
LGHHAVTN

SEQ ID NO: 305396 - protein, 8 aa, Influenza virus
GHHAVTNG

SEQ ID NO: 305397 - protein, 8 aa, Influenza virus
HHAVTNGT

SEQ ID NO: 305398 - protein, 8 aa, Influenza virus
HAVANGTR

SEQ ID NO: 305399 - protein, 8 aa, Influenza virus
AVANGTRV

SEQ ID NO: 305400 - protein, 8 aa, Influenza virus
TKVDTLTG

SEQ ID NO: 305401 - protein, 8 aa, Influenza virus
VNTLAERG

SEQ ID NO: 305402 - protein, 8 aa, Influenza virus
DTLTEKGI

SEQ ID NO: 305403 - protein, 8 aa, Influenza virus
TLTGRGIE

SEQ ID NO: 305404 - protein, 8 aa, Influenza virus
LTGRGIEV

SEQ ID NO: 305405 - protein, 8 aa, Influenza virus
TGRGIEVV

SEQ ID NO: 305406 - protein, 8 aa, Influenza virus
ERGVEVVD

SEQ ID NO: 305407 - protein, 8 aa, Influenza virus
RGVEVVDA

SEQ ID NO: 305408 - protein, 8 aa, Influenza virus
NATETVEQ

SEQ ID NO: 305409 - protein, 8 aa, Influenza virus
TDLGQCGI

SEQ ID NO: 305410 - protein, 8 aa, Influenza virus
QCGILGIL

SEQ ID NO: 305411 - protein, 8 aa, Influenza virus
CGILGILT

SEQ ID NO: 305412 - protein, 8 aa, Influenza virus
GILGILTG

SEQ ID NO: 305413 - protein, 8 aa, Influenza virus
ILGILTGP

SEQ ID NO: 305414 - protein, 8 aa, Influenza virus
LGILTGPP

SEQ ID NO: 305415 - protein, 8 aa, Influenza virus
GILTGPPQ

SEQ ID NO: 305416 - protein, 8 aa, Influenza virus
ILTGPPQC

SEQ ID NO: 305417 - protein, 8 aa, Influenza virus
LTGPPQCD

SEQ ID NO: 305418 - protein, 8 aa, Influenza virus
IGPPQCDR

SEQ ID NO: 305419 - protein, 8 aa, Influenza virus
ANLIIERR

SEQ ID NO: 305420 - protein, 8 aa, Influenza virus
DLIVERQD

SEQ ID NO: 305421 - protein, 8 aa, Influenza virus
GKDVCYPG

SEQ ID NO: 305422 - protein, 8 aa, Influenza virus
VCYPGKFS

SEQ ID NO: 305423 - protein, 8 aa, Influenza virus
CYPGKFSN

SEQ ID NO: 305424 - protein, 8 aa, Influenza virus
EPLRQILR

SEQ ID NO: 305425 - protein, 8 aa, Influenza virus
LRQVLRES

SEQ ID NO: 305426 - protein, 8 aa, Influenza virus
RQVLRESG

SEQ ID NO: 305427 - protein, 8 aa, Influenza virus
QVLRESGG

SEQ ID NO: 305428 - protein, 8 aa, Influenza virus
VLRESGGI

SEQ ID NO: 305429 - protein, 8 aa, Influenza virus
KEAMGFTY

SEQ ID NO: 305430 - protein, 8 aa, Influenza virus
GFTYSEIR

SEQ ID NO: 305431 - protein, 8 aa, Influenza virus
FTYSGVRT

SEQ ID NO: 305432 - protein, 8 aa, Influenza virus
DSSFYAEM

SEQ ID NO: 305433 - protein, 8 aa, Influenza virus
MKWLLSNA

SEQ ID NO: 305434 - protein, 8 aa, Influenza virus
KWLLSNAD

SEQ ID NO: 305435 - protein, 8 aa, Influenza virus
WLLSNADN

SEQ ID NO: 305436 - protein, 8 aa, Influenza virus
FPQMTRSY

SEQ ID NO: 305437 - protein, 8 aa, Influenza virus
PALIVWGV

SEQ ID NO: 305438 - protein, 8 aa, Influenza virus
ALIVWGVH

SEQ ID NO: 305439 - protein, 8 aa, Influenza virus
LIVWGVHH

SEQ ID NO: 305440 - protein, 8 aa, Influenza virus
IVWGVHHS

SEQ ID NO: 305441 - protein, 8 aa, Influenza virus
WGIHHSAS

SEQ ID NO: 305442 - protein, 8 aa, Influenza virus
QTKLYGNG

SEQ ID NO: 305443 - protein, 8 aa, Influenza virus
KLYGSGSK

SEQ ID NO: 305444 - protein, 8 aa, Influenza virus
LYGSENKL

SEQ ID NO: 305445 - protein, 8 aa, Influenza virus
YGSGNKLV

SEQ ID NO: 305446 - protein, 8 aa, Influenza virus
GSGNKLVT

SEQ ID NO: 305447 - protein, 8 aa, Influenza virus
SGNKLVTV

SEQ ID NO: 305448 - protein, 8 aa, Influenza virus
KLITVESP

SEQ ID NO: 305449 - protein, 8 aa, Influenza virus
SSKCQQSF

SEQ ID NO: 305450 - protein, 8 aa, Influenza virus
YNYHQSFV

SEQ ID NO: 305451 - protein, 8 aa, Influenza virus
SFTPSPGT

SEQ ID NO: 305452 - protein, 8 aa, Influenza virus
FVPSPGSR

SEQ ID NO: 305453 - protein, 8 aa, Influenza virus
PVNGQSGR

SEQ ID NO: 305454 - protein, 8 aa, Influenza virus
DGQSGRID

SEQ ID NO: 305455 - protein, 8 aa, Influenza virus
GQTGRIDF

SEQ ID NO: 305456 - protein, 8 aa, Influenza virus
QSGRINFH

SEQ ID NO: 305457 - protein, 8 aa, Influenza virus
SGRINFHW

SEQ ID NO: 305458 - protein, 8 aa, Influenza virus
FHWMMLNP

SEQ ID NO: 305459 - protein, 8 aa, Influenza virus
RWLLLDPN

SEQ ID NO: 305460 - protein, 8 aa, Influenza virus
WMMLNPND

SEQ ID NO: 305461 - protein, 8 aa, Influenza virus
MLLDPNDT

SEQ ID NO: 305462 - protein, 8 aa, Influenza virus
MLNPNDTI

SEQ ID NO: 305463 - protein, 8 aa, Influenza virus
LNPNDTVI

SEQ ID NO: 305464 - protein, 8 aa, Influenza virus
NPNDTITF

SEQ ID NO: 305465 - protein, 8 aa, Influenza virus
NDTITFSF

SEQ ID NO: 305466 - protein, 8 aa, Influenza virus
DTITFSFN

SEQ ID NO: 305467 - protein, 8 aa, Influenza virus
TITFSFNG

SEQ ID NO: 305468 - protein, 8 aa, Influenza virus
TFSSNGAF

SEQ ID NO: 305469 - protein, 8 aa, Influenza virus
FNFNGAFI

SEQ ID NO: 305470 - protein, 8 aa, Influenza virus
TFNGSFIA

SEQ ID NO: 305471 - protein, 8 aa, Influenza virus
FVAPDRVS

SEQ ID NO: 305472 - protein, 8 aa, Influenza virus
VAPDRVSF

SEQ ID NO: 305473 - protein, 8 aa, Influenza virus
APDRATFL

SEQ ID NO: 305474 - protein, 8 aa, Influenza virus
CFHNGGTI

SEQ ID NO: 305475 - protein, 8 aa, Influenza virus
GGTITSNL

SEQ ID NO: 305476 - protein, 8 aa, Influenza virus
GTITSNLP

SEQ ID NO: 305477 - protein, 8 aa, Influenza virus
TITSNLPF

SEQ ID NO: 305478 - protein, 8 aa, Influenza virus
ITSNLPFQ

SEQ ID NO: 305479 - protein, 8 aa, Influenza virus
TSNLPFQN

SEQ ID NO: 305480 - protein, 8 aa, Influenza virus
SNLPFQNV

SEQ ID NO: 305481 - protein, 8 aa, Influenza virus
NLPFQNVN

SEQ ID NO: 305482 - protein, 8 aa, Influenza virus
FQNVNSRA

SEQ ID NO: 305483 - protein, 8 aa, Influenza virus
VGKCPKYV

SEQ ID NO: 305484 - protein, 8 aa, Influenza virus
GMRNVPEK

SEQ ID NO: 305485 - protein, 8 aa, Influenza virus
MRNVPEKP

SEQ ID NO: 305486 - protein, 8 aa, Influenza virus
RNVPEKPK

SEQ ID NO: 305487 - protein, 8 aa, Influenza virus
RRRGLFGA

SEQ ID NO: 305488 - protein, 8 aa, Influenza virus
AYQKRMTR

SEQ ID NO: 305489 - protein, 8 aa, Influenza virus
YQKRMTRG

SEQ ID NO: 305490 - protein, 8 aa, Influenza virus
QKRMTRGL

SEQ ID NO: 305491 - protein, 8 aa, Influenza virus
KQMTRGLF

SEQ ID NO: 305492 - protein, 8 aa, Influenza virus
QMTRGLFG

SEQ ID NO: 305493 - protein, 8 aa, Influenza virus
IDGWYGFK

SEQ ID NO: 305494 - protein, 8 aa, Influenza virus
KSTPSAID

SEQ ID NO: 305495 - protein, 8 aa, Influenza virus
STPSAIDQ

SEQ ID NO: 305496 - protein, 8 aa, Influenza virus
TPSAIDQI

SEQ ID NO: 305497 - protein, 8 aa, Influenza virus
PSAIDQIT

SEQ ID NO: 305498 - protein, 8 aa, Influenza virus
GKLNRFIE

SEQ ID NO: 305499 - protein, 8 aa, Influenza virus
KLNRLIDR

SEQ ID NO: 305500 - protein, 8 aa, Influenza virus
LNRLIDRT

SEQ ID NO: 305501 - protein, 8 aa, Influenza virus
NRFIEKTN

SEQ ID NO: 305502 - protein, 8 aa, Influenza virus
RFIEKTNQ

SEQ ID NO: 305503 - protein, 8 aa, Influenza virus
LIDRTNHQ

SEQ ID NO: 305504 - protein, 8 aa, Influenza virus
DRTNHQFE

SEQ ID NO: 305505 - protein, 8 aa, Influenza virus
NHQFELID

SEQ ID NO: 305506 - protein, 8 aa, Influenza virus
HQFELIDN

SEQ ID NO: 305507 - protein, 8 aa, Influenza virus
LIDNEFNE

SEQ ID NO: 305508 - protein, 8 aa, Influenza virus
IDNEFIEV

SEQ ID NO: 305509 - protein, 8 aa, Influenza virus
DNEFIEVE

SEQ ID NO: 305510 - protein, 8 aa, Influenza virus
FIEVEKQI

SEQ ID NO: 305511 - protein, 8 aa, Influenza virus
IEVEKQIG

SEQ ID NO: 305512 - protein, 8 aa, Influenza virus
TRDSVTEL

SEQ ID NO: 305513 - protein, 8 aa, Influenza virus
RDSVTELW

SEQ ID NO: 305514 - protein, 8 aa, Influenza virus
DSVTELWS

SEQ ID NO: 305515 - protein, 8 aa, Influenza virus
SVTELWSY

SEQ ID NO: 305516 - protein, 8 aa, Influenza virus
VTELWSYN

SEQ ID NO: 305517 - protein, 8 aa, Influenza virus
LADSEMSK

SEQ ID NO: 305518 - protein, 8 aa, Influenza virus
DSEMNNLY

SEQ ID NO: 305519 - protein, 8 aa, Influenza virus
SEMNNLYE

SEQ ID NO: 305520 - protein, 8 aa, Influenza virus
EMNKLHER

SEQ ID NO: 305521 - protein, 8 aa, Influenza virus
MNKLHERV

SEQ ID NO: 305522 - protein, 8 aa, Influenza virus
KLHERVRK

SEQ ID NO: 305523 - protein, 8 aa, Influenza virus
LYTRVKRQ

SEQ ID NO: 305524 - protein, 8 aa, Influenza virus
YTRVKRQL

SEQ ID NO: 305525 - protein, 8 aa, Influenza virus
QCMASIRN

SEQ ID NO: 305526 - protein, 8 aa, Influenza virus
RNNTYDHN

SEQ ID NO: 305527 - protein, 8 aa, Influenza virus
TYDHSTYR

SEQ ID NO: 305528 - protein, 8 aa, Influenza virus
QYRAESLQ

SEQ ID NO: 305529 - protein, 8 aa, Influenza virus
EEAMQNRM

SEQ ID NO: 305530 - protein, 8 aa, Influenza virus
EAMQNRMQ

SEQ ID NO: 305531 - protein, 8 aa, Influenza virus
AMQNRMQI

SEQ ID NO: 305532 - protein, 8 aa, Influenza virus
QNRMQINP

SEQ ID NO: 305533 - protein, 8 aa, Influenza virus
NRMQINPV

SEQ ID NO: 305534 - protein, 8 aa, Influenza virus
RMQINPVK

SEQ ID NO: 305535 - protein, 8 aa, Influenza virus
MQINPVKL

SEQ ID NO: 305536 - protein, 8 aa, Influenza virus
DPVKLSNG

SEQ ID NO: 305537 - protein, 8 aa, Influenza virus
PVKLNSGY

SEQ ID NO: 305538 - protein, 8 aa, Influenza virus
VKLNSGYK

SEQ ID NO: 305539 - protein, 8 aa, Influenza virus
KLSNGYKD

SEQ ID NO: 305540 - protein, 8 aa, Influenza virus
SGGYKDII

SEQ ID NO: 305541 - protein, 8 aa, Influenza virus
GGYKDIIL

SEQ ID NO: 305542 - protein, 8 aa, Influenza virus
GASCFLFL

SEQ ID NO: 305543 - protein, 8 aa, Influenza virus
ASCFLFLA

SEQ ID NO: 305544 - protein, 8 aa, Influenza virus
SCFLFLAI

SEQ ID NO: 305545 - protein, 8 aa, Influenza virus
GVVNTALS

SEQ ID NO: 305546 - protein, 8 aa, Influenza virus
VVNTILST

SEQ ID NO: 305547 - protein, 8 aa, Influenza virus
VLSIIALL

SEQ ID NO: 305548 - protein, 8 aa, Influenza virus
LSTKALLI

SEQ ID NO: 305549 - protein, 8 aa, Influenza virus
SIIALLIG

SEQ ID NO: 305550 - protein, 8 aa, Influenza virus
TIALFIGV

SEQ ID NO: 305551 - protein, 8 aa, Influenza virus
IALFIGVG

SEQ ID NO: 305552 - protein, 8 aa, Influenza virus
ALFIGVGN

SEQ ID NO: 305553 - protein, 8 aa, Influenza virus
LFIGVGNL

SEQ ID NO: 305554 - protein, 8 aa, Influenza virus
IGIGNLIF

SEQ ID NO: 305555 - protein, 8 aa, Influenza virus
GIGNLAFN

SEQ ID NO: 305556 - protein, 8 aa, Influenza virus
IGNLAFNA

SEQ ID NO: 305557 - protein, 8 aa, Influenza virus
VFNTVIHG

SEQ ID NO: 305558 - protein, 8 aa, Influenza virus
ITYNKTVI

SEQ ID NO: 305559 - protein, 8 aa, Influenza virus
TYNKTVIN

SEQ ID NO: 305560 - protein, 8 aa, Influenza virus
YNKTVINN

SEQ ID NO: 305561 - protein, 8 aa, Influenza virus
NKTVINNI

SEQ ID NO: 305562 - protein, 8 aa, Influenza virus
KTVINNIT

SEQ ID NO: 305563 - protein, 8 aa, Influenza virus
NNMTTTII

SEQ ID NO: 305564 - protein, 8 aa, Influenza virus
NITTTITT

SEQ ID NO: 305565 - protein, 8 aa, Influenza virus
FKPSLPLC

SEQ ID NO: 305566 - protein, 8 aa, Influenza virus
KPSLPLCP

SEQ ID NO: 305567 - protein, 8 aa, Influenza virus
PSLPLCPF

SEQ ID NO: 305568 - protein, 8 aa, Influenza virus
SLPLCPFK

SEQ ID NO: 305569 - protein, 8 aa, Influenza virus
ALRLAENK

SEQ ID NO: 305570 - protein, 8 aa, Influenza virus
DVLVTREP

SEQ ID NO: 305571 - protein, 8 aa, Influenza virus
IVTREPCV

SEQ ID NO: 305572 - protein, 8 aa, Influenza virus
GCWSFALA

SEQ ID NO: 305573 - protein, 8 aa, Influenza virus
QGALLGTR

SEQ ID NO: 305574 - protein, 8 aa, Influenza virus
GALLGTRH

SEQ ID NO: 305575 - protein, 8 aa, Influenza virus
ALLGTRHS

SEQ ID NO: 305576 - protein, 8 aa, Influenza virus
LLGTRHSN

SEQ ID NO: 305577 - protein, 8 aa, Influenza virus
LGTRHSNG

SEQ ID NO: 305578 - protein, 8 aa, Influenza virus
HSNGTIED

SEQ ID NO: 305579 - protein, 8 aa, Influenza virus
SNGTIKDK

SEQ ID NO: 305580 - protein, 8 aa, Influenza virus
KDKTPYRS

SEQ ID NO: 305581 - protein, 8 aa, Influenza virus
RSLIRFPV

SEQ ID NO: 305582 - protein, 8 aa, Influenza virus
SLIRFPVG

SEQ ID NO: 305583 - protein, 8 aa, Influenza virus
LIQFPMGT

SEQ ID NO: 305584 - protein, 8 aa, Influenza virus
IQFPMGTA

SEQ ID NO: 305585 - protein, 8 aa, Influenza virus
QFPIGTAP

SEQ ID NO: 305586 - protein, 8 aa, Influenza virus
FPVGTAPV

SEQ ID NO: 305587 - protein, 8 aa, Influenza virus
PVGTAPVL

SEQ ID NO: 305588 - protein, 8 aa, Influenza virus
IGTAPILG

SEQ ID NO: 305589 - protein, 8 aa, Influenza virus
VLGNYREV

SEQ ID NO: 305590 - protein, 8 aa, Influenza virus
LGNYKEMC

SEQ ID NO: 305591 - protein, 8 aa, Influenza virus
GNYKEIRI

SEQ ID NO: 305592 - protein, 8 aa, Influenza virus
NYREVCIA

SEQ ID NO: 305593 - protein, 8 aa, Influenza virus
YKEMCAAW

SEQ ID NO: 305594 - protein, 8 aa, Influenza virus
KEMCAAWS

SEQ ID NO: 305595 - protein, 8 aa, Influenza virus
EVCIAWSS

SEQ ID NO: 305596 - protein, 8 aa, Influenza virus
IRIAWSSS

SEQ ID NO: 305597 - protein, 8 aa, Influenza virus
CAAWSSSS

SEQ ID NO: 305598 - protein, 8 aa, Influenza virus
KEWLHVCI

SEQ ID NO: 305599 - protein, 8 aa, Influenza virus
EWMHVCMA

SEQ ID NO: 305600 - protein, 8 aa, Influenza virus
WMHVSMTG

SEQ ID NO: 305601 - protein, 8 aa, Influenza virus
HVCMTGDD

SEQ ID NO: 305602 - protein, 8 aa, Influenza virus
GKMRDSIK

SEQ ID NO: 305603 - protein, 8 aa, Influenza virus
RMADSIKS

SEQ ID NO: 305604 - protein, 8 aa, Influenza virus
MSDSIKSW

SEQ ID NO: 305605 - protein, 8 aa, Influenza virus
ESECQCLY

SEQ ID NO: 305606 - protein, 8 aa, Influenza virus
SECQRIDG

SEQ ID NO: 305607 - protein, 8 aa, Influenza virus
GTCIVAVT

SEQ ID NO: 305608 - protein, 8 aa, Influenza virus
TCIVAVTD

SEQ ID NO: 305609 - protein, 8 aa, Influenza virus
ANSAHHRV

SEQ ID NO: 305610 - protein, 8 aa, Influenza virus
NKADHRIY

SEQ ID NO: 305611 - protein, 8 aa, Influenza virus
SAHHRVYW

SEQ ID NO: 305612 - protein, 8 aa, Influenza virus
IYWIREGK

SEQ ID NO: 305613 - protein, 8 aa, Influenza virus
KIRHLEEC

SEQ ID NO: 305614 - protein, 8 aa, Influenza virus
ECSCYVDV

SEQ ID NO: 305615 - protein, 8 aa, Influenza virus
CSCYVDTD

SEQ ID NO: 305616 - protein, 8 aa, Influenza virus
SCYVDTDV

SEQ ID NO: 305617 - protein, 8 aa, Influenza virus
CYVDVDVY

SEQ ID NO: 305618 - protein, 8 aa, Influenza virus
YVDTDVYC

SEQ ID NO: 305619 - protein, 8 aa, Influenza virus
DVDVYCIC

SEQ ID NO: 305620 - protein, 8 aa, Influenza virus
TDVYCICR

SEQ ID NO: 305621 - protein, 8 aa, Influenza virus
NRPWVRMN

SEQ ID NO: 305622 - protein, 8 aa, Influenza virus
RPWVRMNN

SEQ ID NO: 305623 - protein, 8 aa, Influenza virus
PWVRMNNE

SEQ ID NO: 305624 - protein, 8 aa, Influenza virus
WVRINNET

SEQ ID NO: 305625 - protein, 8 aa, Influenza virus
VRMNNETI

SEQ ID NO: 305626 - protein, 8 aa, Influenza virus
HSDTPRPT

SEQ ID NO: 305627 - protein, 8 aa, Influenza virus
SDTPRPVD

SEQ ID NO: 305628 - protein, 8 aa, Influenza virus
DTPRPVDP

SEQ ID NO: 305629 - protein, 8 aa, Influenza virus
TPRPTDPS

SEQ ID NO: 305630 - protein, 8 aa, Influenza virus
DPSIMSCD

SEQ ID NO: 305631 - protein, 8 aa, Influenza virus
PSIMSCDS

SEQ ID NO: 305632 - protein, 8 aa, Influenza virus
SIMSCDSP

SEQ ID NO: 305633 - protein, 8 aa, Influenza virus
IMSCDSPS

SEQ ID NO: 305634 - protein, 8 aa, Influenza virus
CSSPSGIE

SEQ ID NO: 305635 - protein, 8 aa, Influenza virus
SSPSGIEG

SEQ ID NO: 305636 - protein, 8 aa, Influenza virus
SPSNVKGG

SEQ ID NO: 305637 - protein, 8 aa, Influenza virus
KGGPGVKG

SEQ ID NO: 305638 - protein, 8 aa, Influenza virus
VKGFGFKV

SEQ ID NO: 305639 - protein, 8 aa, Influenza virus
KGFGFKVG

SEQ ID NO: 305640 - protein, 8 aa, Influenza virus
LGRTVSIN

SEQ ID NO: 305641 - protein, 8 aa, Influenza virus
GRTVSISG

SEQ ID NO: 305642 - protein, 8 aa, Influenza virus
RTVSINGR

SEQ ID NO: 305643 - protein, 8 aa, Influenza virus
TVSISGRS

SEQ ID NO: 305644 - protein, 8 aa, Influenza virus
SSRSGFEV

SEQ ID NO: 305645 - protein, 8 aa, Influenza virus
GRLGFEII

SEQ ID NO: 305646 - protein, 8 aa, Influenza virus
RSGFEIIR

SEQ ID NO: 305647 - protein, 8 aa, Influenza virus
SGFEVIRV

SEQ ID NO: 305648 - protein, 8 aa, Influenza virus
IKVAEGWI

SEQ ID NO: 305649 - protein, 8 aa, Influenza virus
VTDGWINS

SEQ ID NO: 305650 - protein, 8 aa, Influenza virus
TEGWIDSP

SEQ ID NO: 305651 - protein, 8 aa, Influenza virus
EGWIDSPN

SEQ ID NO: 305652 - protein, 8 aa, Influenza virus
WIDSPNHA

SEQ ID NO: 305653 - protein, 8 aa, Influenza virus
IDSPNHAK

SEQ ID NO: 305654 - protein, 8 aa, Influenza virus
DSPNHAKS

SEQ ID NO: 305655 - protein, 8 aa, Influenza virus
AKAATQTL

SEQ ID NO: 305656 - protein, 8 aa, Influenza virus
KGCFQPCF

SEQ ID NO: 305657 - protein, 8 aa, Influenza virus
VELIRGRL

SEQ ID NO: 305658 - protein, 8 aa, Influenza virus
ELIRGRPI

SEQ ID NO: 305659 - protein, 8 aa, Influenza virus
NDDVSWAS

SEQ ID NO: 305660 - protein, 8 aa, Influenza virus
DDVSWASN

SEQ ID NO: 305661 - protein, 8 aa, Influenza virus
DVSWASNS

SEQ ID NO: 305662 - protein, 8 aa, Influenza virus
KMNIQILI

SEQ ID NO: 305663 - protein, 8 aa, Influenza virus
SADKICLG

SEQ ID NO: 305664 - protein, 8 aa, Influenza virus
ICLGHHAE

SEQ ID NO: 305665 - protein, 8 aa, Influenza virus
NGAKVNTL

SEQ ID NO: 305666 - protein, 8 aa, Influenza virus
GIKVDTLT

SEQ ID NO: 305667 - protein, 8 aa, Influenza virus
IKVDTLTE

SEQ ID NO: 305668 - protein, 8 aa, Influenza virus
VNTLTERE

SEQ ID NO: 305669 - protein, 8 aa, Influenza virus
NTLTEKGI

SEQ ID NO: 305670 - protein, 8 aa, Influenza virus
TLTEREVE

SEQ ID NO: 305671 - protein, 8 aa, Influenza virus
LTEREVEV

SEQ ID NO: 305672 - protein, 8 aa, Influenza virus
TEREVEVV

SEQ ID NO: 305673 - protein, 8 aa, Influenza virus
EREVEVVN

SEQ ID NO: 305674 - protein, 8 aa, Influenza virus
REVEVVNA

SEQ ID NO: 305675 - protein, 8 aa, Influenza virus
DLGRCGLL

SEQ ID NO: 305676 - protein, 8 aa, Influenza virus
LGKCGLLG

SEQ ID NO: 305677 - protein, 8 aa, Influenza virus
SQCGLLGT

SEQ ID NO: 305678 - protein, 8 aa, Influenza virus
IIGPPQCD

SEQ ID NO: 305679 - protein, 8 aa, Influenza virus
IGPPQCDL

SEQ ID NO: 305680 - protein, 8 aa, Influenza virus
DLIIERRD

SEQ ID NO: 305681 - protein, 8 aa, Influenza virus
LIIERSEG

SEQ ID NO: 305682 - protein, 8 aa, Influenza virus
EETLRKIL

SEQ ID NO: 305683 - protein, 8 aa, Influenza virus
ETLRKILR

SEQ ID NO: 305684 - protein, 8 aa, Influenza virus
LRKILRKS

SEQ ID NO: 305685 - protein, 8 aa, Influenza virus
RKILRKSG

SEQ ID NO: 305686 - protein, 8 aa, Influenza virus
KILRKSGG

SEQ ID NO: 305687 - protein, 8 aa, Influenza virus
ILRRSGGI

SEQ ID NO: 305688 - protein, 8 aa, Influenza virus
MRFTYSGI

SEQ ID NO: 305689 - protein, 8 aa, Influenza virus
TYTGVRTD

SEQ ID NO: 305690 - protein, 8 aa, Influenza virus
YTGVRTDG

SEQ ID NO: 305691 - protein, 8 aa, Influenza virus
RSESSFYA

SEQ ID NO: 305692 - protein, 8 aa, Influenza virus
SGPSFYAE

SEQ ID NO: 305693 - protein, 8 aa, Influenza virus
ESSFYAEM

SEQ ID NO: 305694 - protein, 8 aa, Influenza virus
EMKWLLSD

SEQ ID NO: 305695 - protein, 8 aa, Influenza virus
PQMTRSYK

SEQ ID NO: 305696 - protein, 8 aa, Influenza virus
QMTRSYKN

SEQ ID NO: 305697 - protein, 8 aa, Influenza virus
TKSYKNIR

SEQ ID NO: 305698 - protein, 8 aa, Influenza virus
PALITWGI

SEQ ID NO: 305699 - protein, 8 aa, Influenza virus
ALITWGIH

SEQ ID NO: 305700 - protein, 8 aa, Influenza virus
LITWGIHH

SEQ ID NO: 305701 - protein, 8 aa, Influenza virus
EQTKLYGN

SEQ ID NO: 305702 - protein, 8 aa, Influenza virus
QTKLYGNG

SEQ ID NO: 305703 - protein, 8 aa, Influenza virus
LYGNGSKL

SEQ ID NO: 305704 - protein, 8 aa, Influenza virus
VTVWSSKY

SEQ ID NO: 305705 - protein, 8 aa, Influenza virus
TVWSSKYR

SEQ ID NO: 305706 - protein, 8 aa, Influenza virus
VWSSKYQR

SEQ ID NO: 305707 - protein, 8 aa, Influenza virus
WSSKYQRS

SEQ ID NO: 305708 - protein, 8 aa, Influenza virus
SSKYQQSL

SEQ ID NO: 305709 - protein, 8 aa, Influenza virus
RPPVNGQS

SEQ ID NO: 305710 - protein, 8 aa, Influenza virus
PPVNGQSG

SEQ ID NO: 305711 - protein, 8 aa, Influenza virus
PVNGQSGR

SEQ ID NO: 305712 - protein, 8 aa, Influenza virus
NDTVNFSF

SEQ ID NO: 305713 - protein, 8 aa, Influenza virus
DTVNFSFN

SEQ ID NO: 305714 - protein, 8 aa, Influenza virus
TVNFSFNG

SEQ ID NO: 305715 - protein, 8 aa, Influenza virus
VNFSFNGA

SEQ ID NO: 305716 - protein, 8 aa, Influenza virus
TFNFNGAF

SEQ ID NO: 305717 - protein, 8 aa, Influenza virus
FNFNGAFV

SEQ ID NO: 305718 - protein, 8 aa, Influenza virus
NFNGAFVA

SEQ ID NO: 305719 - protein, 8 aa, Influenza virus
FVAPDRAS

SEQ ID NO: 305720 - protein, 8 aa, Influenza virus
IAPDRAGF

SEQ ID NO: 305721 - protein, 8 aa, Influenza virus
CFHSGGTI

SEQ ID NO: 305722 - protein, 8 aa, Influenza virus
SKLPFQNI

SEQ ID NO: 305723 - protein, 8 aa, Influenza virus
KLPFQNIN

SEQ ID NO: 305724 - protein, 8 aa, Influenza virus
FQNVNSRA

SEQ ID NO: 305725 - protein, 8 aa, Influenza virus
VGRCPRYV

SEQ ID NO: 305726 - protein, 8 aa, Influenza virus
GECPRYVK

SEQ ID NO: 305727 - protein, 8 aa, Influenza virus
ECPRYVKQ

SEQ ID NO: 305728 - protein, 8 aa, Influenza virus
IHKQLTHH

SEQ ID NO: 305729 - protein, 8 aa, Influenza virus
KKKRGLFG

SEQ ID NO: 305730 - protein, 8 aa, Influenza virus
KKRGLFGA

SEQ ID NO: 305731 - protein, 8 aa, Influenza virus
IDGWYGYK

SEQ ID NO: 305732 - protein, 8 aa, Influenza virus
WYGFKHQN

SEQ ID NO: 305733 - protein, 8 aa, Influenza virus
YGYKHQNA

SEQ ID NO: 305734 - protein, 8 aa, Influenza virus
GFRHQNSQ

SEQ ID NO: 305735 - protein, 8 aa, Influenza virus
YKHQNAQG

SEQ ID NO: 305736 - protein, 8 aa, Influenza virus
SAVNQITG

SEQ ID NO: 305737 - protein, 8 aa, Influenza virus
AVNQITGK

SEQ ID NO: 305738 - protein, 8 aa, Influenza virus
VNQITGKL

SEQ ID NO: 305739 - protein, 8 aa, Influenza virus
EMIDNEFN

SEQ ID NO: 305740 - protein, 8 aa, Influenza virus
MIDNEFNE

SEQ ID NO: 305741 - protein, 8 aa, Influenza virus
IDNEFSEV

SEQ ID NO: 305742 - protein, 8 aa, Influenza virus
DNEFTEIE

SEQ ID NO: 305743 - protein, 8 aa, Influenza virus
EVERQIGN

SEQ ID NO: 305744 - protein, 8 aa, Influenza virus
VERQIGNV

SEQ ID NO: 305745 - protein, 8 aa, Influenza virus
EKQLGNVI

SEQ ID NO: 305746 - protein, 8 aa, Influenza virus
KQLGNVIN

SEQ ID NO: 305747 - protein, 8 aa, Influenza virus
NWTRDSLT

SEQ ID NO: 305748 - protein, 8 aa, Influenza virus
WTRDSLTE

SEQ ID NO: 305749 - protein, 8 aa, Influenza virus
TEMWSYNA

SEQ ID NO: 305750 - protein, 8 aa, Influenza virus
EVWSYNAD

SEQ ID NO: 305751 - protein, 8 aa, Influenza virus
MWSYNAEL

SEQ ID NO: 305752 - protein, 8 aa, Influenza virus
SYNAELLI

SEQ ID NO: 305753 - protein, 8 aa, Influenza virus
YNAELLIA

SEQ ID NO: 305754 - protein, 8 aa, Influenza virus
NADLLVAM

SEQ ID NO: 305755 - protein, 8 aa, Influenza virus
ADLLVAME

SEQ ID NO: 305756 - protein, 8 aa, Influenza virus
ELLIAMEN

SEQ ID NO: 305757 - protein, 8 aa, Influenza virus
QHTIDSTD

SEQ ID NO: 305758 - protein, 8 aa, Influenza virus
HTIDSTDS

SEQ ID NO: 305759 - protein, 8 aa, Influenza virus
TIDLAESE

SEQ ID NO: 305760 - protein, 8 aa, Influenza virus
IDSTDSEM

SEQ ID NO: 305761 - protein, 8 aa, Influenza virus
DSTDSEMN

SEQ ID NO: 305762 - protein, 8 aa, Influenza virus
LTNSEMNK

SEQ ID NO: 305763 - protein, 8 aa, Influenza virus
KLYERVRK

SEQ ID NO: 305764 - protein, 8 aa, Influenza virus
LYERVRKQ

SEQ ID NO: 305765 - protein, 8 aa, Influenza virus
YERVRKQL

SEQ ID NO: 305766 - protein, 8 aa, Influenza virus
ERVRKQLR

SEQ ID NO: 305767 - protein, 8 aa, Influenza virus
RVRKQLRE

SEQ ID NO: 305768 - protein, 8 aa, Influenza virus
DGTGCFEL

SEQ ID NO: 305769 - protein, 8 aa, Influenza virus
GTGCFELF

SEQ ID NO: 305770 - protein, 8 aa, Influenza virus
LFHKCDDD

SEQ ID NO: 305771 - protein, 8 aa, Influenza virus
FHKCDDNC

SEQ ID NO: 305772 - protein, 8 aa, Influenza virus
HKCDDRCM

SEQ ID NO: 305773 - protein, 8 aa, Influenza virus
CMTSIRNN

SEQ ID NO: 305774 - protein, 8 aa, Influenza virus
MANIRNNT

SEQ ID NO: 305775 - protein, 8 aa, Influenza virus
ASIRNNSY

SEQ ID NO: 305776 - protein, 8 aa, Influenza virus
RNNTYDHR

SEQ ID NO: 305777 - protein, 8 aa, Influenza virus
NNTYDHST

SEQ ID NO: 305778 - protein, 8 aa, Influenza virus
NTYDHSTY

SEQ ID NO: 305779 - protein, 8 aa, Influenza virus
TYDHSTYR

SEQ ID NO: 305780 - protein, 8 aa, Influenza virus
AMQNRVKI

SEQ ID NO: 305781 - protein, 8 aa, Influenza virus
QNRIQINP

SEQ ID NO: 305782 - protein, 8 aa, Influenza virus
NRIQINPV

SEQ ID NO: 305783 - protein, 8 aa, Influenza virus
VKIDPVKL

SEQ ID NO: 305784 - protein, 8 aa, Influenza virus
KIDPVKLS

SEQ ID NO: 305785 - protein, 8 aa, Influenza virus
IDPVKLSG

SEQ ID NO: 305786 - protein, 8 aa, Influenza virus
DPVKLSGG

SEQ ID NO: 305787 - protein, 8 aa, Influenza virus
PVKLSGGY

SEQ ID NO: 305788 - protein, 8 aa, Influenza virus
ELSSGYKD

SEQ ID NO: 305789 - protein, 8 aa, Influenza virus
LSGGYKDV

SEQ ID NO: 305790 - protein, 8 aa, Influenza virus
SGGYKDVI

SEQ ID NO: 305791 - protein, 8 aa, Influenza virus
SGYKEVIL

SEQ ID NO: 305792 - protein, 8 aa, Influenza virus
GYKDVIIW

SEQ ID NO: 305793 - protein, 8 aa, Influenza virus
YKDVIIWF

SEQ ID NO: 305794 - protein, 8 aa, Influenza virus
KDVIIWFS

SEQ ID NO: 305795 - protein, 8 aa, Influenza virus
DVILWFSL

SEQ ID NO: 305796 - protein, 8 aa, Influenza virus
SLGASCFL

SEQ ID NO: 305797 - protein, 8 aa, Influenza virus
FGASCFTL

SEQ ID NO: 305798 - protein, 8 aa, Influenza virus
GASCFLLI

SEQ ID NO: 305799 - protein, 8 aa, Influenza virus
ASCFLLIA

SEQ ID NO: 305800 - protein, 8 aa, Influenza virus
SCFLLIAI

SEQ ID NO: 305801 - protein, 8 aa, Influenza virus
LVFICIKN

SEQ ID NO: 305802 - protein, 8 aa, Influenza virus
AFICIKNG

SEQ ID NO: 305803 - protein, 8 aa, Influenza virus
VKNGNHAV

SEQ ID NO: 305804 - protein, 8 aa, Influenza virus
NGNMRCTS

SEQ ID NO: 305805 - protein, 8 aa, Influenza virus
GNMRGTNW

SEQ ID NO: 305806 - protein, 8 aa, Influenza virus
NMRCTSCI

SEQ ID NO: 305807 - protein, 8 aa, Influenza virus
PNQKLFTL

SEQ ID NO: 305808 - protein, 8 aa, Influenza virus
NQKLFTLS

SEQ ID NO: 305809 - protein, 8 aa, Influenza virus
TLSGVAIA

SEQ ID NO: 305810 - protein, 8 aa, Influenza virus
GIAIALGI

SEQ ID NO: 305811 - protein, 8 aa, Influenza virus
IAIALGII

SEQ ID NO: 305812 - protein, 8 aa, Influenza virus
AIALGIIN

SEQ ID NO: 305813 - protein, 8 aa, Influenza virus
IALGIINL

SEQ ID NO: 305814 - protein, 8 aa, Influenza virus
ALGIINLL

SEQ ID NO: 305815 - protein, 8 aa, Influenza virus
VLNLLIGV

SEQ ID NO: 305816 - protein, 8 aa, Influenza virus
LLIGISNI

SEQ ID NO: 305817 - protein, 8 aa, Influenza virus
LIGISNVV

SEQ ID NO: 305818 - protein, 8 aa, Influenza virus
IGISNVVL

SEQ ID NO: 305819 - protein, 8 aa, Influenza virus
GISNVVLN

SEQ ID NO: 305820 - protein, 8 aa, Influenza virus
SNVGLNMS

SEQ ID NO: 305821 - protein, 8 aa, Influenza virus
NIGLNVSL

SEQ ID NO: 305822 - protein, 8 aa, Influenza virus
VGLNMSLH

SEQ ID NO: 305823 - protein, 8 aa, Influenza virus
GLNMSLHL

SEQ ID NO: 305824 - protein, 8 aa, Influenza virus
LNVSLHLR

SEQ ID NO: 305825 - protein, 8 aa, Influenza virus
GNTYVNNT

SEQ ID NO: 305826 - protein, 8 aa, Influenza virus
NKYVNNTT

SEQ ID NO: 305827 - protein, 8 aa, Influenza virus
TYINNTTI

SEQ ID NO: 305828 - protein, 8 aa, Influenza virus
YINNTTII

SEQ ID NO: 305829 - protein, 8 aa, Influenza virus
NYLLLNKS

SEQ ID NO: 305830 - protein, 8 aa, Influenza virus
LNKSLCKI

SEQ ID NO: 305831 - protein, 8 aa, Influenza virus
NKSLCKIE

SEQ ID NO: 305832 - protein, 8 aa, Influenza virus
KSLCKIEG

SEQ ID NO: 305833 - protein, 8 aa, Influenza virus
SLCKIEGW

SEQ ID NO: 305834 - protein, 8 aa, Influenza virus
LCKIEGWV

SEQ ID NO: 305835 - protein, 8 aa, Influenza virus
CKIEGWVV

SEQ ID NO: 305836 - protein, 8 aa, Influenza virus
SVEGWVVI

SEQ ID NO: 305837 - protein, 8 aa, Influenza virus
VEGWVVIE

SEQ ID NO: 305838 - protein, 8 aa, Influenza virus
EGWVVIEK

SEQ ID NO: 305839 - protein, 8 aa, Influenza virus
GWVVIAQD

SEQ ID NO: 305840 - protein, 8 aa, Influenza virus
WVVIEKDN

SEQ ID NO: 305841 - protein, 8 aa, Influenza virus
VVIEKDNA

SEQ ID NO: 305842 - protein, 8 aa, Influenza virus
VIAQDNAI

SEQ ID NO: 305843 - protein, 8 aa, Influenza virus
IAQDNAIR

SEQ ID NO: 305844 - protein, 8 aa, Influenza virus
EKDNAVRF

SEQ ID NO: 305845 - protein, 8 aa, Influenza virus
PYVSCDPK

SEQ ID NO: 305846 - protein, 8 aa, Influenza virus
NGTIHDRA

SEQ ID NO: 305847 - protein, 8 aa, Influenza virus
GTIHDRTT

SEQ ID NO: 305848 - protein, 8 aa, Influenza virus
TIHDRAAF

SEQ ID NO: 305849 - protein, 8 aa, Influenza virus
IHDRAAFR

SEQ ID NO: 305850 - protein, 8 aa, Influenza virus
RTAFRGLM

SEQ ID NO: 305851 - protein, 8 aa, Influenza virus
TTFRGLLS

SEQ ID NO: 305852 - protein, 8 aa, Influenza virus
AFRGLMST

SEQ ID NO: 305853 - protein, 8 aa, Influenza virus
FRGLMSTP

SEQ ID NO: 305854 - protein, 8 aa, Influenza virus
RGLLSTPL

SEQ ID NO: 305855 - protein, 8 aa, Influenza virus
GLMSTPLG

SEQ ID NO: 305856 - protein, 8 aa, Influenza virus
SNSEFICV

SEQ ID NO: 305857 - protein, 8 aa, Influenza virus
NSEFICVG

SEQ ID NO: 305858 - protein, 8 aa, Influenza virus
SEFICVGW

SEQ ID NO: 305859 - protein, 8 aa, Influenza virus
EFICVGWS

SEQ ID NO: 305860 - protein, 8 aa, Influenza virus
STTCHDGV

SEQ ID NO: 305861 - protein, 8 aa, Influenza virus
CHDGVNRM

SEQ ID NO: 305862 - protein, 8 aa, Influenza virus
HDGVNRMT

SEQ ID NO: 305863 - protein, 8 aa, Influenza virus
DGVNRMTI

SEQ ID NO: 305864 - protein, 8 aa, Influenza virus
GVNRMTIC

SEQ ID NO: 305865 - protein, 8 aa, Influenza virus
NRMTICVQ

SEQ ID NO: 305866 - protein, 8 aa, Influenza virus
QGNNENAT

SEQ ID NO: 305867 - protein, 8 aa, Influenza virus
GNNENATA

SEQ ID NO: 305868 - protein, 8 aa, Influenza virus
NNENATAT

SEQ ID NO: 305869 - protein, 8 aa, Influenza virus
TATVYYNG

SEQ ID NO: 305870 - protein, 8 aa, Influenza virus
ATVYYNGR

SEQ ID NO: 305871 - protein, 8 aa, Influenza virus
TVYYNGRL

SEQ ID NO: 305872 - protein, 8 aa, Influenza virus
VYYNGRLT

SEQ ID NO: 305873 - protein, 8 aa, Influenza virus
YYNGRLTT

SEQ ID NO: 305874 - protein, 8 aa, Influenza virus
YNGRLTTT

SEQ ID NO: 305875 - protein, 8 aa, Influenza virus
NGRLTTTI

SEQ ID NO: 305876 - protein, 8 aa, Influenza virus
RRLTTTVK

SEQ ID NO: 305877 - protein, 8 aa, Influenza virus
TTVKTWAG

SEQ ID NO: 305878 - protein, 8 aa, Influenza virus
TIRTWAKN

SEQ ID NO: 305879 - protein, 8 aa, Influenza virus
VKTWAGNI

SEQ ID NO: 305880 - protein, 8 aa, Influenza virus
RTWAKNIL

SEQ ID NO: 305881 - protein, 8 aa, Influenza virus
RNILRTQD

SEQ ID NO: 305882 - protein, 8 aa, Influenza virus
SECVSHNG

SEQ ID NO: 305883 - protein, 8 aa, Influenza virus
ECVSHNGT

SEQ ID NO: 305884 - protein, 8 aa, Influenza virus
CVRHNGTC

SEQ ID NO: 305885 - protein, 8 aa, Influenza virus
VSHNGTWA

SEQ ID NO: 305886 - protein, 8 aa, Influenza virus
RHNGTCAV

SEQ ID NO: 305887 - protein, 8 aa, Influenza virus
HNGTCVVV

SEQ ID NO: 305888 - protein, 8 aa, Influenza virus
NGTCVVVM

SEQ ID NO: 305889 - protein, 8 aa, Influenza virus
GTCVVVMT

SEQ ID NO: 305890 - protein, 8 aa, Influenza virus
TWAVVMTD

SEQ ID NO: 305891 - protein, 8 aa, Influenza virus
WAVVMTDG

SEQ ID NO: 305892 - protein, 8 aa, Influenza virus
VVVMTDGS

SEQ ID NO: 305893 - protein, 8 aa, Influenza virus
VMTDGPAS

SEQ ID NO: 305894 - protein, 8 aa, Influenza virus
MTDGSASG

SEQ ID NO: 305895 - protein, 8 aa, Influenza virus
TDGSASGQ

SEQ ID NO: 305896 - protein, 8 aa, Influenza virus
DGSASSRA

SEQ ID NO: 305897 - protein, 8 aa, Influenza virus
ASSRAYTK

SEQ ID NO: 305898 - protein, 8 aa, Influenza virus
EWSCYGHS

SEQ ID NO: 305899 - protein, 8 aa, Influenza virus
VSCVCRDN

SEQ ID NO: 305900 - protein, 8 aa, Influenza virus
PIIEIDMS

SEQ ID NO: 305901 - protein, 8 aa, Influenza virus
LEHTSKYV

SEQ ID NO: 305902 - protein, 8 aa, Influenza virus
DHTSQYLC

SEQ ID NO: 305903 - protein, 8 aa, Influenza virus
HTSKYVCT

SEQ ID NO: 305904 - protein, 8 aa, Influenza virus
TSKYVCTG

SEQ ID NO: 305905 - protein, 8 aa, Influenza virus
YVCTGVLT

SEQ ID NO: 305906 - protein, 8 aa, Influenza virus
VCTGVLTD

SEQ ID NO: 305907 - protein, 8 aa, Influenza virus
DTSRPGDR

SEQ ID NO: 305908 - protein, 8 aa, Influenza virus
PITGSPCA

SEQ ID NO: 305909 - protein, 8 aa, Influenza virus
ITGSPGSP

SEQ ID NO: 305910 - protein, 8 aa, Influenza virus
TGSPCAPG

SEQ ID NO: 305911 - protein, 8 aa, Influenza virus
SPGVKGFG

SEQ ID NO: 305912 - protein, 8 aa, Influenza virus
VKGFGFLS

SEQ ID NO: 305913 - protein, 8 aa, Influenza virus
KGFGFLSG

SEQ ID NO: 305914 - protein, 8 aa, Influenza virus
NNTWLGRT

SEQ ID NO: 305915 - protein, 8 aa, Influenza virus
TISPRSRN

SEQ ID NO: 305916 - protein, 8 aa, Influenza virus
ISPRSRNG

SEQ ID NO: 305917 - protein, 8 aa, Influenza virus
SPRSRNGF

SEQ ID NO: 305918 - protein, 8 aa, Influenza virus
PRSRNGFE

SEQ ID NO: 305919 - protein, 8 aa, Influenza virus
RSRNGFEM

SEQ ID NO: 305920 - protein, 8 aa, Influenza virus
MLRIPNAG

SEQ ID NO: 305921 - protein, 8 aa, Influenza virus
LKIHNAGT

SEQ ID NO: 305922 - protein, 8 aa, Influenza virus
KIHNAGTD

SEQ ID NO: 305923 - protein, 8 aa, Influenza virus
IHNAGTDP

SEQ ID NO: 305924 - protein, 8 aa, Influenza virus
NAGIDPNS

SEQ ID NO: 305925 - protein, 8 aa, Influenza virus
GRQEIVDN

SEQ ID NO: 305926 - protein, 8 aa, Influenza virus
RQEIVDNS

SEQ ID NO: 305927 - protein, 8 aa, Influenza virus
QEIVDNKN

SEQ ID NO: 305928 - protein, 8 aa, Influenza virus
EIVDNSNW

SEQ ID NO: 305929 - protein, 8 aa, Influenza virus
IVDNKNWS

SEQ ID NO: 305930 - protein, 8 aa, Influenza virus
VDNKNWSG

SEQ ID NO: 305931 - protein, 8 aa, Influenza virus
DNKNWSGY

SEQ ID NO: 305932 - protein, 8 aa, Influenza virus
NSNWSGYS

SEQ ID NO: 305933 - protein, 8 aa, Influenza virus
SNWSGYSG

SEQ ID NO: 305934 - protein, 8 aa, Influenza virus
WWASNSLI

SEQ ID NO: 305935 - protein, 8 aa, Influenza virus
PIGSGFFP

SEQ ID NO: 305936 - protein, 8 aa, Influenza virus
TLASTNAY

SEQ ID NO: 305937 - protein, 8 aa, Influenza virus
LLMSTNAY

SEQ ID NO: 305938 - protein, 8 aa, Influenza virus
LASTNAHD

SEQ ID NO: 305939 - protein, 8 aa, Influenza virus
ASTNAHDR

SEQ ID NO: 305940 - protein, 8 aa, Influenza virus
TDTVNTLM

SEQ ID NO: 305941 - protein, 8 aa, Influenza virus
DTVNTLTE

SEQ ID NO: 305942 - protein, 8 aa, Influenza virus
TVNTLMEQ

SEQ ID NO: 305943 - protein, 8 aa, Influenza virus
VDTLIEQN

SEQ ID NO: 305944 - protein, 8 aa, Influenza virus
TLIEQKVP

SEQ ID NO: 305945 - protein, 8 aa, Influenza virus
LIEQNIPV

SEQ ID NO: 305946 - protein, 8 aa, Influenza virus
MEQNVPVT

SEQ ID NO: 305947 - protein, 8 aa, Influenza virus
QNIPVTQT

SEQ ID NO: 305948 - protein, 8 aa, Influenza virus
KVPVTQTM

SEQ ID NO: 305949 - protein, 8 aa, Influenza virus
AMELVEAE

SEQ ID NO: 305950 - protein, 8 aa, Influenza virus
ELVETEKN

SEQ ID NO: 305951 - protein, 8 aa, Influenza virus
EKNPAYCN

SEQ ID NO: 305952 - protein, 8 aa, Influenza virus
KNPAYCNT

SEQ ID NO: 305953 - protein, 8 aa, Influenza virus
NPAYCNTD

SEQ ID NO: 305954 - protein, 8 aa, Influenza virus
PKCDIHLR

SEQ ID NO: 305955 - protein, 8 aa, Influenza virus
KCDIHLRD

SEQ ID NO: 305956 - protein, 8 aa, Influenza virus
CDIHLRDQ

SEQ ID NO: 305957 - protein, 8 aa, Influenza virus
HLRDQGWS

SEQ ID NO: 305958 - protein, 8 aa, Influenza virus
LRDQGWSY

SEQ ID NO: 305959 - protein, 8 aa, Influenza virus
KDQAWSYI

SEQ ID NO: 305960 - protein, 8 aa, Influenza virus
DQAWSYIV

SEQ ID NO: 305961 - protein, 8 aa, Influenza virus
QAWSYIVE

SEQ ID NO: 305962 - protein, 8 aa, Influenza virus
AWSYIVER

SEQ ID NO: 305963 - protein, 8 aa, Influenza virus
SAASYKRV

SEQ ID NO: 305964 - protein, 8 aa, Influenza virus
VRLFDYSR

SEQ ID NO: 305965 - protein, 8 aa, Influenza virus
DYSGWNVT

SEQ ID NO: 305966 - protein, 8 aa, Influenza virus
ACNASTGA

SEQ ID NO: 305967 - protein, 8 aa, Influenza virus
CNASTGAQ

SEQ ID NO: 305968 - protein, 8 aa, Influenza virus
NALTGGQS

SEQ ID NO: 305969 - protein, 8 aa, Influenza virus
ASTGAQSF

SEQ ID NO: 305970 - protein, 8 aa, Influenza virus
STGAQSFY

SEQ ID NO: 305971 - protein, 8 aa, Influenza virus
LTKKEPDT

SEQ ID NO: 305972 - protein, 8 aa, Influenza virus
TKKKPDIY

SEQ ID NO: 305973 - protein, 8 aa, Influenza virus
KKEPDTYD

SEQ ID NO: 305974 - protein, 8 aa, Influenza virus
KEPDTYDF

SEQ ID NO: 305975 - protein, 8 aa, Influenza virus
EPDTYDFN

SEQ ID NO: 305976 - protein, 8 aa, Influenza virus
AYNFNEGS

SEQ ID NO: 305977 - protein, 8 aa, Influenza virus
YNFNEGSY

SEQ ID NO: 305978 - protein, 8 aa, Influenza virus
FNEGAYVN

SEQ ID NO: 305979 - protein, 8 aa, Influenza virus
NEGAYVNN

SEQ ID NO: 305980 - protein, 8 aa, Influenza virus
NNEEGDII

SEQ ID NO: 305981 - protein, 8 aa, Influenza virus
NENGDIIF

SEQ ID NO: 305982 - protein, 8 aa, Influenza virus
ENGDIIFL

SEQ ID NO: 305983 - protein, 8 aa, Influenza virus
EGDIIFLW

SEQ ID NO: 305984 - protein, 8 aa, Influenza virus
GIHHPPDE

SEQ ID NO: 305985 - protein, 8 aa, Influenza virus
IHHPPDET

SEQ ID NO: 305986 - protein, 8 aa, Influenza virus
HHPPDETE

SEQ ID NO: 305987 - protein, 8 aa, Influenza virus
HPPDETEQ

SEQ ID NO: 305988 - protein, 8 aa, Influenza virus
PPDETEQT

SEQ ID NO: 305989 - protein, 8 aa, Influenza virus
ETEQTKLY

SEQ ID NO: 305990 - protein, 8 aa, Influenza virus
ANTLTSVT

SEQ ID NO: 305991 - protein, 8 aa, Influenza virus
TTNTINRN

SEQ ID NO: 305992 - protein, 8 aa, Influenza virus
NTINRNFQ

SEQ ID NO: 305993 - protein, 8 aa, Influenza virus
TINRNFQP

SEQ ID NO: 305994 - protein, 8 aa, Influenza virus
INRNFQPN

SEQ ID NO: 305995 - protein, 8 aa, Influenza virus
NRNFQPNI

SEQ ID NO: 305996 - protein, 8 aa, Influenza virus
RNFQPNIG

SEQ ID NO: 305997 - protein, 8 aa, Influenza virus
NFQPNIGP

SEQ ID NO: 305998 - protein, 8 aa, Influenza virus
LVREQQGR

SEQ ID NO: 305999 - protein, 8 aa, Influenza virus
VRGQQGTM

SEQ ID NO: 306000 - protein, 8 aa, Influenza virus
RGQQGTMD

SEQ ID NO: 306001 - protein, 8 aa, Influenza virus
GQQGTMDY

SEQ ID NO: 306002 - protein, 8 aa, Influenza virus
LLKGESHC

SEQ ID NO: 306003 - protein, 8 aa, Influenza virus
LKGESHGK

SEQ ID NO: 306004 - protein, 8 aa, Influenza virus
GESHGRTI

SEQ ID NO: 306005 - protein, 8 aa, Influenza virus
ESHGKIIQ

SEQ ID NO: 306006 - protein, 8 aa, Influenza virus
SHCRIIQN

SEQ ID NO: 306007 - protein, 8 aa, Influenza virus
HGRTIQNE

SEQ ID NO: 306008 - protein, 8 aa, Influenza virus
GRTIQNED

SEQ ID NO: 306009 - protein, 8 aa, Influenza virus
NCKTKCQT

SEQ ID NO: 306010 - protein, 8 aa, Influenza virus
CYTKCQTY

SEQ ID NO: 306011 - protein, 8 aa, Influenza virus
HTKCQTYT

SEQ ID NO: 306012 - protein, 8 aa, Influenza virus
AGAVNSSK

SEQ ID NO: 306013 - protein, 8 aa, Influenza virus
AINSSKPL

SEQ ID NO: 306014 - protein, 8 aa, Influenza virus
VNSSKPFQ

SEQ ID NO: 306015 - protein, 8 aa, Influenza virus
SSKPLQNA

SEQ ID NO: 306016 - protein, 8 aa, Influenza virus
SKPLQNAS

SEQ ID NO: 306017 - protein, 8 aa, Influenza virus
KPLQNASR

SEQ ID NO: 306018 - protein, 8 aa, Influenza virus
PFQNTSRH

SEQ ID NO: 306019 - protein, 8 aa, Influenza virus
LQNASRHY

SEQ ID NO: 306020 - protein, 8 aa, Influenza virus
QNTSRHYM

SEQ ID NO: 306021 - protein, 8 aa, Influenza virus
NTSRHYMG

SEQ ID NO: 306022 - protein, 8 aa, Influenza virus
ASRHHMGE

SEQ ID NO: 306023 - protein, 8 aa, Influenza virus
YYMGECPK

SEQ ID NO: 306024 - protein, 8 aa, Influenza virus
YMGECPNY

SEQ ID NO: 306025 - protein, 8 aa, Influenza virus
MGECPEYV

SEQ ID NO: 306026 - protein, 8 aa, Influenza virus
GECPEYVK

SEQ ID NO: 306027 - protein, 8 aa, Influenza virus
ECPKYAKK

SEQ ID NO: 306028 - protein, 8 aa, Influenza virus
YAKKASLR

SEQ ID NO: 306029 - protein, 8 aa, Influenza virus
AKKASLRL

SEQ ID NO: 306030 - protein, 8 aa, Influenza virus
KESLRLAI

SEQ ID NO: 306031 - protein, 8 aa, Influenza virus
ESLRLAIG

SEQ ID NO: 306032 - protein, 8 aa, Influenza virus
NTPSIEPR

SEQ ID NO: 306033 - protein, 8 aa, Influenza virus
TPSIEPRG

SEQ ID NO: 306034 - protein, 8 aa, Influenza virus
PSIEPRGL

SEQ ID NO: 306035 - protein, 8 aa, Influenza virus
SIEPRGLF

SEQ ID NO: 306036 - protein, 8 aa, Influenza virus
IEPRGLFG

SEQ ID NO: 306037 - protein, 8 aa, Influenza virus
KSTQEAIE

SEQ ID NO: 306038 - protein, 8 aa, Influenza virus
STQEAINK

SEQ ID NO: 306039 - protein, 8 aa, Influenza virus
TQEAINKI

SEQ ID NO: 306040 - protein, 8 aa, Influenza virus
QEAINKIT

SEQ ID NO: 306041 - protein, 8 aa, Influenza virus
EAIEKITN

SEQ ID NO: 306042 - protein, 8 aa, Influenza virus
AIGKITNK

SEQ ID NO: 306043 - protein, 8 aa, Influenza virus
IGKITNKV

SEQ ID NO: 306044 - protein, 8 aa, Influenza virus
EKITNKVN

SEQ ID NO: 306045 - protein, 8 aa, Influenza virus
NREFEVVD

SEQ ID NO: 306046 - protein, 8 aa, Influenza virus
REFEVVDH

SEQ ID NO: 306047 - protein, 8 aa, Influenza virus
EFEVVDHE

SEQ ID NO: 306048 - protein, 8 aa, Influenza virus
FEVVDHEF

SEQ ID NO: 306049 - protein, 8 aa, Influenza virus
EVVDHEFS

SEQ ID NO: 306050 - protein, 8 aa, Influenza virus
VVNHEFSG

SEQ ID NO: 306051 - protein, 8 aa, Influenza virus
HEFSGVEK

SEQ ID NO: 306052 - protein, 8 aa, Influenza virus
EKRINVIN

SEQ ID NO: 306053 - protein, 8 aa, Influenza virus
KKINMIND

SEQ ID NO: 306054 - protein, 8 aa, Influenza virus
RINMISDK

SEQ ID NO: 306055 - protein, 8 aa, Influenza virus
TNMINDKI

SEQ ID NO: 306056 - protein, 8 aa, Influenza virus
NVINDKID

SEQ ID NO: 306057 - protein, 8 aa, Influenza virus
VINDKIDD

SEQ ID NO: 306058 - protein, 8 aa, Influenza virus
KIDDQIEG

SEQ ID NO: 306059 - protein, 8 aa, Influenza virus
IDDQIEGL

SEQ ID NO: 306060 - protein, 8 aa, Influenza virus
DDQIENLW

SEQ ID NO: 306061 - protein, 8 aa, Influenza virus
DQIEELWA

SEQ ID NO: 306062 - protein, 8 aa, Influenza virus
QIEELWAY

SEQ ID NO: 306063 - protein, 8 aa, Influenza virus
IEELWAYN

SEQ ID NO: 306064 - protein, 8 aa, Influenza virus
EELWAYNA

SEQ ID NO: 306065 - protein, 8 aa, Influenza virus
ELWAYNAE

SEQ ID NO: 306066 - protein, 8 aa, Influenza virus
EVRRRLST

SEQ ID NO: 306067 - protein, 8 aa, Influenza virus
VRRRLSTN

SEQ ID NO: 306068 - protein, 8 aa, Influenza virus
RRRLSTNA

SEQ ID NO: 306069 - protein, 8 aa, Influenza virus
RRLSANAV

SEQ ID NO: 306070 - protein, 8 aa, Influenza virus
RLSANAVD

SEQ ID NO: 306071 - protein, 8 aa, Influenza virus
NAIDTGKG

SEQ ID NO: 306072 - protein, 8 aa, Influenza virus
AVDTGNGC

SEQ ID NO: 306073 - protein, 8 aa, Influenza virus
VDTGNGCF

SEQ ID NO: 306074 - protein, 8 aa, Influenza virus
NGTYNHKD

SEQ ID NO: 306075 - protein, 8 aa, Influenza virus
GTYDHKDY

SEQ ID NO: 306076 - protein, 8 aa, Influenza virus
TYDHKDYE

SEQ ID NO: 306077 - protein, 8 aa, Influenza virus
YNRKEYEE

SEQ ID NO: 306078 - protein, 8 aa, Influenza virus
DHKDYEEE

SEQ ID NO: 306079 - protein, 8 aa, Influenza virus
KSRINGVK

SEQ ID NO: 306080 - protein, 8 aa, Influenza virus
SRINGVKL

SEQ ID NO: 306081 - protein, 8 aa, Influenza virus
RINGVKLE

SEQ ID NO: 306082 - protein, 8 aa, Influenza virus
INEVKLEE

SEQ ID NO: 306083 - protein, 8 aa, Influenza virus
NGVRLEEN

SEQ ID NO: 306084 - protein, 8 aa, Influenza virus
GVILEENT

SEQ ID NO: 306085 - protein, 8 aa, Influenza virus
VILEENTT

SEQ ID NO: 306086 - protein, 8 aa, Influenza virus
RLEENTTY

SEQ ID NO: 306087 - protein, 8 aa, Influenza virus
VHQSTNST

SEQ ID NO: 306088 - protein, 8 aa, Influenza virus
TNSTETVY

SEQ ID NO: 306089 - protein, 8 aa, Influenza virus
NSTETVYT

SEQ ID NO: 306090 - protein, 8 aa, Influenza virus
EHNGLLCA

SEQ ID NO: 306091 - protein, 8 aa, Influenza virus
VEGLVYGN

SEQ ID NO: 306092 - protein, 8 aa, Influenza virus
IYGNPSCN

SEQ ID NO: 306093 - protein, 8 aa, Influenza virus
GWSYIVER

SEQ ID NO: 306094 - protein, 8 aa, Influenza virus
YIIERPSA

SEQ ID NO: 306095 - protein, 8 aa, Influenza virus
SFYRGMRW

SEQ ID NO: 306096 - protein, 8 aa, Influenza virus
FYKSMRWL

SEQ ID NO: 306097 - protein, 8 aa, Influenza virus
YKSMRWLT

SEQ ID NO: 306098 - protein, 8 aa, Influenza virus
GRIDYYWP

SEQ ID NO: 306099 - protein, 8 aa, Influenza virus
SLLKPGQT

SEQ ID NO: 306100 - protein, 8 aa, Influenza virus
QTLRVKSN

SEQ ID NO: 306101 - protein, 8 aa, Influenza virus
TLRVKSNG

SEQ ID NO: 306102 - protein, 8 aa, Influenza virus
LRVKSNGN

SEQ ID NO: 306103 - protein, 8 aa, Influenza virus
RVKSNGNL

SEQ ID NO: 306104 - protein, 8 aa, Influenza virus
VKSNGNLI

SEQ ID NO: 306105 - protein, 8 aa, Influenza virus
RSNENLIA

SEQ ID NO: 306106 - protein, 8 aa, Influenza virus
NENLIAPW

SEQ ID NO: 306107 - protein, 8 aa, Influenza virus
LIAPLYGH

SEQ ID NO: 306108 - protein, 8 aa, Influenza virus
GGLNTILP

SEQ ID NO: 306109 - protein, 8 aa, Influenza virus
GLNITLPF

SEQ ID NO: 306110 - protein, 8 aa, Influenza virus
LNTILPFH

SEQ ID NO: 306111 - protein, 8 aa, Influenza virus
NTILPFHN

SEQ ID NO: 306112 - protein, 8 aa, Influenza virus
TLPFQNIS

SEQ ID NO: 306113 - protein, 8 aa, Influenza virus
LPFQNISK

SEQ ID NO: 306114 - protein, 8 aa, Influenza virus
PFQNISKY

SEQ ID NO: 306115 - protein, 8 aa, Influenza virus
FQNISKYA

SEQ ID NO: 306116 - protein, 8 aa, Influenza virus
QNISKYAF

SEQ ID NO: 306117 - protein, 8 aa, Influenza virus
ISKYAFGI

SEQ ID NO: 306118 - protein, 8 aa, Influenza virus
SRYAFGNC

SEQ ID NO: 306119 - protein, 8 aa, Influenza virus
KYAFGICP

SEQ ID NO: 306120 - protein, 8 aa, Influenza virus
YAFGICPK

SEQ ID NO: 306121 - protein, 8 aa, Influenza virus
AFGICPKY

SEQ ID NO: 306122 - protein, 8 aa, Influenza virus
NSLKLAIG

SEQ ID NO: 306123 - protein, 8 aa, Influenza virus
LKLAVGLK

SEQ ID NO: 306124 - protein, 8 aa, Influenza virus
KLAVGLKN

SEQ ID NO: 306125 - protein, 8 aa, Influenza virus
YGFQHTND

SEQ ID NO: 306126 - protein, 8 aa, Influenza virus
GFQHTNDQ

SEQ ID NO: 306127 - protein, 8 aa, Influenza virus
QGIGMAAD

SEQ ID NO: 306128 - protein, 8 aa, Influenza virus
DKVDDQIQ

SEQ ID NO: 306129 - protein, 8 aa, Influenza virus
KIEDQIQD

SEQ ID NO: 306130 - protein, 8 aa, Influenza virus
DDQIQDLW

SEQ ID NO: 306131 - protein, 8 aa, Influenza virus
DQIQDLWA

SEQ ID NO: 306132 - protein, 8 aa, Influenza virus
QIQDLWAY

SEQ ID NO: 306133 - protein, 8 aa, Influenza virus
IQDLWAYN

SEQ ID NO: 306134 - protein, 8 aa, Influenza virus
QDLWAYNA

SEQ ID NO: 306135 - protein, 8 aa, Influenza virus
DLWAYNAE

SEQ ID NO: 306136 - protein, 8 aa, Influenza virus
VLLENQKP

SEQ ID NO: 306137 - protein, 8 aa, Influenza virus
QKTLDEHV

SEQ ID NO: 306138 - protein, 8 aa, Influenza virus
KPLDEHDA

SEQ ID NO: 306139 - protein, 8 aa, Influenza virus
TLDEHDSN

SEQ ID NO: 306140 - protein, 8 aa, Influenza virus
LDEHVANV

SEQ ID NO: 306141 - protein, 8 aa, Influenza virus
DEHDANAN

SEQ ID NO: 306142 - protein, 8 aa, Influenza virus
NNLYNRVK

SEQ ID NO: 306143 - protein, 8 aa, Influenza virus
NGNGCFEL

SEQ ID NO: 306144 - protein, 8 aa, Influenza virus
FELYHKCN

SEQ ID NO: 306145 - protein, 8 aa, Influenza virus
ELYHRCDD

SEQ ID NO: 306146 - protein, 8 aa, Influenza virus
CMEAIRNG

SEQ ID NO: 306147 - protein, 8 aa, Influenza virus
MEAIRNGT

SEQ ID NO: 306148 - protein, 8 aa, Influenza virus
ETTRNGTY

SEQ ID NO: 306149 - protein, 8 aa, Influenza virus
TTRNGTYN

SEQ ID NO: 306150 - protein, 8 aa, Influenza virus
EGAYKILT

SEQ ID NO: 306151 - protein, 8 aa, Influenza virus
YSTVASSF

SEQ ID NO: 306152 - protein, 8 aa, Influenza virus
STVASSFV

SEQ ID NO: 306153 - protein, 8 aa, Influenza virus
AAFLFWTM

SEQ ID NO: 306154 - protein, 8 aa, Influenza virus
AFLFWVMS

SEQ ID NO: 306155 - protein, 8 aa, Influenza virus
VHQSTNST

SEQ ID NO: 306156 - protein, 8 aa, Influenza virus
TNSTETVY

SEQ ID NO: 306157 - protein, 8 aa, Influenza virus
NSTETVYT

SEQ ID NO: 306158 - protein, 8 aa, Influenza virus
ELLHAEHN

SEQ ID NO: 306159 - protein, 8 aa, Influenza virus
EHNGLLCA

SEQ ID NO: 306160 - protein, 8 aa, Influenza virus
VEGLVYGN

SEQ ID NO: 306161 - protein, 8 aa, Influenza virus
IYGNPSCN

SEQ ID NO: 306162 - protein, 8 aa, Influenza virus
GWSYIVER

SEQ ID NO: 306163 - protein, 8 aa, Influenza virus
YIIERPSA

SEQ ID NO: 306164 - protein, 8 aa, Influenza virus
SFYRGMRW

SEQ ID NO: 306165 - protein, 8 aa, Influenza virus
FYKSMRWL

SEQ ID NO: 306166 - protein, 8 aa, Influenza virus
YKSMRWLT

SEQ ID NO: 306167 - protein, 8 aa, Influenza virus
GRIDYYWP

SEQ ID NO: 306168 - protein, 8 aa, Influenza virus
YYWPVLKP

SEQ ID NO: 306169 - protein, 8 aa, Influenza virus
SLLKPGQT

SEQ ID NO: 306170 - protein, 8 aa, Influenza virus
QTLRVKSN

SEQ ID NO: 306171 - protein, 8 aa, Influenza virus
TLRVKSNG

SEQ ID NO: 306172 - protein, 8 aa, Influenza virus
LRVKSNGN

SEQ ID NO: 306173 - protein, 8 aa, Influenza virus
RVKSNGNL

SEQ ID NO: 306174 - protein, 8 aa, Influenza virus
VKSNGNLI

SEQ ID NO: 306175 - protein, 8 aa, Influenza virus
RSNENLIA

SEQ ID NO: 306176 - protein, 8 aa, Influenza virus
NENLIAPW

SEQ ID NO: 306177 - protein, 8 aa, Influenza virus
LIAPWYGY

SEQ ID NO: 306178 - protein, 8 aa, Influenza virus
GGLNTILP

SEQ ID NO: 306179 - protein, 8 aa, Influenza virus
GLNITLPF

SEQ ID NO: 306180 - protein, 8 aa, Influenza virus
LNTILPFH

SEQ ID NO: 306181 - protein, 8 aa, Influenza virus
NTILPFHN

SEQ ID NO: 306182 - protein, 8 aa, Influenza virus
TLPFQNIS

SEQ ID NO: 306183 - protein, 8 aa, Influenza virus
LPFQNISK

SEQ ID NO: 306184 - protein, 8 aa, Influenza virus
PFQNISKY

SEQ ID NO: 306185 - protein, 8 aa, Influenza virus
FQNISKYA

SEQ ID NO: 306186 - protein, 8 aa, Influenza virus
QNISKYAF

SEQ ID NO: 306187 - protein, 8 aa, Influenza virus
ISKYAFGI

SEQ ID NO: 306188 - protein, 8 aa, Influenza virus
SRYAFGNC

SEQ ID NO: 306189 - protein, 8 aa, Influenza virus
KYAFGICP

SEQ ID NO: 306190 - protein, 8 aa, Influenza virus
YAFGICPK

SEQ ID NO: 306191 - protein, 8 aa, Influenza virus
AFGICPKY

SEQ ID NO: 306192 - protein, 8 aa, Influenza virus
NSLKLAIG

SEQ ID NO: 306193 - protein, 8 aa, Influenza virus
LKLAVGLK

SEQ ID NO: 306194 - protein, 8 aa, Influenza virus
KLAVGLKN

SEQ ID NO: 306195 - protein, 8 aa, Influenza virus
LAVGLKNV

SEQ ID NO: 306196 - protein, 8 aa, Influenza virus
YGFQHTND

SEQ ID NO: 306197 - protein, 8 aa, Influenza virus
GFQHTNDQ

SEQ ID NO: 306198 - protein, 8 aa, Influenza virus
QGIGMAAD

SEQ ID NO: 306199 - protein, 8 aa, Influenza virus
KVNNMVDK

SEQ ID NO: 306200 - protein, 8 aa, Influenza virus
DKVDDQIQ

SEQ ID NO: 306201 - protein, 8 aa, Influenza virus
KIEDQIQD

SEQ ID NO: 306202 - protein, 8 aa, Influenza virus
DDQIQDLW

SEQ ID NO: 306203 - protein, 8 aa, Influenza virus
DQIQDLWA

SEQ ID NO: 306204 - protein, 8 aa, Influenza virus
QIQDLWAY

SEQ ID NO: 306205 - protein, 8 aa, Influenza virus
IQDLWAYN

SEQ ID NO: 306206 - protein, 8 aa, Influenza virus
QDLWAYNA

SEQ ID NO: 306207 - protein, 8 aa, Influenza virus
DLWAYNAE

SEQ ID NO: 306208 - protein, 8 aa, Influenza virus
KTLDEHDS

SEQ ID NO: 306209 - protein, 8 aa, Influenza virus
TLDEHVAN

SEQ ID NO: 306210 - protein, 8 aa, Influenza virus
DEHEANVN

SEQ ID NO: 306211 - protein, 8 aa, Influenza virus
DANVNKLY

SEQ ID NO: 306212 - protein, 8 aa, Influenza virus
ANVNKLYN

SEQ ID NO: 306213 - protein, 8 aa, Influenza virus
VHNLYNKV

SEQ ID NO: 306214 - protein, 8 aa, Influenza virus
NNLYKKVK

SEQ ID NO: 306215 - protein, 8 aa, Influenza virus
NGNGCFEL

SEQ ID NO: 306216 - protein, 8 aa, Influenza virus
FELYHKCN

SEQ ID NO: 306217 - protein, 8 aa, Influenza virus
ELYHRCDD

SEQ ID NO: 306218 - protein, 8 aa, Influenza virus
CMEAIRNG

SEQ ID NO: 306219 - protein, 8 aa, Influenza virus
MEAIRNGT

SEQ ID NO: 306220 - protein, 8 aa, Influenza virus
ETTRNGTY

SEQ ID NO: 306221 - protein, 8 aa, Influenza virus
TTRNGTYN

SEQ ID NO: 306222 - protein, 8 aa, Influenza virus
SEETYKIL

SEQ ID NO: 306223 - protein, 8 aa, Influenza virus
EGAYKILT

SEQ ID NO: 306224 - protein, 8 aa, Influenza virus
YSTVASSF

SEQ ID NO: 306225 - protein, 8 aa, Influenza virus
STVASSFV

SEQ ID NO: 306226 - protein, 8 aa, Influenza virus
AAFLFWTM

SEQ ID NO: 306227 - protein, 8 aa, Influenza virus
AFLFWVMS

SEQ ID NO: 306228 - protein, 8 aa, Influenza virus
SKPQCQIA

SEQ ID NO: 306229 - protein, 8 aa, Influenza virus
PQCQITGS

SEQ ID NO: 306230 - protein, 8 aa, Influenza virus
QCLITGFA

SEQ ID NO: 306231 - protein, 8 aa, Influenza virus
CQIAGFAP

SEQ ID NO: 306232 - protein, 8 aa, Influenza virus
GFAPLSKD

SEQ ID NO: 306233 - protein, 8 aa, Influenza virus
SIRLAAAG

SEQ ID NO: 306234 - protein, 8 aa, Influenza virus
RLSAGGGI

SEQ ID NO: 306235 - protein, 8 aa, Influenza virus
LSAGGGIW

SEQ ID NO: 306236 - protein, 8 aa, Influenza virus
ITREPYVS

SEQ ID NO: 306237 - protein, 8 aa, Influenza virus
REPYVSCN

SEQ ID NO: 306238 - protein, 8 aa, Influenza virus
TCYQFALG

SEQ ID NO: 306239 - protein, 8 aa, Influenza virus
SYRTLLMS

SEQ ID NO: 306240 - protein, 8 aa, Influenza virus
NELGVPFN

SEQ ID NO: 306241 - protein, 8 aa, Influenza virus
TRQVCIAW

SEQ ID NO: 306242 - protein, 8 aa, Influenza virus
QQVCIAWS

SEQ ID NO: 306243 - protein, 8 aa, Influenza virus
SASCHDGR

SEQ ID NO: 306244 - protein, 8 aa, Influenza virus
ASCHDGRA

SEQ ID NO: 306245 - protein, 8 aa, Influenza virus
CHDGKEWL

SEQ ID NO: 306246 - protein, 8 aa, Influenza virus
HDGKEWLH

SEQ ID NO: 306247 - protein, 8 aa, Influenza virus
WLHVCVSG

SEQ ID NO: 306248 - protein, 8 aa, Influenza virus
LHVCVSGD

SEQ ID NO: 306249 - protein, 8 aa, Influenza virus
HVCVSGDD

SEQ ID NO: 306250 - protein, 8 aa, Influenza virus
NILITQES

SEQ ID NO: 306251 - protein, 8 aa, Influenza virus
ESECVCID

SEQ ID NO: 306252 - protein, 8 aa, Influenza virus
SECVCIDG

SEQ ID NO: 306253 - protein, 8 aa, Influenza virus
ECVCINGI

SEQ ID NO: 306254 - protein, 8 aa, Influenza virus
CVCINGIC

SEQ ID NO: 306255 - protein, 8 aa, Influenza virus
INGICTVV

SEQ ID NO: 306256 - protein, 8 aa, Influenza virus
NGICTVVM

SEQ ID NO: 306257 - protein, 8 aa, Influenza virus
GTCTAVMT

SEQ ID NO: 306258 - protein, 8 aa, Influenza virus
TCTAVMTD

SEQ ID NO: 306259 - protein, 8 aa, Influenza virus
CAVVMTVG

SEQ ID NO: 306260 - protein, 8 aa, Influenza virus
AVVMTDGG

SEQ ID NO: 306261 - protein, 8 aa, Influenza virus
AVMTDGSA

SEQ ID NO: 306262 - protein, 8 aa, Influenza virus
VMTDGSSS

SEQ ID NO: 306263 - protein, 8 aa, Influenza virus
GGAQHVEE

SEQ ID NO: 306264 - protein, 8 aa, Influenza virus
GAQHVEEC

SEQ ID NO: 306265 - protein, 8 aa, Influenza virus
ECSCYPRH

SEQ ID NO: 306266 - protein, 8 aa, Influenza virus
CDCRDNWK

SEQ ID NO: 306267 - protein, 8 aa, Influenza virus
GKGSNRPL

SEQ ID NO: 306268 - protein, 8 aa, Influenza virus
LVGDTPRT

SEQ ID NO: 306269 - protein, 8 aa, Influenza virus
DAWMGRTI

SEQ ID NO: 306270 - protein, 8 aa, Influenza virus
IVWWTSNS

SEQ ID NO: 306271 - protein, 8 aa, Influenza virus
VLWTSNSI

SEQ ID NO: 306272 - protein, 8 aa, Influenza virus
FCGTPGTY

SEQ ID NO: 306273 - protein, 8 aa, Influenza virus
CGTPGTYG

SEQ ID NO: 306274 - protein, 8 aa, Influenza virus
TTGTYGTG

SEQ ID NO: 306275 - protein, 8 aa, Influenza virus
GTHGTGSW

SEQ ID NO: 306276 - protein, 8 aa, Influenza virus
THGTGSWP

SEQ ID NO: 306277 - protein, 8 aa, Influenza virus
YGTGSWAD

SEQ ID NO: 306278 - protein, 8 aa, Influenza virus
GTGSWADG

SEQ ID NO: 306279 - protein, 8 aa, Influenza virus
TGSWPDRA

SEQ ID NO: 306280 - protein, 8 aa, Influenza virus
SWADGANI

SEQ ID NO: 306281 - protein, 8 aa, Influenza virus
EIAQRLEG

SEQ ID NO: 306282 - protein, 8 aa, Influenza virus
IAQRLEGV

SEQ ID NO: 306283 - protein, 8 aa, Influenza virus
AQRLEGVF

SEQ ID NO: 306284 - protein, 8 aa, Influenza virus
QRLEGVFA

SEQ ID NO: 306285 - protein, 8 aa, Influenza virus
RLEGVFAG

SEQ ID NO: 306286 - protein, 8 aa, Influenza virus
LENVFAGK

SEQ ID NO: 306287 - protein, 8 aa, Influenza virus
ENVFAGKN

SEQ ID NO: 306288 - protein, 8 aa, Influenza virus
GKNTDLEV

SEQ ID NO: 306289 - protein, 8 aa, Influenza virus
KNTDLEVL

SEQ ID NO: 306290 - protein, 8 aa, Influenza virus
NTDLEVLM

SEQ ID NO: 306291 - protein, 8 aa, Influenza virus
NNMARAVK

SEQ ID NO: 306292 - protein, 8 aa, Influenza virus
DKAVKLYK

SEQ ID NO: 306293 - protein, 8 aa, Influenza virus
KAVKLYKK

SEQ ID NO: 306294 - protein, 8 aa, Influenza virus
FHGAKEIS

SEQ ID NO: 306295 - protein, 8 aa, Influenza virus
HGAKEISL

SEQ ID NO: 306296 - protein, 8 aa, Influenza virus
GAKEVALG

SEQ ID NO: 306297 - protein, 8 aa, Influenza virus
AKEVALGY

SEQ ID NO: 306298 - protein, 8 aa, Influenza virus
KEVALGYS

SEQ ID NO: 306299 - protein, 8 aa, Influenza virus
EVALSYSA

SEQ ID NO: 306300 - protein, 8 aa, Influenza virus
VALSYSAG

SEQ ID NO: 306301 - protein, 8 aa, Influenza virus
ALGYSTGA

SEQ ID NO: 306302 - protein, 8 aa, Influenza virus
YNRMGTIT

SEQ ID NO: 306303 - protein, 8 aa, Influenza virus
QIADSHHR

SEQ ID NO: 306304 - protein, 8 aa, Influenza virus
IADSHHRS

SEQ ID NO: 306305 - protein, 8 aa, Influenza virus
ADSHHRSH

SEQ ID NO: 306306 - protein, 8 aa, Influenza virus
DSHHRSHR

SEQ ID NO: 306307 - protein, 8 aa, Influenza virus
SHHRSHRQ

SEQ ID NO: 306308 - protein, 8 aa, Influenza virus
ATTNPLIR

SEQ ID NO: 306309 - protein, 8 aa, Influenza virus
ARQMVHAM

SEQ ID NO: 306310 - protein, 8 aa, Influenza virus
RMVQAMRA

SEQ ID NO: 306311 - protein, 8 aa, Influenza virus
MVQAMRTV

SEQ ID NO: 306312 - protein, 8 aa, Influenza virus
VQAMRTVG

SEQ ID NO: 306313 - protein, 8 aa, Influenza virus
QAMRTVGT

SEQ ID NO: 306314 - protein, 8 aa, Influenza virus
AMRAVGTH

SEQ ID NO: 306315 - protein, 8 aa, Influenza virus
MRAVGTHP

SEQ ID NO: 306316 - protein, 8 aa, Influenza virus
DDLIENLQ

SEQ ID NO: 306317 - protein, 8 aa, Influenza virus
DLIENLQA

SEQ ID NO: 306318 - protein, 8 aa, Influenza virus
LLDNLQAY

SEQ ID NO: 306319 - protein, 8 aa, Influenza virus
LDNLQAYQ

SEQ ID NO: 306320 - protein, 8 aa, Influenza virus
QKRMGLQM

SEQ ID NO: 306321 - protein, 8 aa, Influenza virus
KRMGLQMQ

SEQ ID NO: 306322 - protein, 8 aa, Influenza virus
RMGLQMQR

SEQ ID NO: 306323 - protein, 8 aa, Influenza virus
MGLQMQRF

SEQ ID NO: 306324 - protein, 8 aa, Influenza virus
GLQMQRFK

SEQ ID NO: 306325 - protein, 8 aa, Influenza virus
QLTEVETP

SEQ ID NO: 306326 - protein, 8 aa, Influenza virus
LTEVETHT

SEQ ID NO: 306327 - protein, 8 aa, Influenza virus
VLHLILWI

SEQ ID NO: 306328 - protein, 8 aa, Influenza virus
GMPESMRE

SEQ ID NO: 306329 - protein, 8 aa, Influenza virus
MPESMREE

SEQ ID NO: 306330 - protein, 8 aa, Influenza virus
SMREEYRE

SEQ ID NO: 306331 - protein, 8 aa, Influenza virus
MREEYREE

SEQ ID NO: 306332 - protein, 8 aa, Influenza virus
REEYREEQ

SEQ ID NO: 306333 - protein, 8 aa, Influenza virus
SDIEIMAS

SEQ ID NO: 306334 - protein, 8 aa, Influenza virus
DIGAMASQ

SEQ ID NO: 306335 - protein, 8 aa, Influenza virus
IEIMASQG

SEQ ID NO: 306336 - protein, 8 aa, Influenza virus
GAMASQGT

SEQ ID NO: 306337 - protein, 8 aa, Influenza virus
SQGTKRPY

SEQ ID NO: 306338 - protein, 8 aa, Influenza virus
SHEQMETG

SEQ ID NO: 306339 - protein, 8 aa, Influenza virus
HEQMETGG

SEQ ID NO: 306340 - protein, 8 aa, Influenza virus
EQMETSGE

SEQ ID NO: 306341 - protein, 8 aa, Influenza virus
QMETSGER

SEQ ID NO: 306342 - protein, 8 aa, Influenza virus
METSGERQ

SEQ ID NO: 306343 - protein, 8 aa, Influenza virus
RQNTTEIR

SEQ ID NO: 306344 - protein, 8 aa, Influenza virus
ATEIRTSV

SEQ ID NO: 306345 - protein, 8 aa, Influenza virus
RSSVGKMI

SEQ ID NO: 306346 - protein, 8 aa, Influenza virus
GGIGRFYV

SEQ ID NO: 306347 - protein, 8 aa, Influenza virus
CTELKLSE

SEQ ID NO: 306348 - protein, 8 aa, Influenza virus
NEGRLIQN

SEQ ID NO: 306349 - protein, 8 aa, Influenza virus
LVQNSITI

SEQ ID NO: 306350 - protein, 8 aa, Influenza virus
VQNSITIE

SEQ ID NO: 306351 - protein, 8 aa, Influenza virus
QNSMTIER

SEQ ID NO: 306352 - protein, 8 aa, Influenza virus
NSMTIERM

SEQ ID NO: 306353 - protein, 8 aa, Influenza virus
RYLEENPS

SEQ ID NO: 306354 - protein, 8 aa, Influenza virus
YLEENPSA

SEQ ID NO: 306355 - protein, 8 aa, Influenza virus
LEENPSAG

SEQ ID NO: 306356 - protein, 8 aa, Influenza virus
EENPSAGK

SEQ ID NO: 306357 - protein, 8 aa, Influenza virus
ENPSAGKD

SEQ ID NO: 306358 - protein, 8 aa, Influenza virus
NPSAGKDP

SEQ ID NO: 306359 - protein, 8 aa, Influenza virus
SAGRDPKK

SEQ ID NO: 306360 - protein, 8 aa, Influenza virus
RELTLYDK

SEQ ID NO: 306361 - protein, 8 aa, Influenza virus
ELILHDKE

SEQ ID NO: 306362 - protein, 8 aa, Influenza virus
LILHDKEE

SEQ ID NO: 306363 - protein, 8 aa, Influenza virus
KEEIMRIW

SEQ ID NO: 306364 - protein, 8 aa, Influenza virus
EVRRIWRQ

SEQ ID NO: 306365 - protein, 8 aa, Influenza virus
VRRIWRQA

SEQ ID NO: 306366 - protein, 8 aa, Influenza virus
QANNGEEA

SEQ ID NO: 306367 - protein, 8 aa, Influenza virus
SGLTHIMI

SEQ ID NO: 306368 - protein, 8 aa, Influenza virus
AIKGVGTM

SEQ ID NO: 306369 - protein, 8 aa, Influenza virus
VLELIRMI

SEQ ID NO: 306370 - protein, 8 aa, Influenza virus
MELVRMIK

SEQ ID NO: 306371 - protein, 8 aa, Influenza virus
IRMIKRGV

SEQ ID NO: 306372 - protein, 8 aa, Influenza virus
TRTAYERM

SEQ ID NO: 306373 - protein, 8 aa, Influenza virus
RTAYERMC

SEQ ID NO: 306374 - protein, 8 aa, Influenza virus
TAYERMCN

SEQ ID NO: 306375 - protein, 8 aa, Influenza virus
EIEDLIFM

SEQ ID NO: 306376 - protein, 8 aa, Influenza virus
IEDLIFMA

SEQ ID NO: 306377 - protein, 8 aa, Influenza virus
EDLIFMAR

SEQ ID NO: 306378 - protein, 8 aa, Influenza virus
DLIFMARS

SEQ ID NO: 306379 - protein, 8 aa, Influenza virus
LIFMARSA

SEQ ID NO: 306380 - protein, 8 aa, Influenza virus
IFMARSAL

SEQ ID NO: 306381 - protein, 8 aa, Influenza virus
LPACIYGL

SEQ ID NO: 306382 - protein, 8 aa, Influenza virus
PACIYGLV

SEQ ID NO: 306383 - protein, 8 aa, Influenza virus
ACIYGLVV

SEQ ID NO: 306384 - protein, 8 aa, Influenza virus
SGYNFEKE

SEQ ID NO: 306385 - protein, 8 aa, Influenza virus
GYNFEKEG

SEQ ID NO: 306386 - protein, 8 aa, Influenza virus
YNFEKEGY

SEQ ID NO: 306387 - protein, 8 aa, Influenza virus
GVDPFRLL

SEQ ID NO: 306388 - protein, 8 aa, Influenza virus
VDPFRLLQ

SEQ ID NO: 306389 - protein, 8 aa, Influenza virus
DPFRLLQS

SEQ ID NO: 306390 - protein, 8 aa, Influenza virus
PFRLLQSS

SEQ ID NO: 306391 - protein, 8 aa, Influenza virus
FRLLQSSQ

SEQ ID NO: 306392 - protein, 8 aa, Influenza virus
KLLQTSQV

SEQ ID NO: 306393 - protein, 8 aa, Influenza virus
SLIRSNEN

SEQ ID NO: 306394 - protein, 8 aa, Influenza virus
LIRSNENP

SEQ ID NO: 306395 - protein, 8 aa, Influenza virus
RPNENPVH

SEQ ID NO: 306396 - protein, 8 aa, Influenza virus
PNENPVHK

SEQ ID NO: 306397 - protein, 8 aa, Influenza virus
AFEDLRIS

SEQ ID NO: 306398 - protein, 8 aa, Influenza virus
PRGRLSTR

SEQ ID NO: 306399 - protein, 8 aa, Influenza virus
RGRLSTRG

SEQ ID NO: 306400 - protein, 8 aa, Influenza virus
LATRGVQI

SEQ ID NO: 306401 - protein, 8 aa, Influenza virus
ATRGVQIA

SEQ ID NO: 306402 - protein, 8 aa, Influenza virus
QIASNENT

SEQ ID NO: 306403 - protein, 8 aa, Influenza virus
SGTLELRS

SEQ ID NO: 306404 - protein, 8 aa, Influenza virus
RSGGNTNH

SEQ ID NO: 306405 - protein, 8 aa, Influenza virus
SGGNNNQQ

SEQ ID NO: 306406 - protein, 8 aa, Influenza virus
QQRSSAGQ

SEQ ID NO: 306407 - protein, 8 aa, Influenza virus
RASAGQVS

SEQ ID NO: 306408 - protein, 8 aa, Influenza virus
ASAGQISI

SEQ ID NO: 306409 - protein, 8 aa, Influenza virus
SAGQISIQ

SEQ ID NO: 306410 - protein, 8 aa, Influenza virus
AGQISIQP

SEQ ID NO: 306411 - protein, 8 aa, Influenza virus
SVQPAFSV

SEQ ID NO: 306412 - protein, 8 aa, Influenza virus
VQPAFSVQ

SEQ ID NO: 306413 - protein, 8 aa, Influenza virus
QRSLPFER

SEQ ID NO: 306414 - protein, 8 aa, Influenza virus
GNSEGRTS

SEQ ID NO: 306415 - protein, 8 aa, Influenza virus
NSEGRTSD

SEQ ID NO: 306416 - protein, 8 aa, Influenza virus
DMRAEIIK

SEQ ID NO: 306417 - protein, 8 aa, Influenza virus
EVSFQGRG

SEQ ID NO: 306418 - protein, 8 aa, Influenza virus
MSFQGRGV

SEQ ID NO: 306419 - protein, 8 aa, Influenza virus
ELSDERAA

SEQ ID NO: 306420 - protein, 8 aa, Influenza virus
SDEKAANP

SEQ ID NO: 306421 - protein, 8 aa, Influenza virus
ATNPVVPS

SEQ ID NO: 306422 - protein, 8 aa, Influenza virus
TNPVVPSF

SEQ ID NO: 306423 - protein, 8 aa, Influenza virus
VVPSFDMS

SEQ ID NO: 306424 - protein, 8 aa, Influenza virus
VPSFDMSK

SEQ ID NO: 306425 - protein, 8 aa, Influenza virus
PSFDMSKE

SEQ ID NO: 306426 - protein, 8 aa, Influenza virus
SFDMSKEG

SEQ ID NO: 306427 - protein, 8 aa, Influenza virus
FDMSKEGS

SEQ ID NO: 306428 - protein, 8 aa, Influenza virus
DMSKEGSY

SEQ ID NO: 306429 - protein, 8 aa, Influenza virus
ISNEGSYF

SEQ ID NO: 306430 - protein, 8 aa, Influenza virus
VDCFIWHI

SEQ ID NO: 306431 - protein, 8 aa, Influenza virus
DCFIWHIR

SEQ ID NO: 306432 - protein, 8 aa, Influenza virus
IDRLRRDQ

SEQ ID NO: 306433 - protein, 8 aa, Influenza virus
RLRRDQRA

SEQ ID NO: 306434 - protein, 8 aa, Influenza virus
LRRDQRAL

SEQ ID NO: 306435 - protein, 8 aa, Influenza virus
RRDQKALK

SEQ ID NO: 306436 - protein, 8 aa, Influenza virus
RDQKALKG

SEQ ID NO: 306437 - protein, 8 aa, Influenza virus
DQKALKGR

SEQ ID NO: 306438 - protein, 8 aa, Influenza virus
VPASRYLT

SEQ ID NO: 306439 - protein, 8 aa, Influenza virus
QLSHKFEE

SEQ ID NO: 306440 - protein, 8 aa, Influenza virus
LSQKFEEM

SEQ ID NO: 306441 - protein, 8 aa, Influenza virus
QKFEEMRW

SEQ ID NO: 306442 - protein, 8 aa, Influenza virus
KFEEMRWL

SEQ ID NO: 306443 - protein, 8 aa, Influenza virus
FEEMRWLI

SEQ ID NO: 306444 - protein, 8 aa, Influenza virus
IQALQLLL

SEQ ID NO: 306445 - protein, 8 aa, Influenza virus
QLLLEVEN

SEQ ID NO: 306446 - protein, 8 aa, Influenza virus
LLLEVENE

SEQ ID NO: 306447 - protein, 8 aa, Influenza virus
EVEQEMRT

SEQ ID NO: 306448 - protein, 8 aa, Influenza virus
VEQEMRTF

SEQ ID NO: 306449 - protein, 8 aa, Influenza virus
EQEMRTFS

SEQ ID NO: 306450 - protein, 8 aa, Influenza virus
QEMRTFSF

SEQ ID NO: 306451 - protein, 8 aa, Influenza virus
IRTFSFQF

SEQ ID NO: 306452 - protein, 8 aa, Influenza virus
MEEFVRQC

SEQ ID NO: 306453 - protein, 8 aa, Influenza virus
EEFVRQCF

SEQ ID NO: 306454 - protein, 8 aa, Influenza virus
EFVRQCFN

SEQ ID NO: 306455 - protein, 8 aa, Influenza virus
QCFNPMTV

SEQ ID NO: 306456 - protein, 8 aa, Influenza virus
CFNPMTVE

SEQ ID NO: 306457 - protein, 8 aa, Influenza virus
FNPMTVEL

SEQ ID NO: 306458 - protein, 8 aa, Influenza virus
NPMTVELA

SEQ ID NO: 306459 - protein, 8 aa, Influenza virus
PMTVELAE

SEQ ID NO: 306460 - protein, 8 aa, Influenza virus
MTVELAEK

SEQ ID NO: 306461 - protein, 8 aa, Influenza virus
AELAEKAM

SEQ ID NO: 306462 - protein, 8 aa, Influenza virus
IETNKFAS

SEQ ID NO: 306463 - protein, 8 aa, Influenza virus
FASICTHL

SEQ ID NO: 306464 - protein, 8 aa, Influenza virus
SICTHLEV

SEQ ID NO: 306465 - protein, 8 aa, Influenza virus
DFHFIDEQ

SEQ ID NO: 306466 - protein, 8 aa, Influenza virus
DPNTLLKH

SEQ ID NO: 306467 - protein, 8 aa, Influenza virus
IIEGRDRA

SEQ ID NO: 306468 - protein, 8 aa, Influenza virus
EGRDRAMA

SEQ ID NO: 306469 - protein, 8 aa, Influenza virus
GRDRAMAW

SEQ ID NO: 306470 - protein, 8 aa, Influenza virus
AWTVINSI

SEQ ID NO: 306471 - protein, 8 aa, Influenza virus
WTVINSIC

SEQ ID NO: 306472 - protein, 8 aa, Influenza virus
KPKYLPDL

SEQ ID NO: 306473 - protein, 8 aa, Influenza virus
PKYLPDLY

SEQ ID NO: 306474 - protein, 8 aa, Influenza virus
KYLPDLYD

SEQ ID NO: 306475 - protein, 8 aa, Influenza virus
DLYDYKKN

SEQ ID NO: 306476 - protein, 8 aa, Influenza virus
LYDYKKNR

SEQ ID NO: 306477 - protein, 8 aa, Influenza virus
YDYKKNRF

SEQ ID NO: 306478 - protein, 8 aa, Influenza virus
RFTEIGVT

SEQ ID NO: 306479 - protein, 8 aa, Influenza virus
FTEIGVTR

SEQ ID NO: 306480 - protein, 8 aa, Influenza virus
TEIGVTRR

SEQ ID NO: 306481 - protein, 8 aa, Influenza virus
VTRREIHI

SEQ ID NO: 306482 - protein, 8 aa, Influenza virus
TRREIHIY

SEQ ID NO: 306483 - protein, 8 aa, Influenza virus
RREIHIYY

SEQ ID NO: 306484 - protein, 8 aa, Influenza virus
REIHIYYL

SEQ ID NO: 306485 - protein, 8 aa, Influenza virus
EIHIYYLE

SEQ ID NO: 306486 - protein, 8 aa, Influenza virus
VHVYYLEK

SEQ ID NO: 306487 - protein, 8 aa, Influenza virus
HMYYLEKA

SEQ ID NO: 306488 - protein, 8 aa, Influenza virus
MYYLEKAN

SEQ ID NO: 306489 - protein, 8 aa, Influenza virus
KSNKIKSE

SEQ ID NO: 306490 - protein, 8 aa, Influenza virus
ERTHIHIF

SEQ ID NO: 306491 - protein, 8 aa, Influenza virus
RTHIHIFS

SEQ ID NO: 306492 - protein, 8 aa, Influenza virus
TGEEMASK

SEQ ID NO: 306493 - protein, 8 aa, Influenza virus
GEEMAAKA

SEQ ID NO: 306494 - protein, 8 aa, Influenza virus
DYILDEES

SEQ ID NO: 306495 - protein, 8 aa, Influenza virus
TIRQELAS

SEQ ID NO: 306496 - protein, 8 aa, Influenza virus
IRQELASR

SEQ ID NO: 306497 - protein, 8 aa, Influenza virus
GEETVEER

SEQ ID NO: 306498 - protein, 8 aa, Influenza virus
EETVEERF

SEQ ID NO: 306499 - protein, 8 aa, Influenza virus
ETVEERFE

SEQ ID NO: 306500 - protein, 8 aa, Influenza virus
KLANYSLP

SEQ ID NO: 306501 - protein, 8 aa, Influenza virus
SFRAYVDG

SEQ ID NO: 306502 - protein, 8 aa, Influenza virus
RTYVDGFE

SEQ ID NO: 306503 - protein, 8 aa, Influenza virus
TYVDGFEP

SEQ ID NO: 306504 - protein, 8 aa, Influenza virus
EPNGCIES

SEQ ID NO: 306505 - protein, 8 aa, Influenza virus
KLSQMPKE

SEQ ID NO: 306506 - protein, 8 aa, Influenza virus
LSQMPKEV

SEQ ID NO: 306507 - protein, 8 aa, Influenza virus
CFQRSKFL

SEQ ID NO: 306508 - protein, 8 aa, Influenza virus
FQRSKFLL

SEQ ID NO: 306509 - protein, 8 aa, Influenza virus
KLSIENPS

SEQ ID NO: 306510 - protein, 8 aa, Influenza virus
LSIENPSH

SEQ ID NO: 306511 - protein, 8 aa, Influenza virus
SIENPSHE

SEQ ID NO: 306512 - protein, 8 aa, Influenza virus
IENPSHEG

SEQ ID NO: 306513 - protein, 8 aa, Influenza virus
ENPSHEGE

SEQ ID NO: 306514 - protein, 8 aa, Influenza virus
NPSHEGEG

SEQ ID NO: 306515 - protein, 8 aa, Influenza virus
IPLYDAVK

SEQ ID NO: 306516 - protein, 8 aa, Influenza virus
PLYDAVKC

SEQ ID NO: 306517 - protein, 8 aa, Influenza virus
RCMKTFFG

SEQ ID NO: 306518 - protein, 8 aa, Influenza virus
CIRTFFGW

SEQ ID NO: 306519 - protein, 8 aa, Influenza virus
IRTFFGWK

SEQ ID NO: 306520 - protein, 8 aa, Influenza virus
LKWTLGEN

SEQ ID NO: 306521 - protein, 8 aa, Influenza virus
KWTLGENM

SEQ ID NO: 306522 - protein, 8 aa, Influenza virus
NIAPEKVD

SEQ ID NO: 306523 - protein, 8 aa, Influenza virus
APEKIDFE

SEQ ID NO: 306524 - protein, 8 aa, Influenza virus
WVQSEFNK

SEQ ID NO: 306525 - protein, 8 aa, Influenza virus
VQSEFNKA

SEQ ID NO: 306526 - protein, 8 aa, Influenza virus
ACELTDST

SEQ ID NO: 306527 - protein, 8 aa, Influenza virus
CELTDSTW

SEQ ID NO: 306528 - protein, 8 aa, Influenza virus
WVELDEIG

SEQ ID NO: 306529 - protein, 8 aa, Influenza virus
VELDEIGE

SEQ ID NO: 306530 - protein, 8 aa, Influenza virus
EDIAPIEY

SEQ ID NO: 306531 - protein, 8 aa, Influenza virus
PIEHVASM

SEQ ID NO: 306532 - protein, 8 aa, Influenza virus
IEHVASMR

SEQ ID NO: 306533 - protein, 8 aa, Influenza virus
EHVASMRR

SEQ ID NO: 306534 - protein, 8 aa, Influenza virus
IASIRRNY

SEQ ID NO: 306535 - protein, 8 aa, Influenza virus
SMRRSYFT

SEQ ID NO: 306536 - protein, 8 aa, Influenza virus
RDYFTAEV

SEQ ID NO: 306537 - protein, 8 aa, Influenza virus
DYFTAEVS

SEQ ID NO: 306538 - protein, 8 aa, Influenza virus
YFTTEVSH

SEQ ID NO: 306539 - protein, 8 aa, Influenza virus
FTTEVSHC

SEQ ID NO: 306540 - protein, 8 aa, Influenza virus
TTEVSHCR

SEQ ID NO: 306541 - protein, 8 aa, Influenza virus
TEVSHCRA

SEQ ID NO: 306542 - protein, 8 aa, Influenza virus
IKGVYINT

SEQ ID NO: 306543 - protein, 8 aa, Influenza virus
GVYINTAM

SEQ ID NO: 306544 - protein, 8 aa, Influenza virus
VYINTAML

SEQ ID NO: 306545 - protein, 8 aa, Influenza virus
YINTAMLN

SEQ ID NO: 306546 - protein, 8 aa, Influenza virus
INTAMLNA

SEQ ID NO: 306547 - protein, 8 aa, Influenza virus
MISKSRTK

SEQ ID NO: 306548 - protein, 8 aa, Influenza virus
SLVDPRLE

SEQ ID NO: 306549 - protein, 8 aa, Influenza virus
PYKWEKYC

SEQ ID NO: 306550 - protein, 8 aa, Influenza virus
YKWEKYCV

SEQ ID NO: 306551 - protein, 8 aa, Influenza virus
KWEKYCVI

SEQ ID NO: 306552 - protein, 8 aa, Influenza virus
WEKYCVIE

SEQ ID NO: 306553 - protein, 8 aa, Influenza virus
PLFLYVRT

SEQ ID NO: 306554 - protein, 8 aa, Influenza virus
LFLYVRTN

SEQ ID NO: 306555 - protein, 8 aa, Influenza virus
VESMIEAE

SEQ ID NO: 306556 - protein, 8 aa, Influenza virus
IEAESSVR

SEQ ID NO: 306557 - protein, 8 aa, Influenza virus
SSVKEKDL

SEQ ID NO: 306558 - protein, 8 aa, Influenza virus
SVKEKDLT

SEQ ID NO: 306559 - protein, 8 aa, Influenza virus
VREKDMTK

SEQ ID NO: 306560 - protein, 8 aa, Influenza virus
KEKDLTKE

SEQ ID NO: 306561 - protein, 8 aa, Influenza virus
DMTKDFFE

SEQ ID NO: 306562 - protein, 8 aa, Influenza virus
EMWPIGES

SEQ ID NO: 306563 - protein, 8 aa, Influenza virus
MWPIGESP

SEQ ID NO: 306564 - protein, 8 aa, Influenza virus
WPVGESPK

SEQ ID NO: 306565 - protein, 8 aa, Influenza virus
PVGESPKG

SEQ ID NO: 306566 - protein, 8 aa, Influenza virus
GESPKRVE

SEQ ID NO: 306567 - protein, 8 aa, Influenza virus
RVEEGSIG

SEQ ID NO: 306568 - protein, 8 aa, Influenza virus
MEEGSIGK

SEQ ID NO: 306569 - protein, 8 aa, Influenza virus
SVFNSLYS

SEQ ID NO: 306570 - protein, 8 aa, Influenza virus
VFNSLYSS

SEQ ID NO: 306571 - protein, 8 aa, Influenza virus
FNSLYSSP

SEQ ID NO: 306572 - protein, 8 aa, Influenza virus
NSLYSSPQ

SEQ ID NO: 306573 - protein, 8 aa, Influenza virus
SLYSSPQL

SEQ ID NO: 306574 - protein, 8 aa, Influenza virus
SRKMLLIV

SEQ ID NO: 306575 - protein, 8 aa, Influenza virus
RKMLLIVQ

SEQ ID NO: 306576 - protein, 8 aa, Influenza virus
KMLLIVQA

SEQ ID NO: 306577 - protein, 8 aa, Influenza virus
LLLIVQAF

SEQ ID NO: 306578 - protein, 8 aa, Influenza virus
LLIVQAFR

SEQ ID NO: 306579 - protein, 8 aa, Influenza virus
LIVQAFRD

SEQ ID NO: 306580 - protein, 8 aa, Influenza virus
QALKDNLE

SEQ ID NO: 306581 - protein, 8 aa, Influenza virus
ALKDNLEP

SEQ ID NO: 306582 - protein, 8 aa, Influenza virus
LKDNLEPG

SEQ ID NO: 306583 - protein, 8 aa, Influenza virus
EPGTFDIE

SEQ ID NO: 306584 - protein, 8 aa, Influenza virus
PGTFDIEG

SEQ ID NO: 306585 - protein, 8 aa, Influenza virus
GTFDIEGL

SEQ ID NO: 306586 - protein, 8 aa, Influenza virus
TFDIEGLY

SEQ ID NO: 306587 - protein, 8 aa, Influenza virus
GLYGAIEE

SEQ ID NO: 306588 - protein, 8 aa, Influenza virus
LYGAIEEC

SEQ ID NO: 306589 - protein, 8 aa, Influenza virus
YGAIEECL

SEQ ID NO: 306590 - protein, 8 aa, Influenza virus
GAIEECLI

SEQ ID NO: 306591 - protein, 8 aa, Influenza virus
SWFNSFLI

SEQ ID NO: 306592 - protein, 8 aa, Influenza virus
WFNSFLIH

SEQ ID NO: 306593 - protein, 8 aa, Influenza virus
FLAHALKL

SEQ ID NO: 306594 - protein, 8 aa, Influenza virus
TLLFLEVP

SEQ ID NO: 306595 - protein, 8 aa, Influenza virus
LLFLKIPV

SEQ ID NO: 306596 - protein, 8 aa, Influenza virus
LFLKIPVQ

SEQ ID NO: 306597 - protein, 8 aa, Influenza virus
FLKIPVQN

SEQ ID NO: 306598 - protein, 8 aa, Influenza virus
LKIPVQNA

SEQ ID NO: 306599 - protein, 8 aa, Influenza virus
KIPVQNAI

SEQ ID NO: 306600 - protein, 8 aa, Influenza virus
IPVQNAIS

SEQ ID NO: 306601 - protein, 8 aa, Influenza virus
HQYSEKGR

SEQ ID NO: 306602 - protein, 8 aa, Influenza virus
QYSEKGRW

SEQ ID NO: 306603 - protein, 8 aa, Influenza virus
NTETKAPQ

SEQ ID NO: 306604 - protein, 8 aa, Influenza virus
TETKAPQL

SEQ ID NO: 306605 - protein, 8 aa, Influenza virus
ETGALQLN

SEQ ID NO: 306606 - protein, 8 aa, Influenza virus
TGALQLNP

SEQ ID NO: 306607 - protein, 8 aa, Influenza virus
GAPQLNPV

SEQ ID NO: 306608 - protein, 8 aa, Influenza virus
DNDPSGYA

SEQ ID NO: 306609 - protein, 8 aa, Influenza virus
EAMALLEE

SEQ ID NO: 306610 - protein, 8 aa, Influenza virus
AMALLEES

SEQ ID NO: 306611 - protein, 8 aa, Influenza virus
MALLEESH

SEQ ID NO: 306612 - protein, 8 aa, Influenza virus
ALLEESHP

SEQ ID NO: 306613 - protein, 8 aa, Influenza virus
LLEESHPG

SEQ ID NO: 306614 - protein, 8 aa, Influenza virus
LENSHPGI

SEQ ID NO: 306615 - protein, 8 aa, Influenza virus
ENSHPGIF

SEQ ID NO: 306616 - protein, 8 aa, Influenza virus
NSHPGIFE

SEQ ID NO: 306617 - protein, 8 aa, Influenza virus
SHPGIFES

SEQ ID NO: 306618 - protein, 8 aa, Influenza virus
GIFGNSCL

SEQ ID NO: 306619 - protein, 8 aa, Influenza virus
IFGNSCLE

SEQ ID NO: 306620 - protein, 8 aa, Influenza virus
FESSCLET

SEQ ID NO: 306621 - protein, 8 aa, Influenza virus
SSCLETME

SEQ ID NO: 306622 - protein, 8 aa, Influenza virus
NTIEVFKS

SEQ ID NO: 306623 - protein, 8 aa, Influenza virus
TIEVFKSN

SEQ ID NO: 306624 - protein, 8 aa, Influenza virus
MDFLKDVM

SEQ ID NO: 306625 - protein, 8 aa, Influenza virus
EIITHFQR

SEQ ID NO: 306626 - protein, 8 aa, Influenza virus
IITHFQRK

SEQ ID NO: 306627 - protein, 8 aa, Influenza virus
KRRVRDNI

SEQ ID NO: 306628 - protein, 8 aa, Influenza virus
RRVRDNIT

SEQ ID NO: 306629 - protein, 8 aa, Influenza virus
RVRDNITK

SEQ ID NO: 306630 - protein, 8 aa, Influenza virus
RDNITKKM

SEQ ID NO: 306631 - protein, 8 aa, Influenza virus
TRKMVTQR

SEQ ID NO: 306632 - protein, 8 aa, Influenza virus
RKMVTQRT

SEQ ID NO: 306633 - protein, 8 aa, Influenza virus
KMVTQRTV

SEQ ID NO: 306634 - protein, 8 aa, Influenza virus
RTIGKRKQ

SEQ ID NO: 306635 - protein, 8 aa, Influenza virus
SYLIRTLT

SEQ ID NO: 306636 - protein, 8 aa, Influenza virus
GFVYFVEI

SEQ ID NO: 306637 - protein, 8 aa, Influenza virus
FVYFVEIL

SEQ ID NO: 306638 - protein, 8 aa, Influenza virus
VYFVEILA

SEQ ID NO: 306639 - protein, 8 aa, Influenza virus
YFVEILAR

SEQ ID NO: 306640 - protein, 8 aa, Influenza virus
VETLARCI

SEQ ID NO: 306641 - protein, 8 aa, Influenza virus
ETLARCIC

SEQ ID NO: 306642 - protein, 8 aa, Influenza virus
LARNICEK

SEQ ID NO: 306643 - protein, 8 aa, Influenza virus
ARNICEKL

SEQ ID NO: 306644 - protein, 8 aa, Influenza virus
RNICEKLE

SEQ ID NO: 306645 - protein, 8 aa, Influenza virus
NICEKLEQ

SEQ ID NO: 306646 - protein, 8 aa, Influenza virus
TNSQDTEV

SEQ ID NO: 306647 - protein, 8 aa, Influenza virus
NSQDTEVS

SEQ ID NO: 306648 - protein, 8 aa, Influenza virus
QNPRVFLT

SEQ ID NO: 306649 - protein, 8 aa, Influenza virus
NPRVFLTM

SEQ ID NO: 306650 - protein, 8 aa, Influenza virus
PRVFLTMI

SEQ ID NO: 306651 - protein, 8 aa, Influenza virus
RVFLTMIT

SEQ ID NO: 306652 - protein, 8 aa, Influenza virus
VFLTMITY

SEQ ID NO: 306653 - protein, 8 aa, Influenza virus
TYITRSQP

SEQ ID NO: 306654 - protein, 8 aa, Influenza virus
QPKWFRNV

SEQ ID NO: 306655 - protein, 8 aa, Influenza virus
PKWFRNVL

SEQ ID NO: 306656 - protein, 8 aa, Influenza virus
KWFRNVLS

SEQ ID NO: 306657 - protein, 8 aa, Influenza virus
WFRNVLSV

SEQ ID NO: 306658 - protein, 8 aa, Influenza virus
FRNVLSVA

SEQ ID NO: 306659 - protein, 8 aa, Influenza virus
RNVLSVAP

SEQ ID NO: 306660 - protein, 8 aa, Influenza virus
NVLSVAPI

SEQ ID NO: 306661 - protein, 8 aa, Influenza virus
VLSVAPIM

SEQ ID NO: 306662 - protein, 8 aa, Influenza virus
GYMFESKK

SEQ ID NO: 306663 - protein, 8 aa, Influenza virus
YMFESKKM

SEQ ID NO: 306664 - protein, 8 aa, Influenza virus
MRLRTQIP

SEQ ID NO: 306665 - protein, 8 aa, Influenza virus
RLRTQIPA

SEQ ID NO: 306666 - protein, 8 aa, Influenza virus
LRTQISAE

SEQ ID NO: 306667 - protein, 8 aa, Influenza virus
IDLKYFNK

SEQ ID NO: 306668 - protein, 8 aa, Influenza virus
KIEKVRPL

SEQ ID NO: 306669 - protein, 8 aa, Influenza virus
IEKVRPLL

SEQ ID NO: 306670 - protein, 8 aa, Influenza virus
ILNLGQRK

SEQ ID NO: 306671 - protein, 8 aa, Influenza virus
LNLGQRKY

SEQ ID NO: 306672 - protein, 8 aa, Influenza virus
NLGQRKYT

SEQ ID NO: 306673 - protein, 8 aa, Influenza virus
TVYWWDGL

SEQ ID NO: 306674 - protein, 8 aa, Influenza virus
VYWWDGLQ

SEQ ID NO: 306675 - protein, 8 aa, Influenza virus
FALILNAP

SEQ ID NO: 306676 - protein, 8 aa, Influenza virus
EGVQAGVD

SEQ ID NO: 306677 - protein, 8 aa, Influenza virus
RCHRGDTH

SEQ ID NO: 306678 - protein, 8 aa, Influenza virus
CHRGDTHI

SEQ ID NO: 306679 - protein, 8 aa, Influenza virus
HIQTRRSF

SEQ ID NO: 306680 - protein, 8 aa, Influenza virus
QTRRAFEL

SEQ ID NO: 306681 - protein, 8 aa, Influenza virus
TRRSFELR

SEQ ID NO: 306682 - protein, 8 aa, Influenza virus
QGRLCNPM

SEQ ID NO: 306683 - protein, 8 aa, Influenza virus
NPMNPFVS

SEQ ID NO: 306684 - protein, 8 aa, Influenza virus
PMNPFVSH

SEQ ID NO: 306685 - protein, 8 aa, Influenza virus
NPFVTHKE

SEQ ID NO: 306686 - protein, 8 aa, Influenza virus
QMYQKCCT

SEQ ID NO: 306687 - protein, 8 aa, Influenza virus
MYQKCCTL

SEQ ID NO: 306688 - protein, 8 aa, Influenza virus
YQKCCTLF

SEQ ID NO: 306689 - protein, 8 aa, Influenza virus
QKCCTLFE

SEQ ID NO: 306690 - protein, 8 aa, Influenza virus
KCCTLFEK

SEQ ID NO: 306691 - protein, 8 aa, Influenza virus
PVGISSMM

SEQ ID NO: 306692 - protein, 8 aa, Influenza virus
VGISSMME

SEQ ID NO: 306693 - protein, 8 aa, Influenza virus
SSMVEAMI

SEQ ID NO: 306694 - protein, 8 aa, Influenza virus
SMVEAMIS

SEQ ID NO: 306695 - protein, 8 aa, Influenza virus
MVEAMISR

SEQ ID NO: 306696 - protein, 8 aa, Influenza virus
VEAMISRA

SEQ ID NO: 306697 - protein, 8 aa, Influenza virus
VDSESGRI

SEQ ID NO: 306698 - protein, 8 aa, Influenza virus
DLMLQSRT

SEQ ID NO: 306699 - protein, 8 aa, Influenza virus
MKYPITAN

SEQ ID NO: 306700 - protein, 8 aa, Influenza virus
KYPITAER

SEQ ID NO: 306701 - protein, 8 aa, Influenza virus
RNEQGQAL

SEQ ID NO: 306702 - protein, 8 aa, Influenza virus
NEQGQALW

SEQ ID NO: 306703 - protein, 8 aa, Influenza virus
DAGSNRVM

SEQ ID NO: 306704 - protein, 8 aa, Influenza virus
GSDRVIVS

SEQ ID NO: 306705 - protein, 8 aa, Influenza virus
MVSPLAIT

SEQ ID NO: 306706 - protein, 8 aa, Influenza virus
HYSKVYKT

SEQ ID NO: 306707 - protein, 8 aa, Influenza virus
YSKVYKTY

SEQ ID NO: 306708 - protein, 8 aa, Influenza virus
SKVYKTYF

SEQ ID NO: 306709 - protein, 8 aa, Influenza virus
KVYRTYFE

SEQ ID NO: 306710 - protein, 8 aa, Influenza virus
VYRTYFEK

SEQ ID NO: 306711 - protein, 8 aa, Influenza virus
AFGPVHFR

SEQ ID NO: 306712 - protein, 8 aa, Influenza virus
PVHFRSQV

SEQ ID NO: 306713 - protein, 8 aa, Influenza virus
VHFRSQVK

SEQ ID NO: 306714 - protein, 8 aa, Influenza virus
KIRRRVDM

SEQ ID NO: 306715 - protein, 8 aa, Influenza virus
IRRRVDMN

SEQ ID NO: 306716 - protein, 8 aa, Influenza virus
RRRVDMNP

SEQ ID NO: 306717 - protein, 8 aa, Influenza virus
RRVDMNPG

SEQ ID NO: 306718 - protein, 8 aa, Influenza virus
RVDMNPGH

SEQ ID NO: 306719 - protein, 8 aa, Influenza virus
VDMNPGHA

SEQ ID NO: 306720 - protein, 8 aa, Influenza virus
DMNPGHAD

SEQ ID NO: 306721 - protein, 8 aa, Influenza virus
MNPGHADL

SEQ ID NO: 306722 - protein, 8 aa, Influenza virus
NPGHSDLS

SEQ ID NO: 306723 - protein, 8 aa, Influenza virus
DISAKEAQ

SEQ ID NO: 306724 - protein, 8 aa, Influenza virus
ISAKEAQD

SEQ ID NO: 306725 - protein, 8 aa, Influenza virus
STKEAQDV

SEQ ID NO: 306726 - protein, 8 aa, Influenza virus
RILASESQ

SEQ ID NO: 306727 - protein, 8 aa, Influenza virus
TKEKREEL

SEQ ID NO: 306728 - protein, 8 aa, Influenza virus
LPVTGGTS

SEQ ID NO: 306729 - protein, 8 aa, Influenza virus
PVTGGTSS

SEQ ID NO: 306730 - protein, 8 aa, Influenza virus
GGTSSVYV

SEQ ID NO: 306731 - protein, 8 aa, Influenza virus
GTSSVYVE

SEQ ID NO: 306732 - protein, 8 aa, Influenza virus
TSSVYVEV

SEQ ID NO: 306733 - protein, 8 aa, Influenza virus
SSVYVEVL

SEQ ID NO: 306734 - protein, 8 aa, Influenza virus
QMYTPGGK

SEQ ID NO: 306735 - protein, 8 aa, Influenza virus
MYTPGGKV

SEQ ID NO: 306736 - protein, 8 aa, Influenza virus
YTPGGKVR

SEQ ID NO: 306737 - protein, 8 aa, Influenza virus
TPGGKVRN

SEQ ID NO: 306738 - protein, 8 aa, Influenza virus
PGGKVRND

SEQ ID NO: 306739 - protein, 8 aa, Influenza virus
GGKVRNDD

SEQ ID NO: 306740 - protein, 8 aa, Influenza virus
VKNDDIDQ

SEQ ID NO: 306741 - protein, 8 aa, Influenza virus
KNDDIDQS

SEQ ID NO: 306742 - protein, 8 aa, Influenza virus
RNIVRRAI

SEQ ID NO: 306743 - protein, 8 aa, Influenza virus
NIVRRAIV

SEQ ID NO: 306744 - protein, 8 aa, Influenza virus
TVSADPLL

SEQ ID NO: 306745 - protein, 8 aa, Influenza virus
DILRQNPS

SEQ ID NO: 306746 - protein, 8 aa, Influenza virus
VDICKAAL

SEQ ID NO: 306747 - protein, 8 aa, Influenza virus
DICKAALG

SEQ ID NO: 306748 - protein, 8 aa, Influenza virus
CKAAMGLK

SEQ ID NO: 306749 - protein, 8 aa, Influenza virus
KAAMGLKI

SEQ ID NO: 306750 - protein, 8 aa, Influenza virus
AAMGLKIS

SEQ ID NO: 306751 - protein, 8 aa, Influenza virus
AMGLKISS

SEQ ID NO: 306752 - protein, 8 aa, Influenza virus
MGLKISSS

SEQ ID NO: 306753 - protein, 8 aa, Influenza virus
TFKRTSGT

SEQ ID NO: 306754 - protein, 8 aa, Influenza virus
FKRTSGTS

SEQ ID NO: 306755 - protein, 8 aa, Influenza virus
GNLQTLKV

SEQ ID NO: 306756 - protein, 8 aa, Influenza virus
VHEGFEEF

SEQ ID NO: 306757 - protein, 8 aa, Influenza virus
HMGYEEFT

SEQ ID NO: 306758 - protein, 8 aa, Influenza virus
EGFEEFTM

SEQ ID NO: 306759 - protein, 8 aa, Influenza virus
GFEEFTMV

SEQ ID NO: 306760 - protein, 8 aa, Influenza virus
FEEFTMVG

SEQ ID NO: 306761 - protein, 8 aa, Influenza virus
VGRKATAI

SEQ ID NO: 306762 - protein, 8 aa, Influenza virus
KATAILRK

SEQ ID NO: 306763 - protein, 8 aa, Influenza virus
ATAIFRKA

SEQ ID NO: 306764 - protein, 8 aa, Influenza virus
TAIFRKAT

SEQ ID NO: 306765 - protein, 8 aa, Influenza virus
AIIRKATR

SEQ ID NO: 306766 - protein, 8 aa, Influenza virus
RKATRRMI

SEQ ID NO: 306767 - protein, 8 aa, Influenza virus
KATKRLIQ

SEQ ID NO: 306768 - protein, 8 aa, Influenza virus
ATKRLIQL

SEQ ID NO: 306769 - protein, 8 aa, Influenza virus
TKRLIQLI

SEQ ID NO: 306770 - protein, 8 aa, Influenza virus
KRLIQLIV

SEQ ID NO: 306771 - protein, 8 aa, Influenza virus
KLIQLIVS

SEQ ID NO: 306772 - protein, 8 aa, Influenza virus
IQLIVSGK

SEQ ID NO: 306773 - protein, 8 aa, Influenza virus
QLVVSGRD

SEQ ID NO: 306774 - protein, 8 aa, Influenza virus
IVSGRDDQ

SEQ ID NO: 306775 - protein, 8 aa, Influenza virus
VSGRDDQS

SEQ ID NO: 306776 - protein, 8 aa, Influenza virus
SGRDEQSV

SEQ ID NO: 306777 - protein, 8 aa, Influenza virus
FSQEDCMM

SEQ ID NO: 306778 - protein, 8 aa, Influenza virus
SQEDCMMK

SEQ ID NO: 306779 - protein, 8 aa, Influenza virus
QEDCMMKA

SEQ ID NO: 306780 - protein, 8 aa, Influenza virus
EDCMMKAV

SEQ ID NO: 306781 - protein, 8 aa, Influenza virus
DCMMKAVR

SEQ ID NO: 306782 - protein, 8 aa, Influenza virus
RMIKAVRG

SEQ ID NO: 306783 - protein, 8 aa, Influenza virus
HFQKNAKV

SEQ ID NO: 306784 - protein, 8 aa, Influenza virus
FQKNAKVL

SEQ ID NO: 306785 - protein, 8 aa, Influenza virus
VMGMVGIL

SEQ ID NO: 306786 - protein, 8 aa, Influenza virus
MGMVGILP

SEQ ID NO: 306787 - protein, 8 aa, Influenza virus
GMVGILPD

SEQ ID NO: 306788 - protein, 8 aa, Influenza virus
GILSDMTP

SEQ ID NO: 306789 - protein, 8 aa, Influenza virus
RVSKTGVD

SEQ ID NO: 306790 - protein, 8 aa, Influenza virus
VSKTGVDE

SEQ ID NO: 306791 - protein, 8 aa, Influenza virus
RMGVDEYS

SEQ ID NO: 306792 - protein, 8 aa, Influenza virus
TGVDEYSS

SEQ ID NO: 306793 - protein, 8 aa, Influenza virus
DEYSSAER

SEQ ID NO: 306794 - protein, 8 aa, Influenza virus
AVSIDRFL

SEQ ID NO: 306795 - protein, 8 aa, Influenza virus
FLRVRDQL

SEQ ID NO: 306796 - protein, 8 aa, Influenza virus
LRVRDQLG

SEQ ID NO: 306797 - protein, 8 aa, Influenza virus
RVRDQLGN

SEQ ID NO: 306798 - protein, 8 aa, Influenza virus
DQQGNILL

SEQ ID NO: 306799 - protein, 8 aa, Influenza virus
QGNILLSP

SEQ ID NO: 306800 - protein, 8 aa, Influenza virus
EVSEAQGT

SEQ ID NO: 306801 - protein, 8 aa, Influenza virus
VSEAQGTE

SEQ ID NO: 306802 - protein, 8 aa, Influenza virus
QGIERLTI

SEQ ID NO: 306803 - protein, 8 aa, Influenza virus
TITYSSPM

SEQ ID NO: 306804 - protein, 8 aa, Influenza virus
ITYSSPMM

SEQ ID NO: 306805 - protein, 8 aa, Influenza virus
TYSSPMMW

SEQ ID NO: 306806 - protein, 8 aa, Influenza virus
SSPMMWEI

SEQ ID NO: 306807 - protein, 8 aa, Influenza virus
SPMMWEIN

SEQ ID NO: 306808 - protein, 8 aa, Influenza virus
PMMWEING

SEQ ID NO: 306809 - protein, 8 aa, Influenza virus
IQWSQNPS

SEQ ID NO: 306810 - protein, 8 aa, Influenza virus
LYNKLEFE

SEQ ID NO: 306811 - protein, 8 aa, Influenza virus
YNKLEFEP

SEQ ID NO: 306812 - protein, 8 aa, Influenza virus
NKLEFEPF

SEQ ID NO: 306813 - protein, 8 aa, Influenza virus
KLEFEPFQ

SEQ ID NO: 306814 - protein, 8 aa, Influenza virus
RSLYSGFV

SEQ ID NO: 306815 - protein, 8 aa, Influenza virus
SLYSGFVR

SEQ ID NO: 306816 - protein, 8 aa, Influenza virus
LGTFDTIQ

SEQ ID NO: 306817 - protein, 8 aa, Influenza virus
GTFDTIQI

SEQ ID NO: 306818 - protein, 8 aa, Influenza virus
TFDTIQII

SEQ ID NO: 306819 - protein, 8 aa, Influenza virus
FDTIQIIK

SEQ ID NO: 306820 - protein, 8 aa, Influenza virus
TIQIIKLL

SEQ ID NO: 306821 - protein, 8 aa, Influenza virus
IQIIKLLP

SEQ ID NO: 306822 - protein, 8 aa, Influenza virus
ASAPPEQS

SEQ ID NO: 306823 - protein, 8 aa, Influenza virus
AAPPVQSR

SEQ ID NO: 306824 - protein, 8 aa, Influenza virus
APPVQSKM

SEQ ID NO: 306825 - protein, 8 aa, Influenza virus
PPVQSRMQ

SEQ ID NO: 306826 - protein, 8 aa, Influenza virus
PVQSKMQF

SEQ ID NO: 306827 - protein, 8 aa, Influenza virus
VQSRMQFS

SEQ ID NO: 306828 - protein, 8 aa, Influenza virus
GTGMRILV

SEQ ID NO: 306829 - protein, 8 aa, Influenza virus
TGMRILVR

SEQ ID NO: 306830 - protein, 8 aa, Influenza virus
GLRILIRG

SEQ ID NO: 306831 - protein, 8 aa, Influenza virus
LRILIRGN

SEQ ID NO: 306832 - protein, 8 aa, Influenza virus
LIRGNSPI

SEQ ID NO: 306833 - protein, 8 aa, Influenza virus
IRGNSPIF

SEQ ID NO: 306834 - protein, 8 aa, Influenza virus
SPAFNYNK

SEQ ID NO: 306835 - protein, 8 aa, Influenza virus
TRRLTVLG

SEQ ID NO: 306836 - protein, 8 aa, Influenza virus
RRLTVLGK

SEQ ID NO: 306837 - protein, 8 aa, Influenza virus
LGKDAGEL

SEQ ID NO: 306838 - protein, 8 aa, Influenza virus
GGVESAVL

SEQ ID NO: 306839 - protein, 8 aa, Influenza virus
FLILGRED

SEQ ID NO: 306840 - protein, 8 aa, Influenza virus
LILGKENK

SEQ ID NO: 306841 - protein, 8 aa, Influenza virus
GKENKRYG

SEQ ID NO: 306842 - protein, 8 aa, Influenza virus
KENKRYGP

SEQ ID NO: 306843 - protein, 8 aa, Influenza virus
ENKKYGPA

SEQ ID NO: 306844 - protein, 8 aa, Influenza virus
NKKYGPAL

SEQ ID NO: 306845 - protein, 8 aa, Influenza virus
LSISELSN

SEQ ID NO: 306846 - protein, 8 aa, Influenza virus
IAKGEKAN

SEQ ID NO: 306847 - protein, 8 aa, Influenza virus
TKRIRLAI

SEQ ID NO: 306848 - protein, 8 aa, Influenza virus
IRMATNEC

SEQ ID NO: 306849 - protein, 8 aa, Influenza virus
RRKRRGLF

SEQ ID NO: 306850 - protein, 8 aa, Influenza virus
KRRGLFGA

SEQ ID NO: 306851 - protein, 8 aa, Influenza virus
LDQNFRNI

SEQ ID NO: 306852 - protein, 8 aa, Influenza virus
RTQESSCV

SEQ ID NO: 306853 - protein, 8 aa, Influenza virus
TQESSCVC

SEQ ID NO: 306854 - protein, 8 aa, Influenza virus
HLEECSCY

SEQ ID NO: 306855 - protein, 8 aa, Influenza virus
LEECSCYV

SEQ ID NO: 306856 - protein, 8 aa, Influenza virus
GWAIHSKD

SEQ ID NO: 306857 - protein, 8 aa, Influenza virus
WAIHSKDN

SEQ ID NO: 306858 - protein, 8 aa, Influenza virus
SKDNNIRI

SEQ ID NO: 306859 - protein, 8 aa, Influenza virus
NNIRIGSK

SEQ ID NO: 306860 - protein, 8 aa, Influenza virus
NIRIGSKG

SEQ ID NO: 306861 - protein, 8 aa, Influenza virus
GDVFVVRE

SEQ ID NO: 306862 - protein, 8 aa, Influenza virus
DVFVVREP

SEQ ID NO: 306863 - protein, 8 aa, Influenza virus
VFVVREPF

SEQ ID NO: 306864 - protein, 8 aa, Influenza virus
DRSPFRAL

SEQ ID NO: 306865 - protein, 8 aa, Influenza virus
RALMSCPV

SEQ ID NO: 306866 - protein, 8 aa, Influenza virus
ALMSCPVG

SEQ ID NO: 306867 - protein, 8 aa, Influenza virus
SCPVGEVP

SEQ ID NO: 306868 - protein, 8 aa, Influenza virus
PMGEAPSP

SEQ ID NO: 306869 - protein, 8 aa, Influenza virus
VGEVPSPY

SEQ ID NO: 306870 - protein, 8 aa, Influenza virus
ASACHDGV

SEQ ID NO: 306871 - protein, 8 aa, Influenza virus
DNGAVAVV

SEQ ID NO: 306872 - protein, 8 aa, Influenza virus
NGAVAVVK

SEQ ID NO: 306873 - protein, 8 aa, Influenza virus
AVLKYNGV

SEQ ID NO: 306874 - protein, 8 aa, Influenza virus
VLKYNGVI

SEQ ID NO: 306875 - protein, 8 aa, Influenza virus
LKYNGVIT

SEQ ID NO: 306876 - protein, 8 aa, Influenza virus
NGYCFTVM

SEQ ID NO: 306877 - protein, 8 aa, Influenza virus
TIMTDGPN

SEQ ID NO: 306878 - protein, 8 aa, Influenza virus
APNYYYEE

SEQ ID NO: 306879 - protein, 8 aa, Influenza virus
PNYYYEEC

SEQ ID NO: 306880 - protein, 8 aa, Influenza virus
NYYYEECS

SEQ ID NO: 306881 - protein, 8 aa, Influenza virus
YYYEECSC

SEQ ID NO: 306882 - protein, 8 aa, Influenza virus
RPWVSFNH

SEQ ID NO: 306883 - protein, 8 aa, Influenza virus
YRIGYICS

SEQ ID NO: 306884 - protein, 8 aa, Influenza virus
RIGYICSG

SEQ ID NO: 306885 - protein, 8 aa, Influenza virus
MGYICSGV

SEQ ID NO: 306886 - protein, 8 aa, Influenza virus
VFGDTPRP

SEQ ID NO: 306887 - protein, 8 aa, Influenza virus
GVKGFSYR

SEQ ID NO: 306888 - protein, 8 aa, Influenza virus
VKGFSYRY

SEQ ID NO: 306889 - protein, 8 aa, Influenza virus
KGFSYRYG

SEQ ID NO: 306890 - protein, 8 aa, Influenza virus
KYGDGVWI

SEQ ID NO: 306891 - protein, 8 aa, Influenza virus
IWDPNGWA

SEQ ID NO: 306892 - protein, 8 aa, Influenza virus
NCIKPCFW

SEQ ID NO: 306893 - protein, 8 aa, Influenza virus
PDDAELPF

SEQ ID NO: 306894 - protein, 8 aa, Influenza virus
FSKDNSVR

SEQ ID NO: 306895 - protein, 8 aa, Influenza virus
RELYVSCD

SEQ ID NO: 306896 - protein, 8 aa, Influenza virus
SHRTLLMN

SEQ ID NO: 306897 - protein, 8 aa, Influenza virus
VPFYLGTK

SEQ ID NO: 306898 - protein, 8 aa, Influenza virus
TKQVCVAW

SEQ ID NO: 306899 - protein, 8 aa, Influenza virus
KQVCVAWS

SEQ ID NO: 306900 - protein, 8 aa, Influenza virus
SILRTQES

SEQ ID NO: 306901 - protein, 8 aa, Influenza virus
SECVCINE

SEQ ID NO: 306902 - protein, 8 aa, Influenza virus
ECSCYPSY

SEQ ID NO: 306903 - protein, 8 aa, Influenza virus
LVGDTPRE

SEQ ID NO: 306904 - protein, 8 aa, Influenza virus
VKGWAFDV

SEQ ID NO: 306905 - protein, 8 aa, Influenza virus
RAGYETFK

SEQ ID NO: 306906 - protein, 8 aa, Influenza virus
AGYETFKV

SEQ ID NO: 306907 - protein, 8 aa, Influenza virus
GYETFRVT

SEQ ID NO: 306908 - protein, 8 aa, Influenza virus
WTANSIIV

SEQ ID NO: 306909 - protein, 8 aa, Influenza virus
TANSIIVF

SEQ ID NO: 306910 - protein, 8 aa, Influenza virus
ANSIIVFC

SEQ ID NO: 306911 - protein, 8 aa, Influenza virus
TWPDGADI

SEQ ID NO: 306912 - protein, 8 aa, Influenza virus
DINLMPIY

SEQ ID NO: 306913 - protein, 8 aa, Influenza virus
INLMPIYS

SEQ ID NO: 306914 - protein, 8 aa, Influenza virus
GLMGRTRI

SEQ ID NO: 306915 - protein, 8 aa, Influenza virus
ALLVGIGN

SEQ ID NO: 306916 - protein, 8 aa, Influenza virus
LLVGIGNL

SEQ ID NO: 306917 - protein, 8 aa, Influenza virus
GIGNLAFN

SEQ ID NO: 306918 - protein, 8 aa, Influenza virus
FNTVIHER

SEQ ID NO: 306919 - protein, 8 aa, Influenza virus
AIVTREPY

SEQ ID NO: 306920 - protein, 8 aa, Influenza virus
VCWSFALA

SEQ ID NO: 306921 - protein, 8 aa, Influenza virus
NGTIRDRT

SEQ ID NO: 306922 - protein, 8 aa, Influenza virus
KDRAPYRS

SEQ ID NO: 306923 - protein, 8 aa, Influenza virus
APYRSLIR

SEQ ID NO: 306924 - protein, 8 aa, Influenza virus
EMCIAWSS

SEQ ID NO: 306925 - protein, 8 aa, Influenza virus
NDILRTQE

SEQ ID NO: 306926 - protein, 8 aa, Influenza virus
VTDDPAAN

SEQ ID NO: 306927 - protein, 8 aa, Influenza virus
TDDPAANS

SEQ ID NO: 306928 - protein, 8 aa, Influenza virus
DDPAANSA

SEQ ID NO: 306929 - protein, 8 aa, Influenza virus
DYRVYWIR

SEQ ID NO: 306930 - protein, 8 aa, Influenza virus
KIRHLEEC

SEQ ID NO: 306931 - protein, 8 aa, Influenza virus
NRPWIRIN

SEQ ID NO: 306932 - protein, 8 aa, Influenza virus
RPWIRINN

SEQ ID NO: 306933 - protein, 8 aa, Influenza virus
PWIRINNE

SEQ ID NO: 306934 - protein, 8 aa, Influenza virus
WIRINNET

SEQ ID NO: 306935 - protein, 8 aa, Influenza virus
IRINNETI

SEQ ID NO: 306936 - protein, 8 aa, Influenza virus
RINNETIV

SEQ ID NO: 306937 - protein, 8 aa, Influenza virus
INNETIVE

SEQ ID NO: 306938 - protein, 8 aa, Influenza virus
HSDTPRPT

SEQ ID NO: 306939 - protein, 8 aa, Influenza virus
SDTPRPTD

SEQ ID NO: 306940 - protein, 8 aa, Influenza virus
DTPRPTDP

SEQ ID NO: 306941 - protein, 8 aa, Influenza virus
TPRPTDPS

SEQ ID NO: 306942 - protein, 8 aa, Influenza virus
RPGVKGFG

SEQ ID NO: 306943 - protein, 8 aa, Influenza virus
SNDVWLGR

SEQ ID NO: 306944 - protein, 8 aa, Influenza virus
IRVAEGWI

SEQ ID NO: 306945 - protein, 8 aa, Influenza virus
ELIRGRLN

SEQ ID NO: 306946 - protein, 8 aa, Influenza virus
DGSKIGFM

SEQ ID NO: 306947 - protein, 8 aa, Influenza virus
GSKIGFMP

SEQ ID NO: 306948 - protein, 8 aa, Influenza virus
VGLLLQVT

SEQ ID NO: 306949 - protein, 8 aa, Influenza virus
HYNQVAQT

SEQ ID NO: 306950 - protein, 8 aa, Influenza virus
VSCSIHEC

SEQ ID NO: 306951 - protein, 8 aa, Influenza virus
SCSIHECR

SEQ ID NO: 306952 - protein, 8 aa, Influenza virus
CSVSECRT

SEQ ID NO: 306953 - protein, 8 aa, Influenza virus
SIHECRTF

SEQ ID NO: 306954 - protein, 8 aa, Influenza virus
IHECRTFF

SEQ ID NO: 306955 - protein, 8 aa, Influenza virus
DVDAIGFH

SEQ ID NO: 306956 - protein, 8 aa, Influenza virus
AIGFHFEE

SEQ ID NO: 306957 - protein, 8 aa, Influenza virus
TGFHLEEC

SEQ ID NO: 306958 - protein, 8 aa, Influenza virus
SIECVCRD

SEQ ID NO: 306959 - protein, 8 aa, Influenza virus
DSPRPVDG

SEQ ID NO: 306960 - protein, 8 aa, Influenza virus
PRSVDGTG

SEQ ID NO: 306961 - protein, 8 aa, Influenza virus
RSVDGTGS

SEQ ID NO: 306962 - protein, 8 aa, Influenza virus
PMDGTGSC

SEQ ID NO: 306963 - protein, 8 aa, Influenza virus
GVNSNTTG

SEQ ID NO: 306964 - protein, 8 aa, Influenza virus
VNSDTTCW

SEQ ID NO: 306965 - protein, 8 aa, Influenza virus
ITIGSMSL

SEQ ID NO: 306966 - protein, 8 aa, Influenza virus
TLGSVSLA

SEQ ID NO: 306967 - protein, 8 aa, Influenza virus
IGSMSLAL

SEQ ID NO: 306968 - protein, 8 aa, Influenza virus
GSVSLTLV

SEQ ID NO: 306969 - protein, 8 aa, Influenza virus
TTEMYNET

SEQ ID NO: 306970 - protein, 8 aa, Influenza virus
NETVRVEI

SEQ ID NO: 306971 - protein, 8 aa, Influenza virus
ETVRVEIA

SEQ ID NO: 306972 - protein, 8 aa, Influenza virus
VVIPVNNT

SEQ ID NO: 306973 - protein, 8 aa, Influenza virus
TIPINNTI

SEQ ID NO: 306974 - protein, 8 aa, Influenza virus
CEISGFAI

SEQ ID NO: 306975 - protein, 8 aa, Influenza virus
SGFAVVSK

SEQ ID NO: 306976 - protein, 8 aa, Influenza virus
GFAVVSKD

SEQ ID NO: 306977 - protein, 8 aa, Influenza virus
FAVVSKDN

SEQ ID NO: 306978 - protein, 8 aa, Influenza virus
VIVSKDNG

SEQ ID NO: 306979 - protein, 8 aa, Influenza virus
PFVACSPS

SEQ ID NO: 306980 - protein, 8 aa, Influenza virus
FVACSPSE

SEQ ID NO: 306981 - protein, 8 aa, Influenza virus
VACSPSEC

SEQ ID NO: 306982 - protein, 8 aa, Influenza virus
ACSPSECR

SEQ ID NO: 306983 - protein, 8 aa, Influenza virus
CHDGKKWM

SEQ ID NO: 306984 - protein, 8 aa, Influenza virus
WLAIGISG

SEQ ID NO: 306985 - protein, 8 aa, Influenza virus
GGVPTDVM

SEQ ID NO: 306986 - protein, 8 aa, Influenza virus
GIPTDVIR

SEQ ID NO: 306987 - protein, 8 aa, Influenza virus
VPTDVMRS

SEQ ID NO: 306988 - protein, 8 aa, Influenza virus
VVRSWRRQ

SEQ ID NO: 306989 - protein, 8 aa, Influenza virus
VRSWRRQI

SEQ ID NO: 306990 - protein, 8 aa, Influenza virus
ANNQASYR

SEQ ID NO: 306991 - protein, 8 aa, Influenza virus
NNQASYRI

SEQ ID NO: 306992 - protein, 8 aa, Influenza virus
SYRIFKSH

SEQ ID NO: 306993 - protein, 8 aa, Influenza virus
SCYPNLCQ

SEQ ID NO: 306994 - protein, 8 aa, Influenza virus
CYPNLCQV

SEQ ID NO: 306995 - protein, 8 aa, Influenza virus
YPNLCQVE

SEQ ID NO: 306996 - protein, 8 aa, Influenza virus
PNLCQVEC

SEQ ID NO: 306997 - protein, 8 aa, Influenza virus
NLCQVECV

SEQ ID NO: 306998 - protein, 8 aa, Influenza virus
LGIVECVC

SEQ ID NO: 306999 - protein, 8 aa, Influenza virus
DTPRFQDS

SEQ ID NO: 307000 - protein, 8 aa, Influenza virus
SAVGGSGT

SEQ ID NO: 307001 - protein, 8 aa, Influenza virus
NISSRSGF

SEQ ID NO: 307002 - protein, 8 aa, Influenza virus
EVLNNRNW

SEQ ID NO: 307003 - protein, 8 aa, Influenza virus
VLNNMNWS

SEQ ID NO: 307004 - protein, 8 aa, Influenza virus
SGAFTIPV

SEQ ID NO: 307005 - protein, 8 aa, Influenza virus
FTIPVTMT

SEQ ID NO: 307006 - protein, 8 aa, Influenza virus
PEEKTSIW

SEQ ID NO: 307007 - protein, 8 aa, Influenza virus
EERNSIWT

SEQ ID NO: 307008 - protein, 8 aa, Influenza virus
IICISAAG

SEQ ID NO: 307009 - protein, 8 aa, Influenza virus
CISATGMI

SEQ ID NO: 307010 - protein, 8 aa, Influenza virus
ISATGMAL

SEQ ID NO: 307011 - protein, 8 aa, Influenza virus
SATGMALS

SEQ ID NO: 307012 - protein, 8 aa, Influenza virus
ATGMALSV

SEQ ID NO: 307013 - protein, 8 aa, Influenza virus
ITNLGLNI

SEQ ID NO: 307014 - protein, 8 aa, Influenza virus
LVKPLCEV

SEQ ID NO: 307015 - protein, 8 aa, Influenza virus
AIRIGEGA

SEQ ID NO: 307016 - protein, 8 aa, Influenza virus
IRIGEGAH

SEQ ID NO: 307017 - protein, 8 aa, Influenza virus
RIGEGAHI

SEQ ID NO: 307018 - protein, 8 aa, Influenza virus
IGEGAHIL

SEQ ID NO: 307019 - protein, 8 aa, Influenza virus
GAHILVTR

SEQ ID NO: 307020 - protein, 8 aa, Influenza virus
TINDRSPF

SEQ ID NO: 307021 - protein, 8 aa, Influenza virus
INDRSPFR

SEQ ID NO: 307022 - protein, 8 aa, Influenza virus
STSCHDGK

SEQ ID NO: 307023 - protein, 8 aa, Influenza virus
TSCHDGKS

SEQ ID NO: 307024 - protein, 8 aa, Influenza virus
SCHDGKSR

SEQ ID NO: 307025 - protein, 8 aa, Influenza virus
CHDGKSRM

SEQ ID NO: 307026 - protein, 8 aa, Influenza virus
HDGKSRMS

SEQ ID NO: 307027 - protein, 8 aa, Influenza virus
HDGICPVV

SEQ ID NO: 307028 - protein, 8 aa, Influenza virus
MTDGPADN

SEQ ID NO: 307029 - protein, 8 aa, Influenza virus
TDGPANSR

SEQ ID NO: 307030 - protein, 8 aa, Influenza virus
DGPANSRA

SEQ ID NO: 307031 - protein, 8 aa, Influenza virus
NRPVIIIN

SEQ ID NO: 307032 - protein, 8 aa, Influenza virus
MTHISKYL

SEQ ID NO: 307033 - protein, 8 aa, Influenza virus
THISKYLC

SEQ ID NO: 307034 - protein, 8 aa, Influenza virus
HISKYLCS

SEQ ID NO: 307035 - protein, 8 aa, Influenza virus
YLCSKTLT

SEQ ID NO: 307036 - protein, 8 aa, Influenza virus
LCSKTLTD

SEQ ID NO: 307037 - protein, 8 aa, Influenza virus
CSKTLTDT

SEQ ID NO: 307038 - protein, 8 aa, Influenza virus
SKTLTDTS

SEQ ID NO: 307039 - protein, 8 aa, Influenza virus
KTLTDTSR

SEQ ID NO: 307040 - protein, 8 aa, Influenza virus
DNSWLGRT

SEQ ID NO: 307041 - protein, 8 aa, Influenza virus
TRSGYEML

SEQ ID NO: 307042 - protein, 8 aa, Influenza virus
YEMLKVPD

SEQ ID NO: 307043 - protein, 8 aa, Influenza virus
EMLKVPDA

SEQ ID NO: 307044 - protein, 8 aa, Influenza virus
MLKVPDAE

SEQ ID NO: 307045 - protein, 8 aa, Influenza virus
IRGRPEES

SEQ ID NO: 307046 - protein, 8 aa, Influenza virus
ESSVWWTS

SEQ ID NO: 307047 - protein, 8 aa, Influenza virus
SGVLWTSN

SEQ ID NO: 307048 - protein, 8 aa, Influenza virus
LNLLIGVS

SEQ ID NO: 307049 - protein, 8 aa, Influenza virus
LIGISNVV

SEQ ID NO: 307050 - protein, 8 aa, Influenza virus
SNIGLNVS

SEQ ID NO: 307051 - protein, 8 aa, Influenza virus
NIGLNVSL

SEQ ID NO: 307052 - protein, 8 aa, Influenza virus
VGLKVSLH

SEQ ID NO: 307053 - protein, 8 aa, Influenza virus
KYVNNTTI

SEQ ID NO: 307054 - protein, 8 aa, Influenza virus
MLSKSLCK

SEQ ID NO: 307055 - protein, 8 aa, Influenza virus
LCKVEEWV

SEQ ID NO: 307056 - protein, 8 aa, Influenza virus
VIEKDNAV

SEQ ID NO: 307057 - protein, 8 aa, Influenza virus
NGTIHDRN

SEQ ID NO: 307058 - protein, 8 aa, Influenza virus
TINDRTAF

SEQ ID NO: 307059 - protein, 8 aa, Influenza virus
IHDRAAFR

SEQ ID NO: 307060 - protein, 8 aa, Influenza virus
RTTFRGLI

SEQ ID NO: 307061 - protein, 8 aa, Influenza virus
STQLGTPP

SEQ ID NO: 307062 - protein, 8 aa, Influenza virus
SNSEFLCV

SEQ ID NO: 307063 - protein, 8 aa, Influenza virus
NSEFLCVG

SEQ ID NO: 307064 - protein, 8 aa, Influenza virus
SEFLCVGW

SEQ ID NO: 307065 - protein, 8 aa, Influenza virus
EFLCVGWS

SEQ ID NO: 307066 - protein, 8 aa, Influenza virus
CHDGVNRM

SEQ ID NO: 307067 - protein, 8 aa, Influenza virus
HDGVSRMT

SEQ ID NO: 307068 - protein, 8 aa, Influenza virus
DGVSRMTI

SEQ ID NO: 307069 - protein, 8 aa, Influenza virus
GVNRMTIC

SEQ ID NO: 307070 - protein, 8 aa, Influenza virus
ARMTICIQ

SEQ ID NO: 307071 - protein, 8 aa, Influenza virus
QGNNKNAT

SEQ ID NO: 307072 - protein, 8 aa, Influenza virus
GNNKNATA

SEQ ID NO: 307073 - protein, 8 aa, Influenza virus
NNKNATAT

SEQ ID NO: 307074 - protein, 8 aa, Influenza virus
ERRLTTTI

SEQ ID NO: 307075 - protein, 8 aa, Influenza virus
TIKPWARN

SEQ ID NO: 307076 - protein, 8 aa, Influenza virus
IKPWARNI

SEQ ID NO: 307077 - protein, 8 aa, Influenza virus
KPWARNIL

SEQ ID NO: 307078 - protein, 8 aa, Influenza virus
PWARNILR

SEQ ID NO: 307079 - protein, 8 aa, Influenza virus
VRHNGTCA

SEQ ID NO: 307080 - protein, 8 aa, Influenza virus
GTCVAVMT

SEQ ID NO: 307081 - protein, 8 aa, Influenza virus
IMTDGSAN

SEQ ID NO: 307082 - protein, 8 aa, Influenza virus
TDGPANSQ

SEQ ID NO: 307083 - protein, 8 aa, Influenza virus
DGSANSQA

SEQ ID NO: 307084 - protein, 8 aa, Influenza virus
ASGQAYTK

SEQ ID NO: 307085 - protein, 8 aa, Influenza virus
KVSCVCRD

SEQ ID NO: 307086 - protein, 8 aa, Influenza virus
DTSRPSDR

SEQ ID NO: 307087 - protein, 8 aa, Influenza virus
KGFGFLDN

SEQ ID NO: 307088 - protein, 8 aa, Influenza virus
GRTISPHS

SEQ ID NO: 307089 - protein, 8 aa, Influenza virus
RTISPHSR

SEQ ID NO: 307090 - protein, 8 aa, Influenza virus
TISPRSRN

SEQ ID NO: 307091 - protein, 8 aa, Influenza virus
ISPHSRSG

SEQ ID NO: 307092 - protein, 8 aa, Influenza virus
MLKIHNAG

SEQ ID NO: 307093 - protein, 8 aa, Influenza virus
LKVPNAGT

SEQ ID NO: 307094 - protein, 8 aa, Influenza virus
KVPNAGTD

SEQ ID NO: 307095 - protein, 8 aa, Influenza virus
VPNAGTDP

SEQ ID NO: 307096 - protein, 8 aa, Influenza virus
SACYNPCF

SEQ ID NO: 307097 - protein, 8 aa, Influenza virus
IALCGSPV

SEQ ID NO: 307098 - protein, 8 aa, Influenza virus
LPDGAQIQ

SEQ ID NO: 307099 - protein, 8 aa, Influenza virus
LMSVGIGQ

SEQ ID NO: 307100 - protein, 8 aa, Influenza virus
MSVGIGQS

SEQ ID NO: 307101 - protein, 8 aa, Influenza virus
YQAKFEAV

SEQ ID NO: 307102 - protein, 8 aa, Influenza virus
QAKFEAVA

SEQ ID NO: 307103 - protein, 8 aa, Influenza virus
AKFEAVAW

SEQ ID NO: 307104 - protein, 8 aa, Influenza virus
KWMAVGVT

SEQ ID NO: 307105 - protein, 8 aa, Influenza virus
WMTIGVSG

SEQ ID NO: 307106 - protein, 8 aa, Influenza virus
AVGVTGPD

SEQ ID NO: 307107 - protein, 8 aa, Influenza virus
WAGDTLRT

SEQ ID NO: 307108 - protein, 8 aa, Influenza virus
AEDILRTQ

SEQ ID NO: 307109 - protein, 8 aa, Influenza virus
FTEGHIEE

SEQ ID NO: 307110 - protein, 8 aa, Influenza virus
TEGHIEEC

SEQ ID NO: 307111 - protein, 8 aa, Influenza virus
LVVSPDLS

SEQ ID NO: 307112 - protein, 8 aa, Influenza virus
VVSPDLSY

SEQ ID NO: 307113 - protein, 8 aa, Influenza virus
LSYSVGYL

SEQ ID NO: 307114 - protein, 8 aa, Influenza virus
SYSVGYLC

SEQ ID NO: 307115 - protein, 8 aa, Influenza virus
YSVGYLCA

SEQ ID NO: 307116 - protein, 8 aa, Influenza virus
SVGYLCAG

SEQ ID NO: 307117 - protein, 8 aa, Influenza virus
DVWMGRTL

SEQ ID NO: 307118 - protein, 8 aa, Influenza virus
VWVGRTIS

SEQ ID NO: 307119 - protein, 8 aa, Influenza virus
RTSRTGFE

SEQ ID NO: 307120 - protein, 8 aa, Influenza virus
ECLVPCFW

SEQ ID NO: 307121 - protein, 8 aa, Influenza virus
IVMCGVEH

SEQ ID NO: 307122 - protein, 8 aa, Influenza virus
DGAILPLT

SEQ ID NO: 307123 - protein, 8 aa, Influenza virus
GAILPFGI

SEQ ID NO: 307124 - protein, 8 aa, Influenza virus
AILPFDIN

SEQ ID NO: 307125 - protein, 8 aa, Influenza virus
RILCTSAT

SEQ ID NO: 307126 - protein, 8 aa, Influenza virus
LFASATAI

SEQ ID NO: 307127 - protein, 8 aa, Influenza virus
GTANLGLN

SEQ ID NO: 307128 - protein, 8 aa, Influenza virus
ITQVSNTN

SEQ ID NO: 307129 - protein, 8 aa, Influenza virus
NLTRGLCK

SEQ ID NO: 307130 - protein, 8 aa, Influenza virus
LTRGLCKI

SEQ ID NO: 307131 - protein, 8 aa, Influenza virus
TKGLCIIN

SEQ ID NO: 307132 - protein, 8 aa, Influenza virus
KELCTINS

SEQ ID NO: 307133 - protein, 8 aa, Influenza virus
NAVRIGEK

SEQ ID NO: 307134 - protein, 8 aa, Influenza virus
AVRIGESS

SEQ ID NO: 307135 - protein, 8 aa, Influenza virus
RIGENSGV

SEQ ID NO: 307136 - protein, 8 aa, Influenza virus
IGESSDVL

SEQ ID NO: 307137 - protein, 8 aa, Influenza virus
GENSGVLV

SEQ ID NO: 307138 - protein, 8 aa, Influenza virus
ESSDVLVT

SEQ ID NO: 307139 - protein, 8 aa, Influenza virus
PPTVYNTK

SEQ ID NO: 307140 - protein, 8 aa, Influenza virus
TSCHDGKT

SEQ ID NO: 307141 - protein, 8 aa, Influenza virus
ASPVIWYN

SEQ ID NO: 307142 - protein, 8 aa, Influenza virus
GRPTTEIN

SEQ ID NO: 307143 - protein, 8 aa, Influenza virus
HDGVCPVV

SEQ ID NO: 307144 - protein, 8 aa, Influenza virus
TRVYYFKK

SEQ ID NO: 307145 - protein, 8 aa, Influenza virus
RVYYFKGG

SEQ ID NO: 307146 - protein, 8 aa, Influenza virus
EGKIIKWE

SEQ ID NO: 307147 - protein, 8 aa, Influenza virus
GKIIKWEP

SEQ ID NO: 307148 - protein, 8 aa, Influenza virus
KIIKWEPL

SEQ ID NO: 307149 - protein, 8 aa, Influenza virus
KWESLNGT

SEQ ID NO: 307150 - protein, 8 aa, Influenza virus
WESLNGTA

SEQ ID NO: 307151 - protein, 8 aa, Influenza virus
AMKHTSQY

SEQ ID NO: 307152 - protein, 8 aa, Influenza virus
NPRPNDPS

SEQ ID NO: 307153 - protein, 8 aa, Influenza virus
FNTWLGRT

SEQ ID NO: 307154 - protein, 8 aa, Influenza virus
TTSTASRS

SEQ ID NO: 307155 - protein, 8 aa, Influenza virus
LNTASRSG

SEQ ID NO: 307156 - protein, 8 aa, Influenza virus
ALIDDRSK

SEQ ID NO: 307157 - protein, 8 aa, Influenza virus
LTDDRSTP

SEQ ID NO: 307158 - protein, 8 aa, Influenza virus
RSKPAQGQ

SEQ ID NO: 307159 - protein, 8 aa, Influenza virus
SKPIQGQI

SEQ ID NO: 307160 - protein, 8 aa, Influenza virus
PAQGQTIV

SEQ ID NO: 307161 - protein, 8 aa, Influenza virus
FIDYWAKE

SEQ ID NO: 307162 - protein, 8 aa, Influenza virus
DYWAKEEC

SEQ ID NO: 307163 - protein, 8 aa, Influenza virus
YWAKEECY

SEQ ID NO: 307164 - protein, 8 aa, Influenza virus
WAKEECYR

SEQ ID NO: 307165 - protein, 8 aa, Influenza virus
AKEECYRA

SEQ ID NO: 307166 - protein, 8 aa, Influenza virus
KEECYRAC

SEQ ID NO: 307167 - protein, 8 aa, Influenza virus
MEEVTNAT

SEQ ID NO: 307168 - protein, 8 aa, Influenza virus
GNCHPIGI

SEQ ID NO: 307169 - protein, 8 aa, Influenza virus
HLTGTWNT

SEQ ID NO: 307170 - protein, 8 aa, Influenza virus
GMWDTLIE

SEQ ID NO: 307171 - protein, 8 aa, Influenza virus
KWDTPIER

SEQ ID NO: 307172 - protein, 8 aa, Influenza virus
WDTLIERK

SEQ ID NO: 307173 - protein, 8 aa, Influenza virus
AYCYPGVT

SEQ ID NO: 307174 - protein, 8 aa, Influenza virus
INEGALRQ

SEQ ID NO: 307175 - protein, 8 aa, Influenza virus
MESGEIDK

SEQ ID NO: 307176 - protein, 8 aa, Influenza virus
SFYSELKW

SEQ ID NO: 307177 - protein, 8 aa, Influenza virus
FYAEVKWL

SEQ ID NO: 307178 - protein, 8 aa, Influenza virus
EVKWLVSK

SEQ ID NO: 307179 - protein, 8 aa, Influenza virus
KGRNFPQT

SEQ ID NO: 307180 - protein, 8 aa, Influenza virus
GRNFPQTT

SEQ ID NO: 307181 - protein, 8 aa, Influenza virus
LWGIHHPS

SEQ ID NO: 307182 - protein, 8 aa, Influenza virus
EKNNLYGT

SEQ ID NO: 307183 - protein, 8 aa, Influenza virus
NNFVPVMG

SEQ ID NO: 307184 - protein, 8 aa, Influenza virus
NFVPVMGA

SEQ ID NO: 307185 - protein, 8 aa, Influenza virus
PVVGARPK

SEQ ID NO: 307186 - protein, 8 aa, Influenza virus
VVGARPLV

SEQ ID NO: 307187 - protein, 8 aa, Influenza virus
VGDRPLVN

SEQ ID NO: 307188 - protein, 8 aa, Influenza virus
NGQSGRIV

SEQ ID NO: 307189 - protein, 8 aa, Influenza virus
GQSGRIVF

SEQ ID NO: 307190 - protein, 8 aa, Influenza virus
QRGRIDFH

SEQ ID NO: 307191 - protein, 8 aa, Influenza virus
SGRIVFHW

SEQ ID NO: 307192 - protein, 8 aa, Influenza virus
GRINFHWT

SEQ ID NO: 307193 - protein, 8 aa, Influenza virus
QPGDNIIF

SEQ ID NO: 307194 - protein, 8 aa, Influenza virus
GDHITFSH

SEQ ID NO: 307195 - protein, 8 aa, Influenza virus
DNITFSDN

SEQ ID NO: 307196 - protein, 8 aa, Influenza virus
IAPSRVGK

SEQ ID NO: 307197 - protein, 8 aa, Influenza virus
APNRVSKL

SEQ ID NO: 307198 - protein, 8 aa, Influenza virus
GRDLGIQS

SEQ ID NO: 307199 - protein, 8 aa, Influenza virus
FWKGGTIN

SEQ ID NO: 307200 - protein, 8 aa, Influenza virus
WREGSINT

SEQ ID NO: 307201 - protein, 8 aa, Influenza virus
SGSINTKL

SEQ ID NO: 307202 - protein, 8 aa, Influenza virus
QCPKYVSQ

SEQ ID NO: 307203 - protein, 8 aa, Influenza virus
GSLLLATG

SEQ ID NO: 307204 - protein, 8 aa, Influenza virus
YESTQAAI

SEQ ID NO: 307205 - protein, 8 aa, Influenza virus
AINQITGK

SEQ ID NO: 307206 - protein, 8 aa, Influenza virus
IVQITGKL

SEQ ID NO: 307207 - protein, 8 aa, Influenza virus
NEIEYQIG

SEQ ID NO: 307208 - protein, 8 aa, Influenza virus
GCFEIYHV

SEQ ID NO: 307209 - protein, 8 aa, Influenza virus
WFEIYHTC

SEQ ID NO: 307210 - protein, 8 aa, Influenza virus
FEIYHKCN

SEQ ID NO: 307211 - protein, 8 aa, Influenza virus
DCMESIRN

SEQ ID NO: 307212 - protein, 8 aa, Influenza virus
NNTYNHTQ

SEQ ID NO: 307213 - protein, 8 aa, Influenza virus
NTYDHSHY

SEQ ID NO: 307214 - protein, 8 aa, Influenza virus
TYNHTQYR

SEQ ID NO: 307215 - protein, 8 aa, Influenza virus
YDHSHYRE

SEQ ID NO: 307216 - protein, 8 aa, Influenza virus
NHTQYREE

SEQ ID NO: 307217 - protein, 8 aa, Influenza virus
HTQYREES

SEQ ID NO: 307218 - protein, 8 aa, Influenza virus
TQYREESL

SEQ ID NO: 307219 - protein, 8 aa, Influenza virus
NPVELSSG

SEQ ID NO: 307220 - protein, 8 aa, Influenza virus
SVKLFSGY

SEQ ID NO: 307221 - protein, 8 aa, Influenza virus
KLSSGYKN

SEQ ID NO: 307222 - protein, 8 aa, Influenza virus
SCFVLLAI

SEQ ID NO: 307223 - protein, 8 aa, Influenza virus
HAVTNGTI

SEQ ID NO: 307224 - protein, 8 aa, Influenza virus
ANGTVVKT

SEQ ID NO: 307225 - protein, 8 aa, Influenza virus
IKTLTNEK

SEQ ID NO: 307226 - protein, 8 aa, Influenza virus
TLTNEREE

SEQ ID NO: 307227 - protein, 8 aa, Influenza virus
LTNEREEV

SEQ ID NO: 307228 - protein, 8 aa, Influenza virus
EHEEVTNA

SEQ ID NO: 307229 - protein, 8 aa, Influenza virus
REEVTNAT

SEQ ID NO: 307230 - protein, 8 aa, Influenza virus
HRDLGNCH

SEQ ID NO: 307231 - protein, 8 aa, Influenza virus
NCHPVGML

SEQ ID NO: 307232 - protein, 8 aa, Influenza virus
CHPIGMVV

SEQ ID NO: 307233 - protein, 8 aa, Influenza virus
HPIGMVVG

SEQ ID NO: 307234 - protein, 8 aa, Influenza virus
VGTPACDL

SEQ ID NO: 307235 - protein, 8 aa, Influenza virus
GAPSCDLH

SEQ ID NO: 307236 - protein, 8 aa, Influenza virus
APSCDLHL

SEQ ID NO: 307237 - protein, 8 aa, Influenza virus
CDLHLTGK

SEQ ID NO: 307238 - protein, 8 aa, Influenza virus
DLHLTGKW

SEQ ID NO: 307239 - protein, 8 aa, Influenza virus
LHLTGKWD

SEQ ID NO: 307240 - protein, 8 aa, Influenza virus
TLIERDNA

SEQ ID NO: 307241 - protein, 8 aa, Influenza virus
IANCYPGA

SEQ ID NO: 307242 - protein, 8 aa, Influenza virus
YCYPGATM

SEQ ID NO: 307243 - protein, 8 aa, Influenza virus
PGSTVNEE

SEQ ID NO: 307244 - protein, 8 aa, Influenza virus
GSTVNEEA

SEQ ID NO: 307245 - protein, 8 aa, Influenza virus
STVNEEAL

SEQ ID NO: 307246 - protein, 8 aa, Influenza virus
SGGIDKVS

SEQ ID NO: 307247 - protein, 8 aa, Influenza virus
GGIDKVST

SEQ ID NO: 307248 - protein, 8 aa, Influenza virus
FTYGSSIT

SEQ ID NO: 307249 - protein, 8 aa, Influenza virus
TYGSSITS

SEQ ID NO: 307250 - protein, 8 aa, Influenza virus
SITSAGTT

SEQ ID NO: 307251 - protein, 8 aa, Influenza virus
LKWLVSKD

SEQ ID NO: 307252 - protein, 8 aa, Influenza virus
KWLVSKDK

SEQ ID NO: 307253 - protein, 8 aa, Influenza virus
WLVSKDKG

SEQ ID NO: 307254 - protein, 8 aa, Influenza virus
LISKSKEQ

SEQ ID NO: 307255 - protein, 8 aa, Influenza virus
KGQSFPQT

SEQ ID NO: 307256 - protein, 8 aa, Influenza virus
QSFPQTTN

SEQ ID NO: 307257 - protein, 8 aa, Influenza virus
EHLVMWGI

SEQ ID NO: 307258 - protein, 8 aa, Influenza virus
HLVMWGIH

SEQ ID NO: 307259 - protein, 8 aa, Influenza virus
IIMWGIHH

SEQ ID NO: 307260 - protein, 8 aa, Influenza virus
SSTQERND

SEQ ID NO: 307261 - protein, 8 aa, Influenza virus
STQEKNAL

SEQ ID NO: 307262 - protein, 8 aa, Influenza virus
TQEKNALY

SEQ ID NO: 307263 - protein, 8 aa, Influenza virus
IVRPGDNI

SEQ ID NO: 307264 - protein, 8 aa, Influenza virus
PSRVSKLI

SEQ ID NO: 307265 - protein, 8 aa, Influenza virus
SRVSKLIG

SEQ ID NO: 307266 - protein, 8 aa, Influenza virus
KGLGIQSG

SEQ ID NO: 307267 - protein, 8 aa, Influenza virus
GLGIQSGV

SEQ ID NO: 307268 - protein, 8 aa, Influenza virus
GSLLLATG

SEQ ID NO: 307269 - protein, 8 aa, Influenza virus
FEIYHKCN

SEQ ID NO: 307270 - protein, 8 aa, Influenza virus
CNDNCMES

SEQ ID NO: 307271 - protein, 8 aa, Influenza virus
NDNCMESI

SEQ ID NO: 307272 - protein, 8 aa, Influenza virus
CFVLLADV

SEQ ID NO: 307273 - protein, 8 aa, Influenza virus
LLADVMGL

SEQ ID NO: 307274 - protein, 8 aa, Influenza virus
ALSGVAIT

SEQ ID NO: 307275 - protein, 8 aa, Influenza virus
SGVAITLS

SEQ ID NO: 307276 - protein, 8 aa, Influenza virus
VNKTTVIN

SEQ ID NO: 307277 - protein, 8 aa, Influenza virus
NNTTIISK

SEQ ID NO: 307278 - protein, 8 aa, Influenza virus
MLSKSLCK

SEQ ID NO: 307279 - protein, 8 aa, Influenza virus
CDPIGCKM

SEQ ID NO: 307280 - protein, 8 aa, Influenza virus
DPIGCKMY

SEQ ID NO: 307281 - protein, 8 aa, Influenza virus
PIGCKMYA

SEQ ID NO: 307282 - protein, 8 aa, Influenza virus
LGCKTYAL

SEQ ID NO: 307283 - protein, 8 aa, Influenza virus
PPMVSNSD

SEQ ID NO: 307284 - protein, 8 aa, Influenza virus
PMVSNSDF

SEQ ID NO: 307285 - protein, 8 aa, Influenza virus
GPASSQAY

SEQ ID NO: 307286 - protein, 8 aa, Influenza virus
SANSQAYT

SEQ ID NO: 307287 - protein, 8 aa, Influenza virus
SGQAYTKV

SEQ ID NO: 307288 - protein, 8 aa, Influenza virus
QAHTKILY

SEQ ID NO: 307289 - protein, 8 aa, Influenza virus
AYTKILYF

SEQ ID NO: 307290 - protein, 8 aa, Influenza virus
HTKILYFH

SEQ ID NO: 307291 - protein, 8 aa, Influenza virus
ILYFHKGL

SEQ ID NO: 307292 - protein, 8 aa, Influenza virus
LYFHKGLL

SEQ ID NO: 307293 - protein, 8 aa, Influenza virus
YFHKGLLI

SEQ ID NO: 307294 - protein, 8 aa, Influenza virus
FHKGLLIK

SEQ ID NO: 307295 - protein, 8 aa, Influenza virus
HKGLLIKE

SEQ ID NO: 307296 - protein, 8 aa, Influenza virus
KGLLIKEE

SEQ ID NO: 307297 - protein, 8 aa, Influenza virus
KEETLKGS

SEQ ID NO: 307298 - protein, 8 aa, Influenza virus
EEALQGSA

SEQ ID NO: 307299 - protein, 8 aa, Influenza virus
EALQGSAR

SEQ ID NO: 307300 - protein, 8 aa, Influenza virus
ALQGSARH

SEQ ID NO: 307301 - protein, 8 aa, Influenza virus
CYGHSQKA

SEQ ID NO: 307302 - protein, 8 aa, Influenza virus
YGHSQKAT

SEQ ID NO: 307303 - protein, 8 aa, Influenza virus
GHNQKVTC

SEQ ID NO: 307304 - protein, 8 aa, Influenza virus
NRPIIEIN

SEQ ID NO: 307305 - protein, 8 aa, Influenza virus
RPAIEIDM

SEQ ID NO: 307306 - protein, 8 aa, Influenza virus
IIERQEIV

SEQ ID NO: 307307 - protein, 8 aa, Influenza virus
TERQEVVD

SEQ ID NO: 307308 - protein, 8 aa, Influenza virus
NNNLSGYS

SEQ ID NO: 307309 - protein, 8 aa, Influenza virus
RNWSGYSG

SEQ ID NO: 307310 - protein, 8 aa, Influenza virus
SACYNPCF

SEQ ID NO: 307311 - protein, 8 aa, Influenza virus
EYTGSFCS

SEQ ID NO: 307312 - protein, 8 aa, Influenza virus
FCSINGKE

SEQ ID NO: 307313 - protein, 8 aa, Influenza virus
CSINGRAP

SEQ ID NO: 307314 - protein, 8 aa, Influenza virus
SINGKEPI

SEQ ID NO: 307315 - protein, 8 aa, Influenza virus
LDGKAPIS

SEQ ID NO: 307316 - protein, 8 aa, Influenza virus
LGNPMCDN

SEQ ID NO: 307317 - protein, 8 aa, Influenza virus
GNPMCDYL

SEQ ID NO: 307318 - protein, 8 aa, Influenza virus
NPMCDYLI

SEQ ID NO: 307319 - protein, 8 aa, Influenza virus
PMCDYLIG

SEQ ID NO: 307320 - protein, 8 aa, Influenza virus
MCDYLIGK

SEQ ID NO: 307321 - protein, 8 aa, Influenza virus
CDDLIEKT

SEQ ID NO: 307322 - protein, 8 aa, Influenza virus
DDLIGKNS

SEQ ID NO: 307323 - protein, 8 aa, Influenza virus
DLIEKTSW

SEQ ID NO: 307324 - protein, 8 aa, Influenza virus
MVWLIYQS

SEQ ID NO: 307325 - protein, 8 aa, Influenza virus
WLIYQSGT

SEQ ID NO: 307326 - protein, 8 aa, Influenza virus
LTHQSGTY

SEQ ID NO: 307327 - protein, 8 aa, Influenza virus
THQSGTYP

SEQ ID NO: 307328 - protein, 8 aa, Influenza virus
RTFNNTKE

SEQ ID NO: 307329 - protein, 8 aa, Influenza virus
FNNTKERD

SEQ ID NO: 307330 - protein, 8 aa, Influenza virus
NNTKERDV

SEQ ID NO: 307331 - protein, 8 aa, Influenza virus
SLYKKDNS

SEQ ID NO: 307332 - protein, 8 aa, Influenza virus
YKKDTSYV

SEQ ID NO: 307333 - protein, 8 aa, Influenza virus
MTFYWTII

SEQ ID NO: 307334 - protein, 8 aa, Influenza virus
IIFESNGA

SEQ ID NO: 307335 - protein, 8 aa, Influenza virus
NGALLAPR

SEQ ID NO: 307336 - protein, 8 aa, Influenza virus
AFLAPRYS

SEQ ID NO: 307337 - protein, 8 aa, Influenza virus
FLAPRYSF
